United States Patent 6,812,339 (POLYMORPHISMS IN KNOWN GENES ASSOCIATED WITH HUMAN DISEASE, METHODS OF DETECTION AND USES THEREOF) - sequence listing, part 77

SEQ ID NO: 17189 - DNA, 255679 bp, Human
  misc_feature (1)...(255679): n = A,T,C or G
tatccctggaagttaatttaaaatatttagaagagttcttcctcatttcctagagacgtcgaattgtaaatatcagagctagaaggaacactagggctcgccactccaaagtgtggtccaaggaccagcagcatcaagtaacctgggaacgtgttagaaatgcagagtcttaggcctcaccccagacctactgaaccagaatctgcattaacaagatttctaggtgcctcacgggcacattaaaacttgagaagctctgcactagaaatcttcactccacctttcattataaatggaatcacttggctgtggtcacaggaaattgattatttttaatttcagaaccttctatttaggtcatctatatttgctaatagcagggaagaaagccaaactctttaactgcaattaacaaatctataattaattagttaagcaatcttccctttaagttttacattttgtggagcaagctgtttgatttggctggggctcaggccggcctgtttgtgaatttcacaattcacagatgttagccgctctcgggctaagtaaaggaagagaatgtcaagttttaaatagcttctcccttccatcctggctgaagcaacaaataaaatatttttatgaaacacattttgagttagatttacttacagggaaatgtcaaatttctctgaaagggctttagattgtctcacaactttgacatctactgatgtcacctatttacaggtgtgtcctgtgactagggggtgaagggaagatgtgaactcaccatgttagtgaccgttagatacacagagtggttttttttccccctgttggagtctatcctaactgagcttctgaatcatatttcattcaatttccaaatccacaaaaccaggataagtttacagcccatattcagaaaggaaataaattattttgtgtgtagactttcctgatattacactgatttgggaatatatgaacaattttatggtttcctttcgaagtaggtcaagtcaaagcaaaaccaaaaacagcaaaaactgtaagacataaagaatagagtggagccgactgagagattaaaataaactagaatatttttattaacaggcaatttgaaataatttgtgcacttcagaatattctacaataatatattatttccaattttaatatctttaagaaaattactatattatatgtaagtacatgtgcatgtgtttgaggtaggatatttaactcaataaaggttattttcttttattcgggtcaggcaaagcttctaaggggatgtgaaagggatatctctttctcttagctgagaggaagagtgagttctaagttaaatataatcaaggaatttccctgtctttgctatttgagattgtgaccacaacaggcggttggctgaaagggaaactgaagggcggggagggagggaaatagatgaaaaaacaaaacaaaacaaaacttccctaagcagctctacaaaacattttagccccagaaatagtcacagaaatcctcaaatcaaaccagtatccagatacaaggaagtgttatgtagctggagcagggtggacactcatcagctcagttcagttacaaaagtccaggctgctgaaattaaactctgatgccattcatgccagcatccaatcacgacagagatcagaagttcagagatgcctccagctccaaattgccaacaacaagtgtggctactatacgtcaaggactctgaagccgtgagagagggggaagaacaacagtagagaggatgcccagctggtaagaatcgagtgtttatgaagttttagtcaattgatgaatctcattggctaaaatcaagaaacgctccgcctctttgcaaatatgtatgaaggagagaagtgcctaaacttctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcggtgagtttgaatgtgacataacttctctcaaaacttaattgaagtgccttgtgtattatgaatgtgtcagctgtgtacaaagaacaattcctccttgtttagtcagcacagtgatattattttggactttctgtggacttaaagtggtctgtggacatattttctgaatgtcttttttggttgatatttggatctacaaagtgaaaaaatttgaagcgaatcttcccatttaaaaaaaattatcacgccatttaagaatgtttaaaatatattatttgccttgttcagcacctactcactcaataagaaatttcactgggcagggatataataatgtatggataatcttcaagtcaaaataaacaccaaataattctgatttatacattaagaaatagataactagccattgttgtaccaaacagattgtggcttgtcattgcattttataaggaatattttttggtatgtttgataatgaaatcttttgacaaatctgacttttaaagcttgtgattgtagtaaattttatttagaaacatttgcctagtactaagagagaatattagtgagggtgcacaattgtgtatgtgcttcaaattagactttgctatttttaaactggtaaatgaaatctgaacagtgtttttccagtcataaagttatgggagatattcaagtcatatgtagcaatgtgatgttagtttaacagcatgagatttcgtactttattttataagactaatgagagaggtcctttgcgtgttgaaaatggtgaggttacaaagggttaacttgccatttaccacctgtgtctgttggagcttgatactagaagcagattctgctctctctgggcaggactcacttactgtagactagtagagtgtgaaagatttgtgatcttcctttaacgtgatttgctacaacgtagaacactaatgtgagctatgtagattgtttctcttcctgtgaggtttctggtgggttgtgcgaaaaggcagaagagaaagagcaaggcagaaagataaatagaataaaggagataaaaagaaaagggtgaaaaaagagagaggggaagcaagtttggggtctccaaggtttcagtggaatttgttggtggtggcttgattcgtgtcttgctgtttaccacaaacaacaatattagcacaaataaatggctctaggatttatgttcttgtataatgtgaaaattagatctagctgcagttgaggattgggttgattaaaaagaaaaacaccaaagattttctggttctcaaaattgtttctaatctcaaaattatctattccattaaacatctttggaaataatagttctaagaagataattgtgatgaaatagtaactgtgtaatgctactcttgagggcatctctcctaaactaggtacttggaaccagggaagctttagaagaaacttccttctattgactaataacccacacttcaatcctgcatacatacctctctagaagcatttctaatgataagagaggcctataaatataaagaaatagagaaactactttttatattaccttgacgatctattagttcatgaagcaaatgtcatctcagtttttgacatactgtaatattctaagcaatcatagtatttttggtttttttttaacctttattttaagttcaggggtacaagtgcaagtttgttatacaggtaaacttgtgtcatgggggtttgttgtacagattatttcatcactcaggtactaagcctagtacccattagttatttttcctgatcctatccctcctcccaccttccaccctctgaaaggccccagcgtgtgttgttcccctctatgtgtccatgcgttgtcatcatttaactcccacttaacacgtgagaacatacagtatttggttttctgctcctgtgttagtttgctaaggataatggcctccggctccatccaagtccctgcaaaggacatgatctcattcttttttatggctacatagtatttttaagtagttttaaattttcctagaatgccctgggctttaatcatggtgcctgatacttttggggaaggcaggggagggcatgttgagaagctgtgagactatggttcagaatggccagggagcaattatttgcctaataaataattttaggcaagaatatgtacttctcatttgtaatgcaagcttaaccagcaaaaacattaaggtgatgaaacatagctcttactcagcatctgctctgcggaagacattgcaaatacaaaaaccaattagatgtgactgttacattcatttatttaatgttgcagtacttacatatttaatctaaaatatattttcctcaagtattttaactgtttgtcatgtgttttaaggactgaattattactattttccaacctttattacttagtgaataaacaagtgaataaatgaaatatcactgaaggaattagtatgataatgtatatggtcaaagcaaggatcaaacaatatgttctttgatacctcatgagtaaatgggtttgagctggtttttgtaagcagacaaccgttgtagttctcggtttacaaaaagctattttaagaaagaccaaatttaatcattccataatcatagtcatctacatagttaaatttgtctttactgaccttgtgtttagaaagaagtcatgaaagataattttttaaagaaagaacaggatatcttgatatttttaactccaagctaccttaatttatgaattcccttacagaatagaaaaaaaaatgacagatgttatcttttattactaaatgttaatgccattccaaaaaagtgtttaaatacatgtttcaaaggatgatggtaatcattctctaagttaaaattgggacttcatcctctgtttttttcctttccacttaaacatattaccatattgagcatttagttgtgccctgatgttaatgctaatttactttagtctttgcaaaaacttttctgaaaaccaaaaaggcagttaacaccttagagcttattaagttccccttttgataatattaacaatacaaagaggaaaaaagttggataaaatcacattaccatttgaatactaacttaatttttaaaatattgaactatagatgaaattataaaagttcaataaataagtcagtgggttcgttaccattaatttatgaatagaaacttgtacacaataaattctgtttgttgtttattttgtattaggtgaatattggaaatgaatctaaaatttaacacttcagaagatacatccttgttaatttattgtttgggctaaaacttgggcaattttccattctttcatttctagaatttccatctagtttgcaaaatttattttttaacaaagtacttttaatagattaaattctttcaaagtatttttttcaaaaaataaaccagttaaaatgataaacatgaatcaaaattaaattttgaaattatgtgatcactgagggctaagaattagagaaaagtaaacatcatttcaatttgaaccaccagtaaaatattttgtattgtttcttcttagtcatcctgtattccaaagaagcatcgaactattaaaatactatatggataatatgaagtgtgttttttgtgtgtgaattacatatttgttatgatttttattctttactggcgtaaaggtcaactttattagctgtactttctaaatatatcccaaaaggaagagtgatgacaatgaagttacagtggaagatcatttcatttgtaagttaaaatcacctaaaggcagatgcagctctgtgttgggcgtccttcacttgctcctccacatctgctctttttctttctcattctttgcctcaagaagctgcctcctgataattgctttaacaggtcttttcttctctggtttcctgttgaattcaaccagcagcaatctcctgcaggagagtgaagttggaatattggtttccctggctgactccctgttggtttttggctaaaggctgcagatcctctcagaggcccttgctgcaggtccgagtcccctgactttgagtagttactccctccccttccttttcttcaagcttaggaggagtaaccatttcccgccattgctaattctagggatccacatcatattccttaccccctcattaaactttcctcaatatcttttttcttgccagtatcatgctctttttcctgccaggatcatgacaactacacacattaaaaaagtatgccatgatgttgtttatgcacataagaagacttccaaaataattgatatagtaattaataatataatttttgatatgaggtaaatgatgaatccatccatttcaatgagcacactggcttttagccatctccgtaatcactaagtttctctgactgaaaggaatgagccaacatgctacagtctgcatatgttgtttatacacagttgtttatacacacttttaaagaaatattaagttacagtttatcttcagcatctaatatatccatcagttgtaatcaaaaaaaaatttttcagtctctaatgaataagcttcaaaatatatttatgaccaaccgtggttagccaaaagcacaatgccgctctattaccatgcgctgcatctaagcggtgagtgcatttaaatagcagagagtcatcttagcagagtgcacaaaggatttgcaaaagatctcaattgtagtaagtaaactccaccactaagtgattatgtgaccttcatgaaatcacttaagctatctaaatcaaagttcctcatgagttaagtagggataaaaacctctcatttactgttcacaactagaactttgagaaataaactcaactcaactctgaaatacacccctttagtgtacggtaagttctcacttaacattactgataggttcttggagattgtgattttaagcaaaaccgtatgtaactaacgaaaccaattttaccataggctaattgatataaacaacagttaagtttctatggcatatttcgggtcacaaaaccgccaccaatcttctaaatatagacccacaagatttctaatattaaacattgagataaatgtgagctacacatgtatttaagaaagattaatacaaggaagtaagataattatttgcccaatttttggtgaatcagtgagtgatggtcatagtggtagtacgttaaatcaaggaataaatctttgcaaagcaaaaattgtaaggagcacctcttaccaccacacagttcaaaatcaaatgaaaatatagcaggcttactgagcactttttgactgcatcgtttatcatcatgtattttatgattatcatagactttgtgaatttttattttacaataatgtatattcattcctttaattattttccaacctgcttattccagttcagggtctcagggccagagcctatctcagcagctcagggtggaaggtagaaaccaaccctggactggatgctattgcactgcaggacacacacacacacactcacaatggggcaatttagacacaccaatgaacctaatgtgcatatctttgaaatgtgggaggaaataggaatacctggaacatccatgtagacctggagagaacacaaaaactccacatagacagtgacctcagctgggaactgaattttttttttctcatcagcgttatatggaaaagacgttaaacaaaacatttttcatgacctgctgtattgttcagttctactattatattacgtgtatagtgtgccagtggactggagctgccttccaacaattgtgtcttcatgtaagcatacctcaagttccactttatatcaactttcggaagaaagatcattatgggtcttgacatcatcttggcttgtccacctcagttcttatactttagaattaaggaatctgaatcccagagtggttaagtgtattgtcaaagatcacacagcaaaatagtaacagaaccaggatgagaattcaagtcccttgactaccagttcaaagctctctttaacacaaaacatagcattttattagatgtgtataaaattttacagttgacaaaatgtttcccaatgcattgcacatgtgacctacctgggaggtaggcagatatggtaggcagaataatagtctcgaaagatagccacatcctaatcctcagaacctgtgaatatgttatgttacacagcaaagcagaattaaggttgtagatggaattaaggctgctaatcaactgactttaaagtaggtggaataactcgtattatccctatgggcaccatgtaatcacaagaaagcggaaggtagaagagtgaaagtgacatgttgtaaaaaaagacttgacaggctattgctggttttgaaagtggaagtgggtcaggagccaaggaagctggaaagggcaaggaaaccgattttctcctacagtctccaaaagcaatgaggtcctgccaacaccttgatctcagctctgggagacccacatcagttttctgatctgcagaacggcaagatactaactttgtgctagtttaagccactaaatttgtggtaacttgtcatggcagcaataggaaactaatccaccaaggtaagaattgttatccccaaattgtagatatggacactagaaaactgcgttttgttttgatgcgtttaactaaaccttcccatgaatttattatttttttatggtgccaagtggggaaggtagaatatatgagtgaaatacaatcctagacctcagggaatccaaggtaaaagtacttgtatagaaataatacaaggtacaaggtggggctgaaaaacactggacaagctagcccggggactgcagatgcaagcatctgctcttgaggcagtaaactgaaacagtgattcttattactagtttctgttaaagttcctcaaactcttttacacagagatatatctgactcttagatggcagctctaaaattttgaaggccaaatttagatccaggaaacacaggaatgcacatactcacttctgatgttgtcagatattgagagggcttgggtggagccttggaaatgcactgtaaactgtaagacaattttgattcgggtggttatcagaccacacttggagaaataattctagactttttggtgttggaaggttctcagttaatttgggtttgagattacatcgatgcctctctctgagaaattgggagccaagggaatgaatgcaagttcagcatttttatcagacactccagatgattcgttggtttgcacacccagttttgaaaatcactacctacagtgaggcaagcttagacccaatgccccaatacatgctcataaaaaggtaactagagataatgaaaaacagagatgcatgctcccaaagaaagacttcacattctcactttatttcaaagccaaatggattgtaagattaaagtgacaattttcaatctctgtttgaggacaagagagccaagtttctgattagctattttgaagctcaaatttgtctggacagggtttctatctcctttaaagaattcaccatgaaaaagtcctcaagcaacaagtgatgggtagataaaatactgtaattacgatcaaagtgcaaagactctgtctatgtaattacacacttcccaacctctgcaagccactttgttccattaaaatagaatgagaaatggacatgggtgatgtgtacttattggttagtcaaggttttggaaatgacagttattaacatgtgtgttttaccataaaccataatatttgggggataacttagattgtgggaattaattctttctccatccttatttttattgttcgccttccattctctacttaatctgactatcttatggtgaattagattatttgaagttcagagtgaattcattaagcttagaagaataaatgtaagggctcaaaatctcttgccactttcaaatttccagttcttttttctttcgtttcaaatgagtaaacctaatctgttaggttgaacagcaaacacccattctcaaattccattaactcaggcagatttttcataattgagggcaaaaccagcatcatcataatgttaagactgagaaagcattttgagtcaagaaatacaaaaccgaagctagcgtgattatttagtcagccatatggccggctagaaaaggtgtttaatctttttaaacagatgttgatttatcatgggaataaataatagaacatatacaggtttataatagtggactatgggaactctttcttttaaagtcaagtatattatgccttaagactgttgattgcatttaatttaaccctccatcaaatgctgacattttatcaatgtgttcaatttttacagcttccttaaaaacatcaaactttaaatattttatttgaaattcatcattagcttttctttcttctttattattttctggctcaaagaaacttctgtctttgcacttgaatttagtagtgtcatttacttcttaactacataaataatgaatatattattcattaaagctttcaatgaggaaatatgctttcttacaacttttccatgacactgcaactgcctctataaaaaaaattttcataagatgtatttttctattttacttttttccttttaacccttttgttatctcaggcaataaatgagacaaaatttttcaaactaaatgatgaacaatcaaaactgacgggttttctttcagcatcttaattgatactgtctaatatgataaatctttgtaccttcataagctcattttttagtaccctatagaggctgatgtggctgtaattgagaattctgcaacaaaatgtgaaatattaatgcacgatttatcttcaagttagtactgctgcaaatgtggtccattgtaaatgttgcagtcacactgacacactttttacagtcagatgttcaatcatttttttcttgctgaacaaaaggcttcagtgatgctctataaatgcactaccgaacctcttgtatgatatgcaaggtgccagcctatgttcctacataaaatgtacatacaattttacctctgtgtcttaaatgctttaaagcagtgaagtggaaagcttgtttttcccttcagcttttgacctcccttcttttcttttgctctttctctctttcatagaagctctgcattctttgctgcttgttagtacagaatatgcctgaaaaagctaaaaatattatagaacacttttttaaaacaagtccaagctttgctttgcaaaagtaaaattgggctattgtgtaaactaaactaagacactgaaacagaaacatatcaaaaatataaacacataaataaaactggcaaaacatatgccttttggattttatacgataattgtttttaatacctagcctctctgaattaagtacatttaagaagatttgtaaatagctgatctttaaataaattcataaattctatttggttggggggacaaggaacaataggagaagggaaatagttcactttcattgtaaacttagtagttgagtttgtagtttgaaagctacaaaactacttaatattgttctgcacatatttattaaatacttgatactggatatatgataagaaatttacaacttcaacatttttatgtatttgtttttactgtagcaaatttggttctgaaataatcttaattaagtgtgaggtaaaggaagatcttcgaagctcaggtagaaatataaatgtcagagcattttagatattctcaggtaaaacatactcagataaaagtaattgtgacttgctactacttatatttcaataagtatttattacacaaatgaagtgtttctaataatcatgatgccaacaaagaaaaatttagtaaaacaattgttttccatgccatcttctaggttcataatttttttacaaacaagttataatcataaatagtttcaatgtcttattcattaataaataatctaatgagcactttccagttattatgtaagtgactgcatcagtatctcatcatatctatgtaatttactacatttattatttcccttatttttgaacatttggtttggttataatttttgttattaattaagaatgttatacaaccacctttcttttgaattatttccttgggatagttcaatggtccaaatatttaaggaaagcaaacttatacatgttcaatctaaacaaggtatgtaatttacctgaattatctcatataacacagttcttaagtaatattcccagtttgcagatgagaaaaatgatgcttggagatagctaacttaaccaagggtgacctaactagtaagtggaaaaacctgtttgtactatcattctcacctgagtcagggctatctgacccaaagattttactgcttcccccacaacatcctgccacctaagaagcaagagggctgggtagtaaatgagtgtatactttttcaagtttctggaaaacattactatttaaacagtatgccaaagtattttgctaaacagttgcagctttgaatagtattatttttaaatttcattaagttaatagatgtaagatgatatgtggttttgattagcactttttattaactaggacttccgtattaactacggaaaccacaattactaattttaaaagacctcaacgtttgattttgtatttttacaaaatgaaaatgagatatgaacagcgaaatatgtagtatttattgaattttaactatgttccaggaactgttccaagcactttacacatttaactctcaaaccacctttaaaggtagttactagtattatttctttctaaccaacagacaatagtataacgtttaagagactggattcgggggccaatgcgcataggttcaaaaatctcactctggcaaatgttatacctcctaacttaatctatatgtctattttttttttcatgtataaagaagagtgataatagtagtacctacctgattggattgccttaaaaattaaatgagttaattgtacaaatgacttaagacagagtctggcacacagtaagtactacaggatgataggtcttattatttatattttatatgaagaaatcgaagcagagagaggctgtgtaacctgtcctgggtaaaagagctggtagttatgggtaggattctgatttctatcacatgttctttaatagtaagtgccttaactttcagtaaattctatatagaaatgattttaaagcataaataaaacatgacagaaaactgcaaaaactaataatttaacattctagaaaaatggtctgagtctaaagaggaaatatatttccaagtatcactcacacccttaacttaattccagacagccaaatttatttatttatttatttatttatttatttatttattttagatggagttttgttcttgtcgcccagggtggagtacaatggcgcaatctcagctcactgcaacttctgcctcccgggttcaggcaattctcctgcctcagcctcccaagtagctgggattacaggcacatgccgctatgcccagctaattttgtatttttagtagagatggggttttgccatgttggccaggctggtctcgaactcctgaccccaggtgatctgcccgcctcagcctctcaaagtgctgagactacaggcgtgagccactgcacccggccccagacagccaagtttgaggacagtctattctccctctggaaataaatgtttccattagaacccttacagacaggggcttaactttgaaaacttagagttgcccagtttggaaacttggagtcacttacttcaaaagctatcctttaaactgattaaaaaaaaaaaaaaaccctcaatgcttttgctcccctatttctgttgataactcagaaatctctcatttaccaatttctgttactgaaatttggtgatgtggatcaagccctcctccatgaactcttgacacaatcagattaattaatttccactctaccaatgtgactgttttttccctaatgtggtacttcagctcaccatcatttctttccatctctgttctttttatcttttatgcttttgctagcttgtcttaactgaaggcttttctttctctgaaaacatctacatcgcccatggttctttagtagaagcaatgccttctgcacaaactccttttcattgcggtggacaggagaagaaactatcatattttttagacaacactgctgttttgggatcatagttgacccatggttactcaataatttcacgttttctgaaatctcaaccatcaaagtgatttactgacctttatgacaatacactgatcttcagaaagctctcctctgttacatggctccattttcctctttactgtggcatctcatctgccagttctttgggaactctattcccttttgattgccttcccacaatgttgtcttacagtccctctgccttttcagctcaagaagctcccatttccacttcaggtaccaatccacacaaatgccctgggttgttcatcattacctgaaattatcaggcccaaatcacacaatcttacactttcctttctggccactatctcctctctcatacccccagcttgcaccaagtcccttcccctctctcatacccccagcttgcaccaagtcccttcccctctctcatacccccagcttgcaccaagcctgttccttctgcacaccctcacaatcttccctgtgaaaatttattcccttcttcaaagtttgtcttaatttctatttatttcataatgtattttgtgcatattcacttatgagtttctgttcacctactagaccctactacttaaagtgaaatgcatagaataatacaaaatgtggggcccacatcagtcctactaaatgagaatctgcattttatttatttttattgtttcaatagttttgggggaacgtggtttttggttacatggatacgttttttaatgctgatttctgggattctggtgcacccatcacctaagcagtccacactgtaacccaaaagtgagtagtcttttatctctcacttcccaaccactcttccccttgagtgtccaaagtccatatatcattcttatgcctttgagtccacatagcttagctcccacttacaagtaagaatataccatatttgattttccattcctgagttatttctcttaaaataatggtctccaattctacccaggttgctgcaaatgccattatttctttcctttttatggctgagtagtatcccattgtgtatatacaccacattttcttttttttttttttatggtgaaatggtacttttatattggaccctaccttttcccacccaattcagtttgagacagagcaacagaggcactgtaagggactatggctgtcttcctcgatattcagacatcctagtttccaataatttgttatgtacctgttacccatgaatcgatataaacctattcatatttagggattagtttccacaagtactaagttgaatttccttttatttgtcctaaaatgcttactttcaaacttgaagggacttcaattattccatgtagttttcaataatattcttttatcttttcagaccagagtcaaaatattcgtacagtattcatactgcagcaccttccacacaccctttggtctcttgaactgcccttctttggttccttttccactttcagatctttcttgaagtctagtaagcagaactgtactgggtattccagctgcagtttggtctgtcattgttggaatgacttctgctactccatggtcttccagctggtctatttctaggattatatgatcttcttttttaaatttttttttattttttattgtgttttttaatttttttattatttattttattatactttaagttctagggtacatgtgcacaacgtgcaggtttgttacatatgtatacatgtgacatgttggtgtgctgcacccattaacttgtcatttagcgttaggtatataggaaatactatccctccccactcccccaccccacgacaggctccagtgtgtgatgttccctgccctgtgtccatgtgttctcattgttcaattcccacctatgagtgagaacatgcagtgtttggttttctgtccttgtgatagtttgctcagaatgatggtttccagcttcatccatgtccctacaaaggacatgaactcatccttttttatggctgcatagtattccatggaatatacaccacattatccactatgttggttgatgggcacataagctgattccatatttttgcatttgtgaattgtgttactataaacatatgtatacaagtgtctttttcatataatgacttcttttcctttgggtaagaatctgtattttaacaagaactcaaggtgatttgtgaacacattcaatttgagaagcatggatctaatccagtggttcccaaggtgtgatcccaagagtacaactgtagcacctgggaatagtattagaaatgcaaattctcaggtccacatgtgtactattgaatttaaaaacttgaagttgtagttcaacaatctgtatcttaacacagttaacagggaattctgatgcacatggaagtttgaaaacctgaccatacaactgacaaggggaggggttgtcttgttaattttggtcttctctgtaggtgtagggtatgcgttttacaaatgcataggaagtgaccgagcaaatggatgaatgaatgagtgaaggacgctcttgcttatctcacagataatatgtattgttttcttctctgatacaactttatacttcacatatggtatttacatttacttacttcaatgactaaacttttaattatttctggatatacattatagctaacattgagtcatgtatattataaatattcaataaatgtctaatttgattgaaataattctattatacattcttctacttttggtcccacccccaccaccatacacctttccctttcacgacacattgcttcaggccaagtgaaggaacaaacacaagatataaggcaggtgggaatctgacctatagagatttgtcttctcataataacaaaaatacatcttaaaaacaaagtcgaaaataaaagtgagaaaagcaaataaatctggtttgaggctacacgtagttgctggccacacccataatttattcttttataaaatgcctttggttgccatgttgaatcatgtgagaacatgtggagtgcaaacactgttggaaacaaagggagcttgggtctgaaataggcttttccagtcataagagaatgccacgattttcattgctcaaagcatgctgcttagtttcaaccagtgaaatgaaatcgtcaggctgggtaactaatggtgactcttggcagcagtgttttgtggatccttttcattgaacagggacagactataaataatagcatttgtttagcacgttgtcgcttccaagaactccaacagccttaacaaatagacatcagtgttctttgccagctcacaggtggttagtctttaatacccggtaaggagggttgctataagtagatagcaacacgaatgctgatgaggtccttcagtttaagaccttaggctaacagtgactattttgtcattctaggcttttcttaattagtcataccctaaaccagtaggtcttccctggggcactaaaaatgtccaaaagtatgaatatctgcgttaaggcaatgattgattaatatatctaagtttcgtgatgaacagttgaccaaagtcactaaatatgactcatatttcagcaacctacctctaagatggtccaactcaacaggtcctcctctggtgccttcttcagtcatacacaatgatccagtgggttgacagaggatccgttgattatatttatctggaaagccattgcaagctctacgtggattgtttttagggagatggggggatatctctcaggaaacctgacatcccttttttcggttacgtcatgctataagatacgcaagctgtctggtcattgtgtatgcagcccttgtaggaagaccgaagccaaattatcaaagaacattgtcttaaagaaaaaaaaagtaaaacaaacctctaccctgccttctcccatccatcgctatagatgtttccatgaatagaaaatttagtaataaaaatcatgagattcaaaacaagtgactaaaaagtatgcgtacattttaaagataatgttatttatttcacttgcaatggaaatgttgcttcttttgaaagcaatcactattaagagagcctatgatatagactgtatttcgtaactaagattaaagatttcacatagaaagattaaataaacgaatttcaaaagattttacagtaatgttttttaaagatatgttattacaactggttactccagtagaagtatgtaggctctgtaattttaagaaagcatatttataatatagttttaaacatttaaagaaaccaaaaataaagaacaagaagtaatggaagaggaggaaagtctttaaatggtagtgtgtgttcgaatgccatggccccatatttattgcaacctgacccccttcccttcacacattctcaattcctagtttcttatttatgttattttgtccatataacacacatcacctttgaaaatacaatttagtttacttttttattatgcttattgtttcttatctgtctcttcactttggaaagtaagctccatggaggacagacatttgtctactttgtgccccaattcatcccaagcacctaggccacaggctggcacacagaggtgctcagtcaataactactgactgaatgaattacggagaaatcattaataaataattcttggtacatttacttatattgcttttcctgaccactgggatacaatttcttttaaatgagtgaaaaacaagcttattgaaaaaaagaaacttttctctctcattaggataaatgaatcttaacaggattgagtaattaactccaaatcacaaagctggttagtgggagaaccaagacttaatagccagaatgtcacactcagaattcagtgttcttcctaaatcttaccattatcctgtttatacgtctagatatcttgtttgctcaaatccctcatagtcgtttaggactttgtcatgtaaaaccatttcacatatagtatttgagccatagaactattattagtttcattttatagataaactgaaggttagagtgttaatgacttgctgaagatcacatagatgcctaattaatggcaaaggcaggattaaattcctggaatctaatcaaatagccttgttgttattacatagttctctctagttactgttcattttaaaaatgtactaagcaccatctatgggctaagccttataccaggcactagttagcaaaaagttattcatgctattatggaagtgtatcttcagtccataaatgaacacatgatatattgggtggtggtaagtctctgcataaaaatgaggaaaataacagatatatacagagaaaatgaaagggttgaaaacgatgctattcacaatagcaaagaaatggaatcaacacaaatgcccatcaatggtagactggacaccatggaacactctgcagcgtaaaaaagaatgagatcatgtcgtttgcaggaacatggatagaactggaggctattattcttagcaaactgatgcaggaatagaaaaccaaatagcattatgtttcactcataagtggaaactaaatgatgagaacgcgtggacacagaaatggaaacaacagacactgggaccaattgaaggatagagggtgagaggaaggagaggatcaaaaaataataattaatgagtgctaggcgtaatacctggatgatgaaataatatttacagcagagccctgtgacatgagtctacctatacaaccaacttgcacatgtacccccaaacttaaaagttaaaaagaaaggaaaacagtgctatattaactgggatggtcatctaataaggcctgtcagattaagagactcaatgaattcaactgcattttagagatctgagcgacatggatctgaggggaatgaggatggaacttggtagagaaagagcattccagacaaggagtgtaagatcagagtggctggaacagagtgaataagaacagggaaataggagaagagagcaactgataaggaacagggatgtgacgtgtaggtaaaagtaatgattaattttttttcaaaggattttattgtctcatattttaaagaatgactttgactctatgctgtgtaggaaataaatgtatagaccaagtttaggggctattgttctatatgagaatttatggtgctatgtactaaggtggggaagcatggtagcatcaagcacacatttcaaaagttgaccaatggaatagttgacgtttacagagattgacctcacttaattcttgggtgtcatccataggagggcatctggttttcacagcatggcattaccttacctgagtgaatatatgtcaatccaaagctggttctcagcttagagaacttggaagcctgatatgtccgcaaaagatcaatttcttgtttaacaaaacactcaaagattgatatatgagaaggagaaaaccaatcaatgcattacctcttacaataagaaatgtaatttatcttgaataagcttctgttgattgatgagtgatatggtttggctgtgtcccccgccccaaatctcatcttgaattgtagttcccataatccccatctgttatgagatgaaccaggtggagaagattgaatcatgggggcagtttcccccatcctgttctcatgatagtgagttcttatgagatctgatggttttataaggggcttcccacttcactggacactctttcttctccttcctgccaccatgtgaagaaggatgcatttgcttcccattctgccatgattgtaagtttccaaaggcctccccagccatgctgaactgtgagtcaattaaaactatttcctttataaattaaccaaatctcaggtatgtctttattagcaatgtgagaatagacaagtacactaaattgaaaccagaagtggggtgctgctattaggatagccaaaaatgtggaagcgactttggagctgggtaacaggcagaggctggaacagtttggaggactcagacgaagacaggaaaatgggagaaagtttggaacttcctagagatccggagggctcagaagacaggaagatgtgggaaggtttggaactttctggagacttgttgaatggctttgaccaaaatgctgatagtgatatggacagtgaagtccaggctgaggtggtcttagatagagatgaggaacttgttaggaactgtaatagaagtgactcttgctttgctttagcaaagagactggcagcattttgccctgccctagagatctgtgtgacattgaacttgagagagattatttagggtatctagcagaagaaatttctaactggcaaagtgtccaagaggaagcagaacataaaagtttagaaaatttgcagcctggtgatgtaatagaaaagaaaaacctggcaaagccaggtgcagtggctcacacctgtaatcccagcactttgggaggccaaggcaggcggataacttgaggtcaggagttcaagaccagcctggccaacatggtgaaatccaatctcttctaaaaatacgaaaattagctgggcatggtggcagaagcttgtaatctcagctacttaggaggctgaatcaggagaatcggttgaacccaggaggcagaggttgcagtgagctgagattattccactgcatttcagcctgggcaacagagtgagattccatatcaaaaaaaaaaaagtaaagcaaagaaaaacccattttggggggagaaattcaagcccaagctggctgcagaaatttgcataagtaacgaggagccgaatgttaatcactgaaacaatggggaaaatgtctccagggcacatcagagacattcacagcagccccttgcatcttgggctgggaggcctaggagggaaaaaatggtttcctgggctgagtccagggccccctgctctgtgcagcctcgggacatggtgctctgcgtcccagatgcttcagctccagctgtggctaaaaggggaaaaggtacagctaaggctattgcttcagagggtgcaagctccaagctttggcagcttccacatgttgttggtcctgttggtgctcataagacaagaattagggtttgggaacctccacctagatttaagaggacgtgtggaaacgcctggatgtccgagcagaagtttgctgcaggagtagagcctcatggagaacctctggcagtgtggaagggaaatgtggggttggagctcccacacaacatcttcactgggccactgcctagtggagctgtgagaggaggacccaaaatggtagatctacttacagcttgcatagtgcacctagataaaccacagacactcaaccccaaccatgaaggcagccaggaggggggctgtaccctgcaaagccacaaggtggagctgtccaaatccatgggagcccacctcttgtatcagcgtgtcctggatgtgagacataaagtcaaggagatcattttggaactttcagatttaaggactgccctgttggatttcaaccttgcatggggcctatagctccattgttttggccaatttctcccatttgaaatgggtgtatttacccaatgcctgtacccttattgtatctaggaagtaactagcttgcttttaattttacaggctcataggcagaagggacttgccttgtctcagatgagactttgggcttggacttttgggttaatgctagaatgagttaagactttggaggactgttgaaaagtcatgattgtgttttgaattgtaagaacatgagattttggaggggcacagtggagaatgatatggtttggctgtgtccctactcaaatgtcatcttgaattttagttcccataatccccacgtgtcatgggagggatcaggtggagataattgaatcatgggagcagtttcccccatcctgttctcatgatagtgagtttgttttcatgagatctgatggttttataaagggtttgccactttgctgggcgctcattcttctccttcctgtcaccatgtgaagaaagatatgtttgcttctcctactgccatgactgtaagtttcctgaggactcccagccatgtggaactgagtcaattaaacctctttcctttataaattattcagtctcagacatgtctttattagcagtgtgataatggactaatataatcagcatgttctttttctatagatatagaggacagaaaattaggtccagaatgttgccagataagtatggcatcgcagaaaataggaaataaatggagaatttaatagcatgattcatccatctacctatagctaattccataaagatatacctattaaaaggaccatacagttactcatgttcttggtccagaacatacatatgccaggacagagtgggagaacctagagtcaggatatctctttctctcttgtggtttctcgacactgaccaaagaccaaaacatcctccaacagcctgactagcacatttgtactttagatatgttaatatatttgataggtttcattctatttttaacctgaaattaatccatctgtttgatgactttgtcaatcagatccagtgtttatatatttttcactcatgaggacaatcaatcttatttctcagtttctatgttgtaaccattatatgtcacaattataaactatgttatgtaattttcctagatttctactaagtagacttatctgctaatttcagctggttgtaccaaaacaagtgcagtctcttttcaaattttagtacctgcttttgctttttgttttaaattactctacttaaactaattttcnnnnnnnnnnnnnnnnnnnncagaccagagtcaaaatattcgtacagtattcatactgcagcaccttccacacaccctttggtctcttgaactgcccttctttggttccttttccactttcagatctttcttgaagtctagtaagcagaactgtactgggtattccagctgcagtttggtctgtcattgttggaatgacttctgctactccatggtcttccagctggtctatttctaggattatatgatcttcttttttaaatttttttttattttttattgtgttttttaatttttttattatttattttattatactttaagttctagggtacatgtgcacaacgtgcaggtttgttacatatgtatacatgtgacatgttggtgtgctgcacccattaacttgtcatttagcgttaggtatataggaaataaatggagaatttaatagcatgattcatccatctacctatagctaattccataaagatatacctattaaaaggaccatacagttactcatgttcttggtccagaaaatacatatgccaggacagagtgggagaacctagagtcaggatatctctttctctcttgtggtttctcgacactgaccaaagaccaaaacatcctccaacagcctgactagcacatttgtactttagatatgttaatatatttgataggtttcattctatttttaacctgaaattaatccatctgtttgatgactttgtcaatcagatccagtgtttatatatttttcactcatgaggacaatcaatcttatttctcagtttctatgttgtaaccattatatgtcacaattataaactatgttatgtaattttcctagatttctactaagtagacttatctgctaatttcagctggttgtaccaaaacaagtgcagtctcttttcaaattttagtacctgcttttgctttttgttttaaattactctacttaaactaattttcctcatgtgtcagttgagtcaacctaaaactagacctttgtgaatatatggcactcaatctttcataaactgcaattgttaaccaaagattcagtcagtatttaattttcttaaagcttttctcacaaaccatatttaacttataataaaggtgcttgtctagttttccataatctttatatgtttaagggattaaatctaaacagatttcttactgtttgttatcttagcaccaaaccagtgttagagagaagcatcttgagtgtttcatggggtcctaagtgcttaggggagaaataattgaatttcaattcatcttccactatggctgaagagatttaaagattcaaataatgactagaacctctctcttcatgcatttatgttattctcagtaaatactgtatacctagtctcccatttatttgtgagacaagtttgtacttattagcctaagctgagaaaacatgtatctcatttgccagtaaaatgtcttaaagacaaaaccagttgaagtatcccactaaacatttgaaacaaacatttaagtaaaagaatgttaataccaagccttttgtaaaaaaaaaaaagaaaaattgcaatcattacaaataatcaaaatggcaggactcatggcagaatgaaaaaaatatatagattattaaactgaaatgtatgtgaaaaaatccattttcttccacaggctataggacaagaaaaccagtctggctttagattaactaattattttgtttactggctttgatattagaactaaagaagctcatgttactatttaggaattttactaaggagtaaaaaataaacacatttttgatgttatacttttattattgcattaattaattttaagaagtacttttcaatggaatctttgtggtagagatgtattaccaatgtttaccttgggatagcctggggttttcagatatgctaatgttataatggctttttacaaaaatatatttaaaaaccctaaaaaatgattaatggaatatgcaagctgaaaaaaatctattaattacaaagcccttttacatatgtatgaatgacccagttatgtagaaatttttgtgtgtgctgagtttcactcagatttcaacataaaatctcctggctcaactattttgccatgtcattttattttccattgtaacatgccctcaatgtaatgtcttgttcaatgtgttgagctggaagggattttaattaggttagaggagagaagccaaattttaggttttgcattccactgagaacacctggatggaaatatcacggaacagttcttgaactatataggactctgcagtgactactgcagtgctgttaagtcttgatcatcggttagaaagaaacgccataattaatctctttatggactcacagaatttgggagaataaaaggaagactggagatcatttttgtttatttttagtctattggaacacaatgtaaatgaaaattgagatctctgcttctataaaagttttaaaaaattattttaggagacttcttggttagccctaaaatgcaaggagcttggaggttgtcactcctcttacgacaagaaaaagctggacaaatcaataactttttttgaacccaccagaaaacagagactgtaggatgaatggccacaaacaaatctggagagtgggcgtggtggctcacatccctaatctcagcactttgggaggccgaggcgggtgcatcacctgaggtcaagagttcgaggccaggctggccaacatggcaaaaccccatctctactaaaaatacaaaaattagctgggcatggcacatgcctgtagtcccagctacttgggaggctgaggaaagagaattgcttgaacccaggaggtggaggttgcagtgaggcgagctcatgtcactggactccagcctgggcgacagagtgagactctgtctcaaaaaaaaagaaaaaataaaataaatctggagagacagatgcacatagagaaactgcttagctagaacagaagccataaagtggtaagaacacttagttggtaaatttgataaattgtttgaggctgtgtagactatctatcttaacagtgagaaaccccttgacacttcagtcttagaaaaaacccacacattgttgggcttttctgtcattaacccatcaggttctcactgtagggatctgagtacaagagaagaggaagtggaacttttgtgaaatatacacagaattttttcataaccccacaaatgacctattatccataagaaaagacattgacagggactcattgcttttgggagaaggaaattcttcctgactcttgccttatccaggtttaatgccttagtaagaaagaaaaataacataatcaacaagattgtataataattgagaataaacaaacataaaatatttactttttttatccttaattggcctgaaagaaaactgtttaaaacaatagtaaataacaatgtattaaatgattaaagtgtatagcagggtgaaatgaattacatcaatatcacatgggatgagagaagaattgggagttctctattataagagaacatgtactacccataagatagtgtagtgttatttggagacagacttagattagttaaaagtgcatatttcaactctaaatcactaaaagaatgtttaattgcaatttttacataaatagaggaggcaaaatggtcttatataatatgcttagttaaaaccaaagaaggcataagggtatgtatgggagatggggaacaaagaacataagcaatgaataaaaagagtttcaaacaaggtaagtacaaatgtacctcaaccaatcatcacattaaatgtgaatggtttaaacataccaagtaaaagacagagattgtcaggatagaataataaaaaacaaaagctcaaatataagttgtctgtaaaaaactcactttaaatacaaggacagagatattttaagggtaaagagatataaaatatatgccatgctaacactaatatagaacagctatattcataagggacaaaaaacagatttccaaagcctgaggaccacatggtaacaacaaggttaattctctaagaatacatagcaacactaaatgtgtatgcacctaacaacatatcaccaaaatgtatgtctccaaaacagaaagaagtgaaggggaaaatagacaactttattattagggtttgaaattttaacaccaaaaattggaagcaaccaagatgttcttcaacaagtgagtgaataaataaactgcagcgcattccattcatacaatgaaatattactcagcaaaaaaaagaaaaaatattatgaagcatccaaaaaaaaaaagacaacaagaatctcaaatgcatattgctaaggggaagaagccaatctgaaaagtcttcatactgtatgattgtgattttgtgacatgctgtaaaaggtaaaactatagagctaagaaaaagattacatgttgccaggggtttggggtaaagggaaaaatatttaatagaaggtacataggagatttatttttgggcagtgaaactattctgtataatactgcagtgatgcatacatgatattatgaatttgtcaaaaccaagagaccattacggcataaaaaatgaacctcaatgtatataaattttgtgaaaatttggagatcaagcattctccagtggaaggcagaatggggtaaaacagttttacaatattacagattagtgaaacaacctcactgaaggagatgaaaaaggtgctgacctaagtaactttagaaataaatagagactataaaatgaagacaaaagaactagacataaaaattgcactctctttgatgaagcttttacctgtggagatacaatttaacaatattgcaacaacaaatgtatactggaattgaacaattaaacaaatggatggtacatggtaagaaccatatttatctattggagtaggagattacaacagataagcaatgaaagaaaatgagagtgattcatgtggtaatggattagagttacagacatcagtgtgaatttatttctgtttaccttgtattagatatggatggttatatatagaaatatcaatatgcatatgttcaagtgtttgtatactttcatatttccttgctctaccaactgatggcctcggaggagtgatgtcccaggagcaaagggcatattccttgattctaggactggtacagaagcaaggacacctaagtagttacaagcacactttcatccagaatttgatttctaatactagcttcttatatctgttcctactaccagagcttcttggaaaagtggcaattctcaaactagggtaagacatatacaagataaaactgatgcatcctgtgttttcaaaaagtaaagcgtttctaacaacagaaacaatccacaaaacataataacggggatatgtcagtggtacaaaggcaccaactgaagagctcccaacccacaaaaagggaatgatttcagtaacaaaattaataaagtagtattgggttgtaatacaaaatattaaatgaatattcatgatttcacactaatatgaataaattattggataagcaaattaatataggagaatagaaatacttgaagaaagggatttcaaataatttttgtagatattctgccctcaagcaggtgaagccctcactccttaagtacaggctgcatgtagtacttccaaccaaaaatacagcatagaaaggggaaaaaaaagaagaacttaaaagtgagaaactttgcaaacactcctcagacaggtgatcaagaaaaatatcaacagtgacaattcaagtagatagtatgtagccttaacaagatgtagtaaaaatggctttgatcccccttggttttcttttaaaaatccataacgctaagtctaatcatgagaaaacattagacaaatttcagttaaggggcattctacaaaatgtgtgactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttgaaaaactgttgtaactaaagagccaaatgagatatgatgaataaacataatgtggtatccctgtatggaatttaggagaagaaaaaggagataagcaaaactaaggaaatatgaataaattatgggactttagcctatctaactcagttggtagagaatgagactcttcagttatggactttgataataatgtatcggtattggttcattaattgtgacaaacgtacatactaatatatgatgttaataatagggaaactgagtcagggtaaagggaaactgtcctatctttcaattgttctgaaatataacgctattctaaaataaaagtttattaacttatttattcatttatttttaattatttcaacttttattttagattcatggggtacatgtgcagttgtgttgtatgaatatattgcatgatgctgaagtctggattatgattgattccatcacccagtacccaatagttcatttttcaacccttgccccatctctcattccccactctagtagtcaccagtgtctactgttgccatctttatgtccccgtatacccaatgattagctcccacttatacatgagagcatgcagtatttggttttctgttctgcataattcacttaggataatggcctccagctgcatctgtgttgctgcaaagaagatgatttcattctcttttatggctgtgtagtattccatgttgtctatgtaccatattttctttatctaatccactataatgggaaccccaaatgggcaccttgattaattctgtgcctttactgttgtgaagaatgctgagaggcacatatgagtgcatttttaataaaatatttttttcttttgtgtatgtactcagtaatggaattgctgggtcgaatggtagttctgttttaagttctttgagaaatctcctaattgctttgcacagtggctgaactaatttacattcccaccaacagtgtataagcattccttttactaggcagcatttgttactttttgagtttttagtaatagacattctaaatggtatgagatggcatctcattgtggttttgacttgcattttcctgatggttagtgaagttaagcatgttttttcatgtgtttgttggccacttgtatgtcttcttttgagaagtttctgtttacatcttttgaccatttttaatggattagttggttttggtttttccaattgtttaagttcctttagattctagatactagaccattgccatatatatagtctgtgaatattttctcccattatgtaggttttctgattactctgttgataattccttttgcttcacagaatctctttagtgtaattaggttccacttgtcaatttttgtttttgttgcaattgcttttgaggacttcatcataaatactttcctaaggctgatgtccagaaagatgtatctaagttttcttccaggattcttatagtttgcaatcttaaatttaaatctttaatccgttttaatatttgtttatgatgaaaggtagggggtccagtttcatcttctgcatattggttagccagctatcccagcaccattgattgactatggagtcctttccgcatgcttatttttgttgattttgtcaaagatcatatggctataggtgtatggctgtctgtctgggttctctattctgttccatgaatgtatgtgtctgttttggtaccagtaccatgctgtttttgttactgtagcatgctgttttggtcactctagcctatagtttaaagttgggtaatgtgatgtctccagctttgttcttttgcttaggattgctttgaattttcaggctctttttttgctccatatgaattttagaatagttttttctagttctgtgaaaaatgactttggtagtttgataaggataatgttgaatctgtagattgatttgggcattatggctattacaacaatattgattcttccaatccatgagcatggaatgttttttttcatttgtttgtgtcatctatgaattccttcaaccgtgttttgtagttctccttgtagagatctttcaccttcgatgttagatgtagtcctaggtatttttgtgtgtgttcctattgtaaatgggattgcattcttgatttggctctcagcttcaacattattggtgtatagaaatgctactgatagcatttctatcagtgtaactatacatttattttgtatcctgaaactttactgatgtcatttatcagttctcaaagccttttggtggagtctttcgggttttctaggtgtaaaatcatatcagcaaagagagactttgacttcttccttttctatttgggtgtctttcatttctctcttgcctgattgctcttgctgggactgccagtattaggttgaatagaagtagtgagagtaagcatccttgtcttcttctagttctccaggaaaatgtttccaatttgtgcacactcagtatgatgttggctgtaggtttgccgtagatcactcttattattttgaggtatattcctttgatgcctagtttcttgagggattttatcatgatggggtgttggattttatctaaatctttctccacatcttttgagatgatcatggggtttttgttttgaattctgtttatgtgttaaatcacatttaattgatttgtatatgttgaacccagcgtgcatcccagaaatgaagcctacttgatcatggtgaattaactttttgatgcgctgctggattcaatatgttggtattttgttgaggatttttgtgtctatgttcatcagagatattagcctttagttttcttttttcattttgcctttgcgagcttttggtatcagggtgatgctggcttcatagaattagttagggacgagtccctcatgcttgatttttttgaaatagttttgatagaattggtaccttgccctctttgtatgtctggtagaatttggctgtgaattatgtagtcaggcttttttggttggtagaatttttaatgccaattccatttcagaactcaatattggccacttcagagtttcaatttcttcctgcttcaatcctgagaggttgtgtttctagaaatttatccatttcctctagattttccagtttgtgtgaatagatatgtttataatagtctttgagaaacttttgtatgtctctggattggttgtaatgccaccattgtatttttgattgcgcttatttggatcttctctcttttttctttgttaatctagctagagtctatcaatattgtttatcctttcaaaaaataatttttggttttgttgattctgtgggtgaattttggggtctcaagtttcctaagctctgctctgattttagtcatttcttttcttgtgctaattttggggttagtttgtttttgtttttatagttcctttaggtgtgatgttagatcattaatttgaggtctttctaacttttcgaggtaagtgtttagcactataaacattcatcttaatcctgcttttgctgcatcccaacgattttggtatgcagtgtttctgtttttatttatttcaaaaaaacttttgacttctgccttaatttagttgtttacccagaagtcattcagtagcaagttgtttaatttccatgtaaattgcctagttttgagagatcttcttggtattgatttctacttttattccactgtgatctgagagtatcgttggtattatttcagttttttttaatttattgagacttgctatatggttaagtatgtgtacattcctctaatctgcacacagaataaaagtttatttttaaacaaataggcttctttctacacttgagtggaagatcttctgaataaacatctagtgtttatgttcttcataatatgtagaatttatttaaaaaacaaattattaggttagctctgtgtttcaaatatatagtacagtatttcaattccttaaataggctgattgtttatcttagtcattgaaagaaaaaatataaataaatatatgacttcacatctctactttcaatttgtcttttatggggatgaagagaacatgttctttcctctattttagtttcttaaacatttgtggatatatgttacagtttatgaagcataccaaagataaggaaactgttggaattctaatttgatcactaattatttatataagattaagagagtctttctgggacttatttttgtttctatgtatataaagtggtctgaatagattaagtgattttaacttattatgtggctttcataagtgctctgaattttttttttgcaaatttaactattgcaaaataaacattttagagttttgatcatatttttaaaattatcagttacccacaaagtgattaagatcctccggtcttactgatgtttgtagctggggtattaattctgtagagaccttgaagatggtgctctgactactgttgacaaatatcagtaagtatcaaaatacttttacgacattgagttctgtacaatagtgattatagttaaaaatataagataggttctggaaggacttcagagttatcaagaaccatggagtccttaccatttaagttctttttcatcaatgaaagaaattaagacccagaggaaaagatttatagaaacatcatcttaaagcatcttatagaatcatttaaagtggttatgctatcctttgctgtccacaaagatgagctgctataatttcagtacaatttcaggcaagatgaactaaaacacctaattcataatttaagtggcttatttcattcattcttttttttttttttttttttttgagacagtgtctcactctgtcacccaggctggagttcggcagtacaatctcagctcactgcaacatccatctcctagattaaagagatcctcctgcctcagcctcctgagtaactgggattacaggcacatgccgctattttcagctaatttttgtatttttagtagagacaggatttcaccatcttggccaggctggtgttgaactcctgacctcaagtgatcctcccacctcagactcccaaaatgctgggattgcaggcatgagccactgcacctgacctgagccaccgcacccagccatttcattctttcatttttattcttaaattcacttacgcatttagcaaataataatgttgtaatatatgttaagcttagtgttaggtgccttggacacagaaacaaatatatatctattatttcttgagtgtctactaagtgctttagcgtaattaacttccaaaacattttaaatatctaaaaacatggagactgggaaaaagtacattacttatccaaacctctacagagagtaagctgcagattagaacttaaaacttaggtctgacttccccctaaactatatttttgtcatctttcctatccccccaagccctgcctttaaagggtttaagagctttttggtaaaaataggcacttggacatgtgaacagcaacaggaatatcacaatacccagcaaagaaatttaacataaatctgacataatttattgcatgcctatctcgttactaaaatcttttgtaaattttaaatatgaagggcagtactatgctcaaaattacatagaaatattttttcaaaaacattcaaaatgacaaactttaaagctagagatggtcggtctttggtactgccatcctatttcctaactgaggaagataatgctctgtgatgcaacatgcattgcagcatgccacattgcatagacatctgaatcccacaggaaccagagcctgagttaaaaaagaaaacagtgactcagaattcaagacttctggccttagttgattcaagatgtcattttttcagtttttattttttttcctccagatcaaatttcagtaaaatgtgacagtaagactttattgtatgtgcctcttatttctcctttagtttataaaatattttggtgttctctgactattgctgaattgtatgcttggatattaaacataataaagttccatctactttcataatgaatgaaatagtagtatttgtttttatgtaatgtttaagagaatccatagccttttatgtgtgtagatggtagaaagctataatttcactaaaagcagaagagatctagctggtggggagacagtgttgtatcggagctagcttgtacctgctcataccatctggttattaaatattcaggaattttacaaaccaattgtgaaatatagccattattaaaaaataaactgtatagacttataactaagtaaaaatattagaatgaaagcataaataaccaaactcatcacttcttaattcttttactacatcttactattacctgtgttctcattattttacacttactgcctttgcatggtaaaacgactccttatgagagtgtactaccacccgtggttttcttcactctgtgttcagtgacataatttttgtagcttaaaattggccatgttgggagtatttatgctgtagaaattgacttatgctacggttcagggatttttatctcagatatccagttgttaaacatgtgtcagcatgccactgagaatagaggaatatcacaaatattgatcagcttctgctattcacaaattcaaccctacttcaacattataatctcgtgttcaaacctgataagctactttttgtcaggatcaggtcctagtttggtatgttttgagtaaaattcccaaatagattagagtatatgtagtttgaggatgaagtgaatgtaatatttgatgttattgatatttgcaactatgaggggatatatctgaaggcaaaacctaacatgcagaggatggctgagcaggaagaagagtgaatccttgatgatgatattgaatcacaacactaattaattctggagtcacacttcagccaccttgtcatgtgaaaaatatattctttaaagccacttttaattgtggtgtgtattatatgcagcagaaagtaacctaactaatacaccaattacccattttatagataaaagtcagctaattcctacagccacgacatttaggaaagttcatgtaaggtcttattagcacttctattttaaaggcttgtcttttttgttttttaattttaagcataactttaattatagcttccagtatataaaagcattatttgaacctgggtcaacatgaaatgcaaccagaaactttaaaaaagtgtaagcactgcaaatatatatttgtataataatgggtactgatgactacgatggatatctaatatctaactgaaaataaatatagttttccttaggaaaggaaaagacatcagaacccagttattcaaatacttacttaggcctttcttaagtaggggaggttgtttatagccataagatacttatcaaacgtaataaataagcacatttccaattataaactaatgagtagattttattaaacattattcttacaattccttgaaaactctagtagttatagaaagagcacaaagtattctgattttatgcttttaaaaatgtgaccctttaacagagaaactccacttaggtttaataagacatatttgacattctactatcattcaaaacccctgagattggttacacaaaagttatatcaactaatacaaaaataatgattatatgaagttatttattctgtgtaatgaacaaatactaattaatgaaatagacttatactgtaattatgactttttatattctagcaaaaacaatgaaattgggaggttttaaattcaacctatagtctgaaatccaatattattctagcaaaaggagagaaagagaatgaaatagagaagagacagatgaatattaagaaatgatttagaataggtaaacagtaaaatagtaataaataatacaacattggttaatatggcagttgatttaccttgtgaggtgtcaaaaatctgaaaggtagctgaagaaacttttggcagtttcttggaagaagtgagtaattcattctcctaaattcaagcttagtgtatatgggtagttctcaagtaacatgaaatgagtataatactatcactggcttaatatctactaaaagggaaattgtgtgtatgtatgtaaatgggtttacatgcatttacaaaagaatggattggatatttttaaatgacagtagaggaacttatacttgtgaccatatataaacacactgatattggacaaaatatataagaaaacttttcaggccttgaacaaaagacagcacaggcttacagtttttgaaaaaaaaaaaaaaaactcataaaagtgtgtctcatgattgaacctactctctgcctgagaacaatttcctaaactgtgaaagaaggagctgacacacaagcatagcacgacagtcccactgaagctaaggcagaagttagaatttttttttttttttttttttgagacggagtcttgctctgtcacccaggcgagagtagtacagtggtgcaatctctactcactgcgacctctgcctcctggattcaagagattctcctgcctcagcctcccgagtagctgggattataggcacccgccaccacgcctggccaatttttgtatttttagtagagacagggtttcaccatcttgaccaggctgttctcaaattcctgacctcttggtctactcgcctctacctcccaaagtgctgggattagaggtgcgagaaagtagatttaagagttgctgaaggaggtagaatctgtggactagggcaccagagagcagggagctaatttgagtaggaaccccagagtttgtgtgggagctcttgtagggtgtctggctatgggataatctttacaagctcaggaagagactatgggaggctgcaaagcaaataagtactaaagacttgagagtagaacagaagctgaagattgcatggttatggaagaacccaatgccccaactcagctagagtgcaaaaatcttattaatatcctgagtattcaactgagacatcaagaagttcattccttaagtatagaccatgttctacagcaagagacagcaaatgttttctgaccctggtccctataatctctgttccaacttcttaaccttgcttttgagatgtgaaagcatctatagaaaatacataaataaataggtgtggccgtattccactacagctttaatcataaaattaacaggtatcagtcgagatttgacccacagaccatagtttgctgaccctacccaagagtaaggcctatacaacacctccttattaaagcgtaaaactcagctttgacaatatccacaggaagacagagtttagaaattaagccgtagcaagttacaggggcttgagaaaaaaaattaggcattgcacagatatgttcaacaaagcataaaactaagcgaatacaagtttaaggtaaataggctatgatagagctacttatttgaacaaaaatcagcaattttctggaaaaaaaaatccaaaatccagtttatctaaattacatcatccaagatgtccagtataaaattgaaaaaattaaataaataaaaacagattttaaagtcatcctgaggtttaatttatcaaataaaaacttaaaggaaactattgttcatttcaaggaataaaatgaaaatatgcttttaatgttatatagatgaggtatctaaacagagacatgaaaaatataaaagcaaatgaaatagaaaatctacaacaaaaatgcagtaactaaaatcttaaatccatatgagctttacagatgactgaaggtagaaaaagaaagtgtcaatggatttcaaccaaataaatagaagttatccaatgttaagaaataaaaatattgaagaaaatataatagcaactcaagcatacaggacaatatcaaaggatcttagcaaatgtttaactaatatcctagaaagacaagtgagaaaggggtgaaaaaagtatttaaagaagtaatagctggctagacgtggtggctcacatctgtaatcccagaactttgggaagtcaaggcgggaggattgccagaggctaagagttcaagaccagcccaagcaacacaaggagaccttatctctaaaaacaaaaatacataagtaaataataactgagatttcccccagatttcatgaaaaacatttatttacaaatccttaaggaactcagaaaaaaagcaaacagaaaaatacaaagaaagtcacacctaggcatatcataaattcatttctttaaagctaaagatgaaagaaaccaaaaaaaaaaaccttaaaatccaccagagaaagcagaaaaaacaattattcagggaataaataatataaatcatgactgacttctcatcagaaaaatggacaccaaaagataatggaatagcgtcttttaaatagcaaaggaatgtggtggcagttaggtcagttggttggtgtggtgctagtatatagcaaaagaaaaaaacaatactaacaaccaaaaaacctgtaaaacttgattctatgtctagtaaaaatagttttgaaaaacaatagcagaatgaagacatttatggtaaacaaactgaggataatttgtagttagcaggtgtgtactacaaaaaaaaaaaagaaaaatgttaaataattttcttcaagctaaaaggaaattataccagacaaaaactcaaacctacaggaaataataggggacataagaaatgataaataattgggcaaatagaaaatgttttttgtttctcgaattttcctgaggaaacaactgtttgtatgaagtaaaaataatcacactgtaaagtgggtttataaaatctgtaagtaaaacctgtgacaatagtgaaagggaagacaaggaaaatagaactataccccataagcttattacatttctgaatgttttggaaaatgggctctgaggcttaaatctgaagtgataatatatgggctctaggtagacattaataagttagagatacagaatattagtcctagagctattatcataaagtaaataaaaagagatatagtaaagcaagccaatagagaaataaaataaaacaaaagtatatgactcacccaaaagtggcaagaaaggaataagaaagcagcaaaaacagaagggaccagtggaaaacaaatagcaaaatggtaggtttaaacatggctatatcaatgtttgcattaagtgttaaacattcctattaaacagtagagtttgtcctattgaattaacaaaaaaggggccaaatataccatataaactatattaataagaaagctgaaatgaacaaagtataaaccaacaagaagaataatattagaaataaaaatagatacttgataattgtaaagagacaatcaggaagaaataacaagcctgaatgtgtatgtgcttaataatagagatttttaaaaagaagaattgaagactgacacatccaaagaagaaatagactcataaacagatatagttggttattttcatcttttcacagtaattgatagaaaaattgagttcagaacaggtacagaagatccaaacaacattaccaaccaacttgaaccaatcgatatttgtagcacacaatacatgacaactgcagaatgtacattctttttacctaccaagatagagcacatgttgagccataaaatctctcaatgtatttcaaaatatggaaatcatgcaaattgtgttcttggagtctaatgttataaattataaatcaatacaaaaataagattttaaaactcataaaatatctggaaattaaataagaatcttctaaatgactcatgagtgaaagaagaaatcataaaagaaaatatattgaacagaaataaaaacaggacacataaaagattgtaggatgcacatactacccaacttcaaaatatgctacaaagcattagtaaccaaaacagtctggtgttggtataaaacagacaaatataccggtgggacagaacagagaacccagaaataaatctatgtgtttgcagccagttgatttttgacccaaggtgccagggacatacattgggaaaatgacaccctcttcaataaatagtactgggaaagccatcaaactagaaacctttccctggtcatatatgaaaatcaactcaaaatgaatgaaaacttaaatgtaagatacaaaatgataaatctaccagaagaaaacatgataaatgctttaggacattggtctaggcaaagatttcataggtgagacttcaaaagcacaggcaacaaaaacaaaaagacaaatgagaatatctcaaactaaaaaacttgtgcacagcaaaggaaacgatcagcagagtgaagagacaacctgtagaaagagagaaaatgtttggaaagtatacatccgataaatgattaatatccagaatatacgaaaaattcaaacaactcaaaagcaaaacaaaccccaaaaatatgattttaataatgggcaagggatttggataaacatttctcaaaagaagacatacaaacttacaaaaaatataagaaaaaatggtcaacatcactaatcatcagggaaatgcaaatcaaaaccacaatgagatattatctcactccggttagaaatgttattatcaaaaagcaaaaagaaatcacaaatgctggtgaggatgtgaaggaaagggaactcttacacattcttggttggaagataaattagtacagccattatggaaaagagtatggaggtttctcaaaagattaaaaacaaaactatcatatgatctagtaattctactacagggtatttattcaaaggaaagaaaatacatatattgaagagatacctgcacctttatatttattgcagatctatttaaaatagccaaaatatggaatcaacctaaatgtccatcaatggatgaatgaataaagaacttatgatacatatacacaatggaatactattcagcaataaaaaagaatgaaatatggtcattcacagcaacatggatgagcctgggaggacattattttaagtgaaataagtcagagacagaaagacaaatactacatgttctcactcatatgtgggggctaaaaatattgagttaatagaagtagtgagtagaactgtggttatcagaggctgggaagggtagcaaggagggaaagataggaaaaagctggttaaggtatacaaagttacagctgagtaggaagaataagttctatgttctgcagcactatagggtgaatatagctaatgataatgtagtgtatattttcaaaaagctagaagagaagatttttgaatgttcacaacacaaagaaatgataaatgtttcaagtgataaatatattagttattcttatttgatcattacacattgtagataagaatgcaaagatcactctgtatcccataaatatgtacaattattacctgtaaactaaacataaaaggaaaaaaataggttgcagccaaagctgtgcagaggcaaatttacagctttaaatatccatattaggaaaaaaagttttaaaataaattatgtaagctcctacattaaaatatttgaaaaaggctgggtgcagtggctgccacctgtaatcccagcagtttgggaggtcgaggtaggaagatcacttgagttccggagttggagaccagcctggacaacatagagagactttgtctctacaaaagatgaacaaaattagctgatcatagtggcacatgactgtagtcccagctactaggggagctgagatgggaggattacttgaacctggcaggggaaggctacagtgagccgagatcatgccactgtactacagcctgggtgacagagcaagaacctgtcacaaataaagatagaaagaaaaaaggaaggaaggaagggagggagggagggaggaaggaaggaaagaaggaaggaaggaaggaaggaaggaaggaaggaaggaaggaaggaaagaaggaaggcaggcaggcaggtaaaaagaagaagagattaagacctaagataaacataaaaataaagtatgagcagaattcaaccatagagaattaaacaaagccaacaattggtttttttaacataattaatacaaacagttaaacctctagcaagattaatcaaaaaaagaggaaaaagcaaaagaataccaagtaaggcatatgcaactctgccttccacgttcaagcaattcttgtgcctcagcctcccgagtagctggaattgcagactcctgccaccacgcctggctaatttttgtatttttagtagggacagggtttcaccatgttggccaggcttgtcttgaactcctgacttcaggtgatccaccctcctcagcctcccaaagtgcagattaccggcatgagccatagcacccagcctatcagaatttaataaataacaatcatctgaatagatgcagcaaattttttcacagaactgaacattcttccataataataactctaggaactaggaaagaagggaatcttcctcagtctgataaaactgatctgtaaaaaacctccagctaacattctacttaatgattgaagaaatctttcttaagattagagaaaagggaaagtttattcttggcaattatcttcaatattattctagaggctccagttaggacaataaacctaaataaataaacatgcaaagtagaacataaagattggaaatatataaagtaaacaaaaaaactgtaaaaattacaaaaataaatctatcagataagataacttagcaaagtcacatcatataaatacaaacaaatgaattttatttttgtgtataggtcgttaacaactgaaaaacaataatctttaccatagcattaaaataacaccacaaaacaggaagaaatttaacaaaaagataggcaggacatttatactgaaacattgatgagataaatttaagcacatattttcgtttctgttataccttgtgtagaggggtgggaatcacaactcaattcaattatttgcagctgtttcacttctgcaatttacttagcttaaactcagtttctaattctttgtcatcattcataaaattcattttctggataggtcattaatagaattggaaatatgtgaagtaattggcataaaccctgaacttaatagaagtacagcaaattgaaatagttttattattgttattgtgaataatgcattataaagtgagatacttatatttattactttagcaataaagaaaccataggcaagactttgaataaagaaaacaacatatgattgatagcgtaagtgaagattaattttcataatggtgagaaatccaggcttatttagccttttatttactaataaattctgaagataagtcataaaacaatgtacggatagtagatacaccagtgtacataatgtcaggtctttgcagaagtggcaagtagctcaaaagtaggttaatatgagaaatttctttttcaaacaaaatgagatagcattgttccaggacttcttattgggacctattcaatcctgaaccactccatctaagtctgcatatctccaaaaccacagtcgtcattcttgtttgggatgatgttcttaaatgtcttatttctggttccctcaaaaacagaaacccagacaggaactttggtcctggtaatttattcaggcgatgatccaggaagcaagaaaggggagcaaacaaagtaagacagggacacagaagcgtcaatatagaatgatttatcgaggttacactgtgggcaatgagggatttttttccaaaacctgagaaacatacagaaagtttcccaaaattttcccttagccagacagaaatctgcaatatttatccacaagctccatgaattgaaaattacatgaaggcattaactcccctaactctctgcctatccaggctgcgtgtgtaccaggctgagtagattcccaaagtgtcagagaaggcactgaagcagagtacagatatacacataaaatgagctttagatgggactctatcaatgtgtggcagatctgaactagcacagaactgccctctgcagctaaggctgaaatcagaaatgagctaaggtgataatgatattaactagaagaccctatgtagcacatcaagtgtaaaaacgggttaggttttcttcactctactaatgctgaggcactcctcagcattgacaaaatcatgtattttgtcaagtgtcttagtcttttcaggctgtgataacaaataccatcaactagttagcttatagacaacaggaatttctctctcatagttctggagaatgggaagtccaaggcactagcacgtttggtgtccagtggggaatcatttccttattcatagatgataccttcatactattccttcacatgatagaagggactaactggctctctggagtcttttaatgagggcacaagtcccagtcatgagagctctgccttcattcataactcagtcatctcccaaagacctcacctcctccattgccttaggggttaggatttcaacatggaatttgaggagatacaaacattaagatcatagcaagaagactgtcatcagaagataattattgaattttaatatttaatcatgatacaaaatagaaaaaaattactgtctataggtcattttaaaagattataaaaatataaggaggtcaaaaaatttagattgcatttagaatataacctaaacatcataatttgataaagtctagattggcagtgctatttgtaccaggtcacatattagacatatataagtcacatataaatttagaggtcataaatattccccatattcccaacccatagattttttcgctagtctactcagtctttatccacatcacctgctttgatgcctgaatcaatgttgactcataaatagattgacatgaacgagtactgtggcacggttacgtctcctgctccccctcacccaccactgtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaacacacacattcattaaaaagaaccgtgaaccctttgaaaaaccattagtaaagattttattttgttcagctttattgtgatataattgaaatataaaaattatatagatttatattgtataacattatgttttgatgtatgcgtacattgttaactgagtaccaaaagcaagctaattaaaatgtccatctcctcatatacttaccatttttgtgtgtgtgatgaggacacttaagttctactctcttagcaagtttcaagtatacaatataaaattattaactatactcattatgctgtacattaagtctctggaatttattcatcctgcataactgaaacattgtgccctttcaccaatatcctcccatttttcgtactcccaaactcttggcaacaccaagctactctctgttcctattatttgacattttttagattccatatgtaagtgggatcatgcagtatttgtctgtctgtgcctggtttacttcacttagctttatgtccttcagttatatcatgttgcaaataacaggatcttcctttttaaggctgaataatatttcaatatgtatttgtattatatagaatatatcgtgtgtgtgtgcatgtgtgtatgtgtgtgtgtgtatcccatatgttcctttaaaaaaaaatagacttagggagtacacgtggtacagttgtgttgcatggatacattggatagtagtgaagtgtgggcttttagtctagccatcacccgaatagtgtacgtcaggaatccccagccccctgcccacagactggtacccatctgtggcctgttaggaactggaccacatagcagagagatctagttttaatgcttttcatgagaatctgactaattcctgacgatctgaggtggaacagtttcatcctgaaaccacccaccccccaacatcagtggaaaaattgtcttccacgaaactggtccctggtgccaaaaaggtttggactcctggtatacattgtacacattaagcaatttctcatccctcactctcttccaaccctcccaccctcccaaatctccagtgtctattattctgctctctatgtccacgtacagggtatttagctcccatttataagtgagaacacatggtatttggctttctgtttctgagttattttacttaagataatggcctctaggttcatccatgttactggaaaaaacataatttcattctttttatggttgaatagtattccatggtgtgtgtttgtgtgtgtgtgtgtgtatacatattgcatgtttatatatgtacatataatgtgtacatatagatatacacacacacacagtggaatactactatataaatgttttatatatattctatatacacacacatatttatatatataaatatatataaataattatatatttatatgtaaataattatatataaatatgtgtgtatatatatacatatatacacgtatacatatatacatatatatatacacacatatatatacacatatatatatggcattttctttatctaaccatgagttgatgcacacttaggttgattccagatctctgctattgtgaatagtgccacagtcaatgtacaaatgcaggcatctttttggtataatgatttcttttcctttgggtcagtatccagtagtggggttactggatttaatggtagttctatgttttcttctttgagaaatatccatattgtttgccataaaggttgcactaatttatattcccaccaacagtgtataagcatttctttttctccccagcctcatcaacatctgttatttttcgactttttaaaaatagccattctgactggtgtaagatggtatctcattgtggttttcatttgcatttctctgatgattagtgatgttgagtattttttcgcatatgttttggacatctgtgtgtcttctgaaacgtgtctgttcatgtactttgcccgttttttcaattgtgattatttcttgttgtttttgttatgatgttggagttacttgtagattttggatattattcctttgtaggatgcatggtttgcaaatattttctcctgttctgcagattgtctgttcactctatatttcttttgctgtgcagaaggtttttattttaactgagtcccatttgtctattttggatttttttctatttgcttttaaggtcttagtcataaattatttgtcaaggcactgtcccaagtgttttttctagattttcttctagtatttctacagtttaaggttttacatttaagtatttaatccatcttgagttaatttttgcatatagtaaaagatggagaagcagtttcattcctctgcatatggctatacaattttctcagcaccatttattgaataggatgcccttgccctagtatatgtttttgttgaagataagttggttgtagatatgtggctttattcctgggttctctattctgttacattgatctatgtatctatttttataccagtaccatgctgttttgtttactaaaaaccttctagtataattttaagtaacataacatgaaatctccggctttgttctttttgctaaggattgctttggctatataggctctttttcagtttcatataaatttcgggtttgttttttctaattctgtgaaaaatgacattggtattttgataggaattgcattcaatctgtagattgttttgggccgtatggtcatatcaatgatattgattcttctaatccatgagcatgtgacatttttccatgtgtttgtgtcatccaaaacacaaacatttcattaaacacatttcatttgtcagtgttttgtagttttccttgtagagacctttcacctccttggttaaatgtattcctcaatattatttttttagctattgtaaatgaggtttacttcttgatttgtttcttagtttggttgttattgatgtatataaacgctactgattattgtaagttggttttgtaccctgattttaaaatgagcaaagaccccaaatttactgaagttacttatcaaatctagcagtcttttcttaattcattcatgtttagatgaacagaggttgattccgtatctgagctattgtgattatgcttcagtgaacatgggggtgcagatagctcttcaagttactgatttcatttattctgtatgtgcattgaaaagtaggattactggaccatgaggtagttttatttttaattttccgagaaacttttatactggttttcataatggttgtaccaatttacattcccaccaacaataggtttgcttttctccacatcctcaccagcacttgcttttttttgtattttttataatagctattctatcagctgtgaggtgacatcttacaatggttttgttttgcatttccttgatgattagtaatgtttaccatttttttcatatacctagtcatcatttgtaagactgtttttgagaaatgtcttttcaggttctttgcccatttttaaattagattatttgttttcttgcaattgagttgtttaaactccttatatatttagaatattaaccctctatcagatgtctgatttgcaaatattttcactcatttcgtaggtgacctcttcattctgttgattgtttttttactgtacaaaagtttttttgtttgatacgacttcatatgtctactctggcttttgttgcctttgcttttggtgtcacattcaaaaaatcattgcccagactaatataaagaagactttctcctgtgttttctttcagcagttctacagctccaggttttatgtaaagtattcaattggtatttatatttggcataaaataagtatccagttttaattcttgacgtggatattcaatttttttcaacatttattgaagaagctatctgttccctattgtatgttcttggcactttgtggaaaaaacaattaaccacaaatgcatagatttatttctaagctctctattctgttccatttggtatacatgttagtttttatgacagtaccacactgtcttaattttgaaaccaggtaatgtgatgtctccagctttgtttttcttgctcaaaatcactttggctatttgggctcttttgtggtttcaaattaattttatgttttttttctctatgtcactgaaaactgccattggaattctggtagggattgcattaaatctgtagatatcttttgggtgtttggatatttaaatattaattattccaattcatgaacatgggatatattttcatttatatgtgtcttctgcaatttctttcatcaatattttgtagttttaagtgtatggatcttcagcctccttggtcaaatatgttcttaagtattttatttttatactattttaaataattaaataattaatgcccatccttttcagactcttccaaaaaattgaaaaggagagaccaccaccaaactcattttaggagaccagcattccactgatactaaatccgcctaaataaagaaacaaataacagatcatcaatatccctggtgaacacagacataaaaattctcaacaaaatacaagcaaaccaaattcaacaacacattaaaagcatcatacaccatgatcaaatgggacttaccacaggaatcacaaggattgttcaacacatgcaaatcaatatatgtgacatatcacattaacaggtccacaaggacaggcctgtatcttggttctatggtggctggcatggagtcagggtccactggagtgagcctggtgactgggtatgctgacatggacctggagcctgtgtctatggaggctgtcctgaagcctaggtacaaggggtccatcctaaagctggggtggttcttgagcctgagtttacattagctagcctgatgttgaggcaagtttggagccagcaacaacagagatgagcctggagtctgggtctgcaagggctggctggcctggtgccagggtacactggtgaaggcctggtgtttgggtccacagtaaagtcaggtgcttccttcacttttatctcatcacacagccagtatgtctttccatgaggcactgcttaggtgtgaggaaggggtgacatggggaattgtaaaaatgtccttccagttctgctaaatgtatcttttcttacttctgtgctcctataatctttcacctggttttctcagctcctggtaatatattttcataagtgaatagtcacttatgtatcttttcttacttctgtgctcctataatctttcacctggttttctcagctcctggtaatatattttcataagtgaatagtcacccaaattgtaagtgaacaagagctggaacctcctatttcactattttgctgatgtcacttccattagcatacattttaaaatttgtaattaggaaggttaaaaataacttgaagccaagtttattaaaatgtctaacatatcctaaattacaagacgtatttcctatttactttacctcctttgctaccaagcttgcatcttagcatgatttctttctcatgaacttaaatccaactagctaaaagtggcaatctttttgatcactgaagccaggctctatatttcagctcacgtgctccataaattatatgcaatatttgaccctgttaataactcttcttcttgccattcctttggcttccttgactttgaactctactggttctcttcttcctcctcctcctttttttctactctctcgctgactgcctctaaaagtaaatattttccaaaaaatagggtacaatatatggatacttcctcaggttctctcctcaggtccctcctcttacttctgactctcctcatcaagaaatgacctctatccccacaggctggaatccctcatttgttacctagggaaccaggcaatcaccttttacacactaagtgaaccaaccagaccaaaatagcaatgcaaaggctttgaaaactatattgtcagctgagcacggtggctcatgcctgtaatcttagcactttgggaggccaaggtgggaggatcacctgagaacaggagtccgagaccagcctggccaacatggtgaaacccggtctctactaaaaatacaaaaattagctaggtgtggtggtacacacctgtagtcccagctactcaagaaaatattctaatatatggcagagtgatgacattcttaatatctatattcatatatcagtgcaacacagaagacctcaaataaaaattaatgaagagcattaataatttcccaaagaaagaccacaaatgaccaatgcatatatgaaaaattctcaactttgccataaatcaaagagaggaaaattaataataaacttccattttctgttgaataaatcagcacctttttttttttttaattactacttagtgttgagaagtttctaggaggggggtacctttcttacactgctaccttaaaagtgttacattatcctggaaaaaaataggacgatattttgcaaaagcctcaagaatgctgattgtttaacccagcagtttcattcctgggacttggtcctaaggggaaaaaaaaaaaaaaaaaattatatatatatatatatatatatatatatatatatatatatcctattcacaaggttgtttattgaagtattatttataattgcaaaaaacacaaggaaatataacttttagctaatttatttcacttaggaggtctttcaccattattctgcactgaacatttctactcaaaagtaatacaggtatcactcctgcctctgtgatctaatggccttttctatatagtgccagggttccctttacctcattgaccccaaaccataattttacttcctaaaatttacttctagactagaactcttggggagagtgaatcattggatctctggagtctccatttctgaattatgcaagaatggtttataaatgatactaatgagcgcttacatccatcaaaaatcatgatagggacttcatttaatatgctatttaatttaatgattacaaaatcttatgcttcagatgcttttattatttccattatacagatgaggaaactcaggattagcagataattagcctgtcagtttcatgcacctattaagtggcaaggttgagatataagccctggatcaccttattttgtggctcaaactcttaataattataaagacattgcctaaaggattcatcatatctaatgaatattagataactatgtgcaaggtactgtagtaagtgctttatatgtatctgttcatttaggcttcacagctctgagataaatatcattattatctccattgtacagatgagaaaatatgcacagcacaaaacatatgttgcccaaggcttatgtcagtatgtggcagagctaaaataaagccacatgcatttcactttgctgccttgtgaagctcctaccatctacataatgttttgataataatttataacatatgcttaattcattcactttcttttagaaacaaatctttctttgacaactcagttgctaaaatacaagatgctggagcagcagacacaggaaacaggaaaaatgccacttctaaaacatgaagagctatatttcttcctcaacagccagtgaatcagttccatcccctatcatatttagcatattgaatgtcccactatatagttggacaattgcagttcccaaacatggccaagatgatttcatcctctgctcttttgtcggaaactcggtctcctctttatacttgaacatgaagtcattgcagtagcctgccaatcctaccctctcctcactacttcagaatttatagaatctctgtcttgcatgacctggaataacaacaactcagcacctgctctcaaagtgttaaagtgcccaatgttctcaccagaaggaaatttgcagcattcagacatgtcacctaggatgaaaaatagattcagtaaggttttacattcaaagttcaaaactaacaaggtttgattacaccctggacatctgcagcttcagcaactgcaggaaagcagttggtaaaatatcattatgacggtaatacaaggtgtgagtgggtaagagaaaacccacagcatgatgtggattttctgtacaaatataacaacaccttaagattacagagattactcaaaagaaatactttcctttcattctttattctttaattcagtaattcaacatttatttggtacctatggtatgtaagacacttttctaggtaccagaaatatgaagctgaataagatacattcttcaaaacctagttctttaaaacctaacatcctatagggaagagtgatagttaatcatcatacacattataaatgctgtggtggacatctgaacagagagttttgagggttaaagaattcaaatagtgatcaactccactttacaaagtcaaaaaagataacagagggaatttcagaacaggagaattgcatgtaagtatgcgtaaaagtatgaataagactgtgttctgagaattttgagtagtttagtgtacctgaaggttaagggcaggaagtgagagtagattagagcaaaagagaaatatgatgcctattagtgatgtcaagggatatagaattgatctatgcatttcttatgttttctttctttcttttttttttttttttgagatgaatttcactcttgttgctcagcctggagggcagtggtgcaatctcggctcactgcaacctccgcctcccgagttcaagcgattctcatgcctcagcctcccgagtagctgagattacaggcatacgttaccacgcccagctaattttttatatttttagtagaaatggggtttctccatgttggtcaggctggtcttggactcctgacctcagatgatccacccgccttagcctcccagagtgttgggattacaggtgtgaactaccgtgcctggccaaggatatacttatatattatttgtgtaatagatataatcaaacaaatacatatagagtagaatagtttagaaaagaagtgaaagagcaaaaggaagactacaaagtatggcagaccctagacaaaccataaatgagaatagacaaatagaatgtggtggaaattctgactttttctaaacgaatatgagagtattctaaatgtaaccaaagatagaaatcagtgagtagattaccataataccaaaagtacttcaaaaaggaggagattgcaaggtggtggcaggagatggcatggggaggatgctaaggggcttggttgggttagagttgataaaggcagagtcaaatggactggagaggtttttgtctcttcttaggttgatgtttctccctttgccctgcattgcaggttgtttcttcctctgcctcacttagttttggataagtccagtattttccttttttcatcctcagtgttactcttctttcacttctcctgcctttattcttttcaccctagcttcttttgttctctaaggcccagtcaagatgaagcttcccgcagccagcttctgtagcacttactttaaacctctctcataacatatggtttcctgtgaactccatcaaggcataaaaggttttaactctatatttcccaaactggtttgtgtagcaagtcttcaatacatgtgtgttcaatggaagaaaggaggaagaataggaaaaagaaaagaaagctttttctctcacagctgatttttctatagaattagaaatttgatagcaatattgatattaaatttgaaagcattattttatagcaataacgcaattgtatctttccagtcatcttaccccagacatgtaggatgtgaatcagaggtaatatatttctccttcttaaaacaacaactccgagacaatatgagctttttaaaagaagggaactatctgagaaacaaatgaacaaagagaagggggataaaatggtgagaagagtactgctttgctctgggaatcagaaaaccctacatttctgccttgactttgcactaagtagctgtcttgagtactgcacttcatatttctgagtcacagtttcttctcttgtaaaatgaggagtttggctcaaagttctccaaattgtttgattatgtggcagaaagtaaagaagaagagagtgcagagctgtgactcgtcatttccggagggaaaggaaagcacagaggaatgtgtactcttggtgtccaggttcaggcctccatcctgatcactaatttttgagtttgtcccttgaacttttacctgttttctttttatgagacaaaacttatattttagattctgtctttgcagtttctcctccttcatactgaagctggcaatagaagacagtgagtgagtaagaagtgtcttaaacaagaatggctggaaacagagctctctcccaggcagggtggtaatgccagcaattcaaagaaactaagatgtggcatcacaggatgtctccagtttttggggatcatggaccctcatatcttggctttcaaaaagtgaatggtaggtggctgttgactgaggctttcttagaaacataatttcatgaactactggaaagagacaggaacttagagtctacccagtggaaaaagaataaataaataaataaataaataatgcccaagagcttaaaaaaatgatagcaaagtttacaaacttgccagataagggaacataccaccagtaaaataattcactgagaactttactcagggggtggggggcaggggcagggtttttttttttttttttgagacagagtcttactctgtcagccatgctggagtgcagtggcacaatctcagctcactgcaacctctgccacccaggttcaagcgattctcctgcctcagcctcccgagtagctgggatgacaggcacctgccaccacgcccagctaatttttgtatttttagtagagacggggtttctccatattggtcaggctggtcttgaactcctgaccttgtgatctacctgtctcagcctccccaagtactgggattacaggtgtgagccaccgcgcctggccaagggtcagggtttttaatgctaggaagaggaggtccttggtggttgggtgaatgaaggattgaaaattagcactctagataagggagaagtggtctacagatctgtacacagttgggcaaaatgagctccattgtcttcagttaggttcaatagagtctggagtacccagatcattcaagtccatggtcaaatcagctccacttgatttgactcagttatgatgaaacggtacatagttttgctattttctaggtgagttttcacataaatgcaaagttttcttttaatacaatccaatcccatcattttagagatgggaaaaccaagacaagaaatggaaaaacacttgcctagtttgaatgattccacatttgtgtcagaaatcagcattattttatctttgatgcttgcctgttacttgagcttgataactttacagccctgcctcagttgaagtcttacctcctttgtaaaaggggaacctagtttgtagtctccttttgtaatttcaagggaatatagaattgcaaataaaaatgaagtgggctgctacagaaaacagtgagactccgaattatctaggttacttaaagaatagcaagacaaccacgtagtagggccactagagggaaatatcaagcttcaaatgggcgactggacaatgtgccctttaaagtgacttctaattctaatgtacaatggtagaggaaccatgagtattgtatcgttaccctcactgtcttctcttctaccataaacatcttgagagaagaaataatgtcttatttacagttccctgaaatgtagcaggtgtccaataatacctgttaaataacagaatgaacataaaaactgtgaagcaaacagttggagatcctttggaaggacatctgtcaagactagactatgttatggctctttatttccctttcatttcaaagaagctctcaaagtaatgtgatctgaaagaaaaaaaaaaacagctagcaacttgctcatctattacagctttgtaattctgttagaggagaagtgaagcaatggttatattaaaaagcccagaaataagcttcaatacttggctccttcaaaggattttggggttgggggattgagtttaaagaaattggttctgaggaaaatgcactaaaattaaaatcttcaagttataaaatgccttagagataatattgtcttcctccattttagaaatgaataactcgagatgtccaggtgaaatacaatttaactaaagtctccacatttctaggtcttacaaattcagaaatgttagcagtgaatatgagtacaggatataatccttcctaagataagaaagatttatacccttctttagtgcctggggaaagctccttgattataaacagacagttggttgctgaagaggatgcagttcacacacacttctgacactgagcttattcactacaatacctctgtgtcctagaaacagctgtttcatctcctctggctctgaggctacttcctgacctatcgtctctcaaaatccacctgagttcttatcactgtacccttttgctagtaaagatgtggctactgataggggtcaatgctgcaggggtttatggccagaaagattggtaagggagctgataaaaaacctgatatccactgtgacagtatctggcttcaccagtcacactctaggacctagccaaaagcaaatacgttgttgtttatgtaaatggttgctgaagaggtcctggcaggatttttgtttatagcaggtgaatctatctccacatgcttattagggagttaaagctgtttcctgtaccaccttattctttcctgaattaagaatctcaaaacactagacccacaagatgatttacaggtcatcttgtattcattcctcactttacaatggcagcgactaagtcccagagaggggaagtaaactgcttgattcacaacatgaagcagtgacagatgggattttgggactcctggaatatcttccaccatactcttctaatttcatcaacacatagaatgacagagtggccagcattcaaatctaccttttttttttttttttttttttttgagacggagtctcactctgtcgcccaggctggagtgcaatggcatgaactggttcactgcaacctccgtttcccaggttcaagcgattctcctgcctcagcctcctgagtagctgggattacaggcacgtgccacactgcccagctaatttttgtatttttagtagagatggggttgcatcatgttggtcaggctagtctcaaactcctgacctctggtgatctgcctaccttggcctcccaaagtgctagaattacagatgtgagccaccatgcccagcccaaatctaccttcttataggtggagaaactgagaccctgaggttcatttcacatgtataaggcaatacacatacttagttgtagaatttgttctacaacaaaaattcttcacctaaagaatttggggtccattgttgagctactggggatttcttgaatcgtgtattgggagtgtgccaaaattgtgtgcaaatatgttcatttttctgagtatataaattgtattaggtattcaaaagggtcatgcctcaaaaaaaggataggtaacattggtctatgtcctagattactgctcattgtggcagttatgatgtatatttttaattgtcttaaggccatacataagaggagtttctgtcttgacttgttgggaaactagcagttcatctctttgctaaagtagtgtttatactgaatggtccacttgaaatatcattagtcactttataggacaggtaatggcaggagaggagggtgaatattgagaacaatgaggcagatttttgaacttttatatattgtgtcttaacagggaaagtccttggggttttaacctccaaggtaatggatatctttgcctccttccctctacctctctgctcctcctgccacactgaaggtcccaaacaattaaatttttggactttgaataagatgacatgggtttaaactcatactcagctacttgctagttttgtggccttgggaaaaatcgctttttcttttcagacttccaatctcctggtaaaccttttcagtagaatgtaatatcatgctttctactaggtgggaaaaatcatctacaaatgaagaacccaacaaacaatctgtagagtaagtagaacatggacttatttaatctgcacatctccatctcttctcaggctgatggggtccaggctctttaggaatccaggatcctggccctgatagtaacttggtgtttggcactcagccagacactctcctactccccccaactcaggacgtctatttctttatctgaaacttgagctggttaaaacaagtaattccttctttctttctagctctaaaattctgtggtctctccagctgtcactgaggtctcatgtggatctgctgaaatcattgtcattctatgattgccccacagctacattttgaagaacttcctatagacacatttatttgaattggtcctgggtgatacctggcagctcaagaactgagtggctcaagaaggaaaacccaaaccccggtagaataaggagaaatgaggaatgatgattttggcctgttatttacatgcttagctgttttgttcctcattcaatgtgggtatcactcatttttatagaatccttctattaatgcaatttctgatcattactggattattttagaggcacattaccttctttgtgacctttgccttttcagttagacttggaacatatttccacatgtttggagtttgtcctgaagatgcttttttgactggactcctgaacccaatgtgttacataatagaaaactggagttgtcactctcaggaactgctccaccagaacaagcacgatatagagtgatttaaattattcacagtatatttaaccttcttcactactgccagagatttagaaaggtaattgattgtggctcggtgcagtggctcacacctgtaatcccagcactttgcaaaggctgaggctggttgatcacctgagatcagggagtttgagaccatcctggccaacatggtgaaaccctgtctctattaaaaatacaaaaattagccgggcgtggtggtgcacgcctgtaatcccagctactcgggaggctgacacaggagaatctcttcaacccgggaggtggaggttacagtgagctgagatcatgccactgcactccagcctgggtgatagaatgagactccatctcaaaaaaaaaaaaaaaaaaaaaagaaaaagaaaaagaaaagaagaaaggtaattgactgtgtatggcaactcaggatttctcaacctgggcaattgacattttgaactgaacaatattttgttgtgggaagttgtcatatgcatttgtaaggtgtttaggaacatctctggcctctttccattagatgccaatatgacacttctgcttcccaagctgtgtcaaccacatatgtctcaagatatttccaaatgtttcttgggggccaaaattgcctctggttaagaaacgctgctttaaataatcagttttcctgtttaagcttcagggttcctatctgtaaaaggaaagcatgtttctcacactagctgtgtaagagtctatactacagtcctctggtatctacagcactagatgtttccttctaaagaccattctcttttgtttttctgttgttgtcctttgggtttctgttgttatttactatagaaataggccagttaaaaaaactaagtgactaatagaaacatagaatatcgtacctagaaccattcaaatagatcatcttgcccaagtcaattatgttcaaggcaagtgtgcttttcaagatcaagcttgttaatgtcaggactgaaatacagatttcttcatcatttctttctgacacaattcaatgcttttcttttattgctacgggttgtcatcttcggaagcacctataatcttaccttaataacattatttctagcactctctattattttattgataaacagcaactgtgaggtaacactgatgtgactgaatatgtaacaaacttacctgagtttacctctacacaccagtattctcttcttaaaagttatttccatatggacttgacattcacttgaacaaatacaaaatacttttgaaacagctttagattttgtgttagaatatgtgcctcttgttttccttcttttttcttttattttctcctctttccctctgttctctatttctttcttcttttcatcccttctttatttcttttacctttttatttccatctcgtcttctttccttttttcttcttcctctcttctccttttcatccttccccttcctccctccccacttttatttactatgtgttacacctcattacaaaaggaatgtggcataacttacaattaataggctaaaaataggcagtaatcacagtgaaaaaatatagcttttccacattccacaaatgaaaagaaattctacattatttaataactataaaaattatatataaatgcattttatttttggacttgggagagaagaaaagactctatgaacaactgagcaatagggggaaacaggatggtcatcacagaatcattgattcagagacaatccagaactgtgaaaagtgaagatacggagatgttgcgagcaatgacctgtcaaaagctgctcacagctatgagtggccaatctgtttactgaactccttctcaaaacgtgtcttttctctctccttcaggcagatctagcatggattaaatcactgtggagccagccagtagcaagtgtattcaaatctatttaatatggtcttaatacccgtacaagagagtcatgtcctgtaaatggacgagtattatgaaaatctttagaaaagggtacatctgaacctttcctgccagcaccccctcaaacaaaaatcagtgttttcaggagaataactatgttacaggtgcttgttacctacaacctttggcttatatcttatctcaagcatctactccgttatgtggcttcatcaataaaataattgaaatagataggatgactgtttctttgactccagaatttcatatcttatactatttaaggaaaggtgattaatgaaaacaaagtaatttataaagtatatacattttagaatttaaactaattcttccaattgcttgcactaatccattgaaggttagctactcttccctacgttcgtattctgcagaatgatttcagattgaggaacagacacccaagaaaatgttttcccccaaatacacattaattaaaaccaagggagaagagaacaaggtgtgacagcttttctgtgtgaattaagctgggtaaaatacctgaaccatgaatctttatttgtggaatgataatagctaaatccaaatagggttttgcaccaacaaattattctacaaatcatggagtgcttcgtatactaaaaaaaggagttattgaacggaatttggatggggacgattattctgaatttgtgctactctaaaaggtaagaaaattatggtagatattaggccttatgttttgcctatttgaatatatacggctatagtaaaatggaaagcagtagaggtagaggtaaataaaacaatctggacttagggtaaatgatagctctctgatcattagatgtgcatttggagcagattaactcacggtgcctggtgttctcatttctaaaatgtaggtggtgataacaaagataatatatgcctacctcacaaggtcgttgtgaaggttcagtgagtgaatagatgaagatgattttaaaaagtttctgacacctcaacaacaccgttttagtgttatcttttattacatggccatattgttttatgcattcaaaagatgtacatgaaattatctaaactatctgaggtttaagaggtatagctcagagtgccatggactataataaagtatgttggtgttatttcttccagactattaaagagcggaacagaaatgtgactaagatcaacccaatagtatatccttcacttcctttgaatatagttttctcattttacataagcttttaatcttagaacagtatacaatttacagaaaatttggaatgatagtcaaaggagtttccacataacccacacccagtttttcctatcactaacatcatacattattatggtatatttgccacaacgaatgaactaatagtgatacattatttttaactaaagttcatgctttattcaatttttctttgtttcacctaagtgtattttgctgttccaagaccttattcagaataccacgctgtatttagccatcatgttgccttaggttccccttggctgtgatattttctcatacttttcttggttttggtaaccttgactgtcttaaggcatgctgttcagaaatttaatagaatgccccttaattagactttgcattttttaatgataaacctgggtttatgttctttggggaggaagaccatgcaggtaaagtgccattttcaacacattatattaagggtacatactatcaacatgaattttcactgttgatggtaatactgatcacctggctgagtcatgtttgttaggttttttcactttgaggttaactcttttttcctctttttccatgccatactctttgaaaggaggccagtatttacagcctttttttttttttttttttttttttttttttttggagacagagtctcgctctgtctcctagcctggagtgcagtggcgtgatcttggctcactgcaacctccaactcctggtttcaagtgattctcctgcctcagcctcctgagtagctgggattacacacgcccgccaccacacctggctaagttttgtatttttagtagagatggggtttcaccatgttggaccaggctggtcttgaactcctcaggtgacctgcccaccttgacagcctattctttaagagtggagagttattttctatcttcttgagggtagaatatctacctaaattatttggaatttttctgcatgggagacgtcttttttctcacttttgttaatgtatctgaatatttatttatatcattataaactcatggatagttatgttatacattggaatataattaaatactactttatttcctcgctccattgctccagttttggccattgaaagctctttcagttagttcctgtgtccctttgatatactcatattattttgagcatggttttaaattttttgtttgtttgtttgtttttctttaatttgtggtgctacaagatgtttcaggctcatcttatatatgtcctgcttcagtcatagaagcagctacttatccaaggatctctggtttcttttactggaggatagttttagaaaccaagaactgggcattaggttttctcattgctgctgggtgttgttgcttctaggctgtctcagctgacagagcaaggaaatatatggatatatactgacccatgtatatgcacatatctataaatatttctatgtggaactagctgtacctatgctgatttctccaacttttattcaaccacatggatcattctagcctttttgccttgtttttctgtatcctcccacactaaagtgaaaaacctcgctctcatacacgcatcatccatttacttaattgttttatcacagtgtacatatatagtggtttcagaattgttaaaatgtagcctgtggaaaataattttatcaagtaaagtacagtgcttatatatcgttcattcggttcattttacgttaaattttatagattcgctaacttcagagttacttaagttagtgtctcctcccttccacttctttagtgaggttgtttcatatatttgtaatatagtgagaatattttatcacactctacattccatcccaagatttcctgacctcctttgtattttattttgtttttaatttgcacacattaaggttcattacttgtgctataaagttctatgggtcttgataaacccataatgtcatgtatccaccatgaatataccatacagaagattttcactgccctaggttcctgtactcatctattcatcctttccctgccaccaactccaagttccagacaaccactaatcactttatcttatttataattttgccttttacagaatgtcatatacttggaatcatatggtatgtagccttttcagactggctttttcacttagcagtatacctgtaagattaatcctcatcttttcatggcttgatagctcatttactattattgctgaaaatattccatagtatggatataccacaacgtattcattcaccaactgaaagacatcttgcttgcttccaattcttggtaattatgaataaaactgctataaacattccaatgtgtgtttttgcgtagatgtaagttttaaatcagttgggtaaatatccagaaacataattggtgaatcttctatagtaagggcatttttggctctgtaagaaactgtcaaactgctttccaaagtacacatacaattttgcattctcaccagcaatgaattagagtccttctggccccacatcttcaccagcaattgcttggcagtcgtttatactttagccattataataagtatattgagatgtctcattgttttacttttattttcctatgacaaattatgttgaaaatgtcttcatatgcctatttgccttcttgatatgtactttgttgaggtgtctgttacaatcttttgcccattttaaaatgttttctaattgttgaattttaagagttcattgtatattttggatgtaagccctttatcagatatgtgttttgcaaatacttttccccagcctgaagcttgtctttttagtctcttaatagtttcctttataaaacaaaaggttttaattttagtaaagtctaagttaccaattattttatttctgagattatacattttatctaaaaatttattatcaaactcagtggtccagatttttcccatattttcttccagacattctttatatttttaaaatttttacattgagttctatgatccattttaagttaatttttgtgaaagatgtaaggtgtatgtctaggttcaatttttttttttttttttgcatatggacactcgattgtttcagcaccatttgtttgaaaaaaaagtctattatttctccattgaattgctttttcttctttgcccaagatcagttgacggtatttgtatgggtctgtatatatatctgaaccttccattctgtttcattgatctataagtatattcttttgtcaataccaaatgtcttgattactgcactttacagtatgtcttgaaaccaggtagaatgaatcctccaatttttttctttttcagtattgtgttggatattccagatcatttgtctctccacataaacttcagagtgagtttgccaatatctcaaaaaaaaataaataacctgccaggattttaatttggaatgttttgaatgtatacatcaagttgggaggagctaacatctagacagtattgagtctcctctcccatcaatgcaaaacatatctctatttatttagatcttgcttgaatttttgtcagttttatacttttctgcatatagatcctgtatttattttattggatttatagccaaatatttctcttttttcagttctgttataaatttctataaattttcatttttatttgttgctgacacataggaaagcaatttctgtatattacccttgtattttgtgactttgttaatagttgcttattagtttcaagaggtacttgaagacccatggattttctatatagacaatcatgtcatctgtgaataaaaccagttttatatatttcttctcaatttgtgtattttaatatgattttgttattttacttcactatttagggcttccaggacaatgttgaataggactggtgataaaagacatccttggtttgttctcattcttaacattttaagaagcatccagtttcgtaccattacacatcaggtttaggttttttgtaggtgttctatgtcaagttgaggaatttctcctatactcccaatgtcctgagactttttggtcataaatggatatcggatgttgtcaaatgattttttttctccatcaattaataagatcctatttatcttctttagtctgtttatgtgagtgaataatttttaaaagtttacattgaaatgtcactagaaattcaataattactcatttactccttcctttctcttatttttctcagtttcttccatctcaattagaggtggcaatcattcctttatttaaggcaagctatgtgttatttctcgaagggggaatagagaatgtaatgatacctttctaaagccagaatgcctgtgttaactgtccagctttacattttaattatccatgagatgctatatagattactcctttacattgcctatctgtaaaataggctaatagtaagatctgtcttgtgaggattaaatatgcttatacatgtatgttcttagaagaatatctgcatgtagtaaattacgtaaataatttattacatcctagaactcatattctttagctcattgttgttcacattgtaaataagagcctattgatcatatctaaactatataatatttaagttacaggtcaagataatattttacacaatatttgaaaaattgatattgcttttttgaatacagagctataatattgtggaaattacagtgtatgacaggaagaatagtatctattatatttgtctcacagaaattctattggtataaaacagaataacagacatgaatgcaagtatattgagttaagctagtattgaatgcctgccaagtgctgaccacggttagctcccaggcacatagtgatgagatggccaacatggttcctcctttcacaaagcttacaatcaagtaggaaagaaagatcaattttcctgtaaattatttccttcatacaatacagtgagcatttcctctgtccaaagtgttccacgcttactgcctcattttaacactcacagtaaccttctgaagttgctcttaatacccttattttactcatggagaaactaaaacagagagaagttgaggtttgcctcaggtcccaagactaatgtgacttaaattcacttatttctcctgactcaaagttattgctctttacgtgcaagtttccacattctacaagctagcatgatgtccaaaaggtattttattcacttgtcccatgaaattggaacaataagaaattaaaagtttggacatatttttcctattttgtcttggagtcggagaggaacttagagaatgcattaaatgattctaaaacattgagcctgaatgcaagtaccatcagcccatcatccagttgtctgtagttttatccacaacaatgatataagaaattcagaatgactaaatactaggaaagtaggatctacctgcccttcattaacataggttaatatctggtaaaaatggcactagcatatttgttttaaaaaaaaatcctagcatttatgaaactataaatctagatatcttgacatagctttatggataccatcactgatttgattaatgtcacttctgttattatagataatttaaattttttgcttgttctcaaagaaaaaaaggaaaagaaactattcttcatattttaaatttcaacattaaatagttaatgaagcttgagttatgattccttacacaaatatttaccaacatgaattttaactgctgaagaaatgtattttaatttatctcagctttggcagtatcttgttttagaaacaaaagagttatgtgcgctgatgctgtttggtgactggggaacactggtctgactgcagtgctgagtgggtaaatccccttgtgcctttaagaagtcttagttgcttaatcttcatggacatttgaagtgtctggagtgagctttgataaaaggtggatcaacaggttgtgcaataacttgaggttaaatgccttcccagaggctcctaaagatgatcattttgatttttccaattgaggtttttaaacagcagctgtagggcagcattgtgatgagaggaaaagccagcaggatggttttctggtacagctccatcttaagtaatacaggcattatgaaaaaaatggtgccatcattcatagatttcagtttcaacaaacacttactgaatgccttactctaggtcagtcccagtgtttgctgtttccatgtactccatctcatttgtttctcactatagcactactgctcaagtacttattaatatcccaaaattgcgtatgagaaatggaagccccacatgaagaagggaaataaagtacatggtaatttcctagttgcagatgctggagctctaatatgaggtaggtaggtagatgggtatcatggctagaatgtggcatcaccattcaggatcagagattaatgggaattactgctgggtagctataacacaataacatatccttatgtcccttgatgtgggcggggtaaactttccattttgatcttaattgcgatgtgctccaatgagcagctggtacatagagaattggaaacaggagtgtctagtagcactgacttccccacttctgaagttaagataatgagttcttttacatcctctgaatattccagggatattttaggaatatgtttgggatgggatggtaataatcacaacataccaagctaggaacataaaaaggtatggatcatattaatatcacccaaatctcttttaaagtaaatgtattacaaaaataatgttaatgaatcctggttaaaagcgctaccaaggcccatccaaaccagaaaatctgtgatatgtgattttagaaaggatcatttaatattttcaaattttctaaaatgagagataggctttgaaactgaagattgttcctccttcaacttccaacatgattgtgatgcctccccagccacatggagctgtgagtccattaaacctctttttctttataaattgcccagtctcagatatgtctttaatagcagcgtgagaatggactaatagaactccagtacgtgctcctcaagaattatctctaatgaaagggaattaagaattagtctgtttctgtgaagatgtgaaagctatgaaaattcatttctccgtatgtctgagtatcacagtaaatgaaggagtgagtcttccagagaagggattacagtagttatttaagggaggcatctaaacatgaacaagaaatcaaggcaaagtccaactgaatatgagaagccacctttcaggaagctggagataagggtgtatgagaactgattttcagtaatgtgaggagatatatatacatatatatatatatatatatatatgtaattttatatatatgttatatatatgtgtaatttttaagttcagcaggaaatgtgggaggaatacaaaagagtacctatttggatcatatttattccaacagaaaatggaggggaaagttcaaaaattcacatggtccaatgcaaagaggcctagagttaaatgttctgataaggcgctccattccttttctatcatttactggataagtgacctgggattgattcctcactgtctctgtactttcctattttttgaagcagaggtgataatacctggcccacggtcatgttcagtacaattagttgagtgtattcttcaaatctgaaggacctctgtttgttgctaatcttttctttctttttcttctttttccatgtaggtgaacaccacatacacaatttaccttaataaattaaataaatgtgtaacttgtctgcaagttggaaattcctgagggcaaatgcattatcttagggagcctgcaacatgcctagtattactgagttggccagagaattcttaacactagccctggaggcctgtaccagagtctgggtcctgctgaattggcccttggggtttttctggttctggagctgctttggtgggttagttactgagcttctctagtgggcctcttgttgttttagtagcttccctgagggaattaaaggttttaactgaatgtgaaacatcagacagaaactgcagggaaagatttattgacaatgaatctcaactttccaaaggttcatttgaaactaacttccttctaagccaaaatgattcaaatttgaaaccctccaggggcttctctgggatttagggtattagggagctttttccttgctgtcgtagattatctcaccattgtttcttgacttgtagaagaggaggtttgattggtaaatcacctcttccctacagctttaaattctttactcattcagaagataagcaggactctggctgtggtgcattccaaatgtttcctctcctgcctgggtcccaaggaaaccagcctgggccctgccaagggtataatgagcagggcacatgccacaggaaagagccagagggaaaagttgaggttgagcatcgcagaaggttaccatggatgctacactgtttttaaaaaggtaaatattcaggattgagcagagcaaaaagtacagacatgaatttgagttttacctctgtcacatgaaatgtgatctcaggaaacataaacttctttcatgctccttttctgcttctgtaaagtggctgaaataagttttatcttacagcaccattgatatgattggaaataatatatgtataaagaatagcaagaaattaataaatcacatcattaacaacaggttttaggcactggctcaggcaatgtgtgccaggcattgtgcaatgtacctcatatgtattatcacatttaatcctcttgaatctgcaaggtaggtgccattgtcatttccattttgcagatcagaaaaactaggctaggtttaaggaacttgctcccagccagctgatgagtggtgcaatcagaactgggatcagggttaactacaaaggccactccatgttcacaaacttctctcaggccgggcacggtgtctcacgcctgtaatcccagcactttgggaggccaaggccagcggatttgttgagctcagggatttgggaccagcctgagcaaaacagtgaaaccccatctctactataaatagaaaaattagctggtcgtgggggcatgcgcctgtagtcccagctactcaggaggctgaggcaggaggagactgggaggtggagattgtagtgagccaagatcgtgccactgcactccagcttgggtgacagagtaagaccctgtctaaaatagatagatagatagatagatagatagatagatagatagatagatagatactctccctgatgctattttctagggacccaatccgtaggtcttcctattgaaaaagaaaagaagaggcaggtggctgccagtttgagtagggtgtgcataagatgatattgaaagaaaaggtagagggcagagtcattagaactttaaataaaagcagttttctaaatccagatccttacatactatactaatacagagaaaagccagaaagtgcactaacaccccatattttggtcacagcattgtcaatattctataggaaaatttagagcaatttcatttgtatctttttctctaaagacaaggaaatagaaactaagaaagtgatcatgacttattcagagttatacagtgagttgttgggaaaacagaggccaaaacacagttctctaccacaccagaccaccacactctacacaacctcaacctggcctctgatggagagtctacagtcagtgagatagcctcaagttctctaataaacattcacttactagaaaggactctatagttatcacttacgcttcagtgtgaattaaggacactttgttgttccctgtcccagagaacatttctttggattcacatttggacaactaggccatacatatcctgtttccacttactaaccagatactacctacacttcaggctagccctgcgcaataggctagatgataagagctacaatggtgggagaaaagtatgattgcctgtaggcaatagtgtgtgtgtatatgtgtgtggctgtcctgctccaacctaaaaggttaagtagtaaggtgatgttggtttgtgctatttttctttccagaatgttctttttctggttctctacgtggtaatactgaattaacatttcaagtctcagttttcattacttcccttgtgaagccacccatagcttacatagtagtttctccagctttttagacagcccaccatttaaataatatctacctattgttcagatttcactttaaatgccaggatctcagggaaacataccttcataccaggcttagactcccctaatacctgctttcattgtaccctctgttttcttcttcatccaattgtcaaagttgtatgagagcaattactgtgcttggttaatgtctgtctcgtgactaggctataaatttaaggaaggacaaggttcttttattcacagctttatttcctcagggcctagcacagtgctcagcacagaataggctctcaataaatattcctcgacagaataggttacctgcattcttttaaattgtatataatttttcacaattcggacactctcactgaattttgtttccttagagcttggcacagagtgttggccactagaaaatgcttttaaaaagatttgaaagaaaaacatgaataaaataggctaaaatctctcatccatgaaaattttctaaattcctgtaaatccagctagccagctagaataattcctataggtggtttatcacttcctttctccttgagaagcattaaaatcacagaaacctagtgttccaaatatttgtaaaatgctatgatttttaaatttacattcacctagatgtatgattttcttcaatattttttacatatgtataatatttgtataaataacatgtcatcattaaaaatccaatttagcaactaacaacccaggtttctcaatgctcaagctatctgagaagctgtatagtgcagactcaagagcttagatgttttatcagaatgagtatgacctcagctcttcttactggatgtgtcctacaggcaaattgcctaaccattctgagcctcagtttcctcatatgtaaaatggggatagtaataggacctaccctataggattagtataaggtctaaatgagataatgcccagtatttagcatatagtaagtaatgagtaactttgagttttttcttcatttcaacgcttttcattcttattcttttttcattcttattcatttctttcttttctttttcttttcattcttattcaattcttttcattatgattatttagcctgtggttggtaatacctaaaacacatccttatggtgcctgaagttgctcctgagtgcgaagcagccttctcacctagacggtgcacacctcccatcccagatcagaacctctagtcaatgggagagcatatggagttttaaagaacatatttattataatatatacttttatatttaggaaatttaaaaggaatctgttgttttcaagaaccttgataaagaaaaatattctcaaggggggtacactgaattctccaggtgtgtttaagattttttgtatgtcaaaaggtagaaaggaacactggcctagacctgaaaggagatcatttgccaccttaaattgcttattatatgagggagaaagtatcagtctactgtgaattcacaatgccagcagccatttaacagtaactgtgatacttcagggactgggatatccacaaagaagcctaatgttgacctgatttacaaattaaggaaaaatttattaattctgtagtgcccatgcatatactatgtctaataaagtgtggaattctcccactctgctttgaattgtgcattttaaatatggagaaaatctttatatcacatcgtattaatctataatcgccccctggtttcagctccaccagcccaccctcccctacaaatacaaacagttgttacacagtataacaattatgacaaacattattttagaaaaaaagagaaatcagcttgccattgtgaacttacttcttttttttattttattttattttttattttttgagacggagtcttcctctgtcacccaggctggagtacagtggcacaatctcagctcactgcaacctccgcctcctgggttcaagtgattctcctgcctcagcctcccaagtagtgggattacaggcacccaccaccatgcctggctcatttttgtatttttagtagagatggggtttcaccatgttggccaggctggtctcgaacacctgaccttgtggtccgctggcctcggcctcccagagtgctgggattacaggtgtgagccaccgtgcccggccgtgaatttacttcttaattctgttttttcccttggagactcttcccatcttctgccgtgggctctctgcatcttgtgacatccagcaatacatctcaagcagggaaactttttttccaaccagtaccaataaatcagactcagaatttgctatatcctatgtatcagccaggcgaatttaaaactctaagaccaagggacacaggttatcaccagctttgtttgatagataagggaggatcacagagacgacttgtaacattgcctaaggcaatagtagttctgactctagatctctgatacttcaatggagagtccaaatagacaatccaaatccaggagaaacagtcttcagcattttatacaatttctcctacacgctgaaagatccccatgctgtgtaacaggtcttgatttattctgttatggttccttaaaagtgttcttttgctagctcactttcttaagattttagcagtgtatatacagatgaagcattttagctttgctaattgttgtcaacacaggttgtatcttagaaccatactaagacatgatcatttttaatagtacagttttatgataatactatctaaaaaaggaattttttaaaaaccatctactattttatcacttcagcaaattaaacatttctatttttctgttccttttcaaaatcttgctaaatgcttgcatagtatttgcatatctgtaatcacagcactgataaaattatattacttaaatggatagtatattcatttttctgaatttgccacagagtaatcattttaattactgtatgtaatattgtactatgtagatttgccagaatattataaacccaaacttttatgttgaattgtaggtgaattatatactctttttgctattattaacaaatctatagtcgtcatctatatacatttgtacatttttgttgttttacaaattttcttttggagatattcccagacatgtttgctgtgtcagaggataaggatatatttatgtctatagcataatcaaatttttgctcttttacatatgtcatagtaaaaccttcctgagcagaatgctgctaatttaaaatttagattattatcctagaaaatgattactttaaaaaacaatattattctaaatgttaatactaacatcataaccattataaccacaaatagaataaattaaacatcaataaggcaaatttattgcctaaatttagaacttaagaaagttacttatgtatacttcttgttaatttaaaatagaccttacctattttttagagtggctttccaatatttttgaccactagctataataaaagtactatttatgtggcattgtacattgtgtacatacatatacaaagacatgcaagtatctataaggtgaatcctaaaatttcataaaacaatacttgttcatattacatgcagtgaaatctgatatattccatgtcgttccattgccttttattctatttcagagtcatctatgtttttttcgttccttctttattttcttaagctggctgtagcccactaaattgttttcatgatctcaatcagcagagtgaaaaatcatcttttaaagcagccttgacaatacctaagcttaaaaatggtttactaacattgaattcaatttgtacaatcttttaacttcgaacttggaaccagtttcagcaaacaatgtctctgccagtagtagcagtcatgagaaatacacggacttaaggaaatcaacctgttgtttcgtgaacaacagtttcaaagaaaccacaatctatctttgttttctcgtttgtttgttagctacagcctgatttttggttcagtcatttatacaagttgtgccaaaacctaaactgtatgattggcatacagcagtatttaatttggtggattaatttcttctctggaatggatgcatctaatttctgaggaaaacctcaaatgacatgtccttactgagagatggcatgccaaagtggcttgtggtacctgacataaatagagctgtgaagcatgtttgctgaccacgaatgaacaggttataaagggaagcacgtgcaagggtgcttttaagagtagactgggcagggtcttgaacccctaaacccacctggaactcaaagacacagatttcattcattaattctgtcactatccactattctactagaatctataatgaacatcgcctaaactgctaaaaaaaataatatgcgaaggaagactttcattttttataatacttaaaataggattactcctcttagacttctttatacccatacattgcttcacggctcagagacactgctggaacacgagagttaagagcctttacgttgtgttcaagaaattttagagtgtcagtttgttttttcacagtttccaccaaaagcaatcctcttacatacctagaatatattttactgtggtatatctcagtattatccccatatagttagttagattcatccttgtttgctgttttatttcatcatctcacttttaatccattatcttatggtacattatttttcttgtacatcatgaaaatgtacactccagctgaaatatgaatttttgtatgtaattattgctcagcttttttgagaacaaggaagatacaatatgaaataaattactactttccccttttggtatgattttaaatttgcttttagaacaaattattatgatggttttctattctgaatctaaatagcctttttttccataagagttgaattaataaatttgttatagctttgcttcatggaactttaacaaacatcaaggttatatttctgtctaatcccttcatcattctgttgtcctatttatgatttttttcttttatttttccactatggagcccacagtctgaaaccgaagcatactattacaactttgtcttcatttttattttaaatttgtcttatttaagacagctttatgttatttattcttaatggaaaatgcactgaggagaactttttttatttgcttttttaaagaattacaattgtgccactgtactccagcctgggcaacagagcaagactccgtctcaaaaaataataataataaaaaagaattacaggtgctttttacatttatgctgtcctcaataaatgttcttcagatcatttgtcctgttctctgatttataattcctaagaggacactttaggaggcatacatgggaggcaatgtaatatggataagctacagttagggatgatataactcaggattgtagttttcctttgaaggtgggtcatacaacttaacctttgctcactttttctccatccataagatggacatgcattaccttgtttatactttttaggaatattttataaatgaataaacatatttatcaataaatgctttgagttatttaaagacactgtaaccatatcatttacttagtaatagcaaaaatagggggttgtgtaatgtcaagtacttatttgaatttgttatgttttcaaaaatggtccatgtttcactagacttagactatactattaaatcatagaagtctgtgtatatgttagggaaaggcgtggggagagaaaaggaaaagagaaaacataccttcactgtgtcccttgtaagtatagtttgtcaggtaaccctcctaacaggcctaggggatagatattattacctccctgttgtagaggagaaaaatatagctgaaagaggcaaaataacttgcctgaacttataatcaatatgtgactgagctaggatttgaactcagctacaaaactcagctttacaggtcaccactcagtttctcagctttcagattcctgctttggaaacatgttagcaattaaaatagaaaagggcagggataatttaattaaaatacttaatttataatgttagccaaatagattttttttttagcttccctcaatatttccattactgctttagttgcagttttggattatttcttattttatcttgctggtttgtccaactctagttcctggactcacaaaaatatacttgctaaagatgcgttaaagtgcatgacctatactgcaatttctctacatagttatttatgtgcttaaaatggccatcttggagagtgcctgaaggttgagctagaggagggtgatggaaggaggggtgattcaacagagtcagggaaattccagatgacatgggttgccagatttcctgctggcctttcactgccaaactccacctcctgctcttcttacacagctgtgtgcttcattaaatagtgatgtctacaaatcacagcagtgttaaaaaatgcagagcagggggaattcctgtgcactgactgctgccaagttcctagagttttaacagcacactcatcaaactgcctctctcttctccaaaaactataaataagttcaatatcaagagtgttttcatcaattataatgcctctctgttctcttggagagttgggaatagtatatagacacattggttacagtgcccatgtctaaggcaatatggtaggggtcatctgttgtcagagataagacttttgaccttgatgttgccactgttcttccagttgagccaggaaccattacttaatcatttacagcatagattttcccatctacaatttgcttttcagaaaccagccttgtggaatttaggccaagaacctggttgctactgctcagagtaggtataggagaggtatgcatttaattcaacaattcctcttgagggtttctgtgtacaaggtcctgtgctgggtgaggttctacctcatctttagcaagtatatttttgtgtttacaatgacaacattagtaagacaaggctgctaatacattcatagtacccgtgtgaggtgagtgctgatgagtggtccactagagttgttaaaaagtgccacaggaacgtggggaaaaaaatataaattttacctggaggattggagacatttcaaggaggaagtaacattggctccaggctttaaagaagagaggggtttaatagataaatctggaagtactccagatagagggaagaatgcaaacaaacgggtagagaacggagaaattcagtgaattgtcagaatagtgtcttgccttgtgttgtagcagtaccataatgactgacagcctacagtactctgacaatttaaaaaatataacctgttttctttcatgtgggtataatgtctccagttaggcctatccactttttatgatcttataccagctggatccttacactgatgtatgggcttgagcaaagaatataaggcggagataggtaggctgatggaacttccgtgataggaagctgtcatgttggtttggtggatggacagaggaagagcaaaagcatgaaggagaaaagtggaagaagtgtggaggccacttgaagaaaagtagtagctaaatggtaggcaggactcgagtcaactttcttctggaaagtttcaggactgaatctggaaaaggaaaacacagaacaattaaaattgatgtgcatttattgagcacataccttgcacaaacactacaataggcaccgtggtagacactgagatacaataatgcatttccctgtcctcacttacgaggacaggaaacagacacgtaaacaactaactactgcacaaggtagaattcagtcacagaggtcagtttgtcacagaaatatggaagaagacatttttgattggagaggaataagaaagttttctgaaatattctgaggtaagaagtgaagattagctaggttattaataagtcttagtccactaggagtgctgtaacaaaataccataaactgggtaacttacaaacaatagaaattctcatggtcctggaggctggaaagtcttagatcaaggcactggtggattccgtctgatgagcaccagctttttcataggtggcaccttcttgttttgtcctcacatggtggaaagggcacacagcagctctttgaggccttttttacaagagcactaatcccattcatgaggagaggcagtaatgatttaatcacctcctcaaaaccccacctcttactatcattaccttgggggttaggtttcaacatatagatttggtggggtgagggtggggacacaattattcagatcacagcaataagaagacaaatatggaaaggtgtttcagattgaaagacagagtaggcaaagagaaaggttataaaatgcaaggactatttcagaaatgaaggtaggattatgaattatgttttattatgagatgagtttaagctcagatcattaggtgtcttcagaaccatgccattgagtttgggctttgatcttgagagggagccattgaaaatatctgagatgtcaagtgacatggggacatctgtttttggacttaggggtgctgggaaattccactattgccacatcttaaacctctaagaaagagctaggtttgcctgggaattctcccagaccaccacagcacagacagagaggtcagattggatttcctgattatttggcttatggtcagatagattgagatgcaaaaacctcaaaataggctttatggccacttcatctccatttgtacccctgcctttgggctttatagcattctgtttattctgtgtatttctgacacttaacacactgcctggcaagtaactactcagtaaatgtttactgaatgaatggacaaactactaacttgtttcaacagtggggaagaggccaattatcagagcttgagtaaacaatctacacatgagcatctggttttgagctgacagacaactagcctttgataccatcctctggtccttgagtttttggataaatacttcattttcctgagctgagttcttttcatttgaaacgagttcatcttattccaaacgtttagggggtaatctcaaatgtacttcatctccaatgaactgatccagttttaacttcagaaagtcaagcttcacatctcccaaatttatttgatttttgaattttgaaaagattagagactgaagcctgcataaaataacaaaagtaattcaaaaaagtgttatatataccatagttgaacaattaaattacaagttcaagtctaatccaactttttaacttataacattatattaggtgtatattctgtgaataactttatatccctcttcataattataattgatgcttttataaattttataattgatgcttttataacttttataattgaatattatttcaataaataagtccataataatataataaaataagtagcaaatcaatttctaagtctgagaggctttacaaatcactaattagaaaatatatgatcaagtgaaaaattttttgttcagtatggaaagagtgattaaaacctggtcttcattctctccaaagtacggttttaatagtttctgttgatccttaacacatctgaaacctaaaagcaatttagacaaagttggattttccaactcttcattttatatgtggtattcacagatcctcagtgccaaatgattatctgtagatgaattaaagacaccccgtaagtggaattgtgtgtatgtgtatgtatgtgtgtgtgatgcaaagcgtcacaggaccctcataaggtggactttgggaaaggtactattaaacctctaagagttctgccttcaagttctattattctctgccatgacttttgggaaagtgatcatgttcccggtgttctgaaagtttaaagagacgtatgcaaagagatgaggttttagcaatcgctccagaaattatcccatcacatagtgtaggctcattgcctaagaacagaatataaccgagaataatacagaaatatcaatatccaaggacaagtaccgaaaaacaaatcttgttttgacagaggtctgttaaagtgtatgttcgtacaccaattatgcggaaattttgagaagtttcttttctgtccatcctagtaatgtttgagtgacttggttgtgacttagaggcctccttttcaagactgtatctctcactgatgtacaccacagtttctgataggttttccttggctggagattatccttacatctttccaaaattctctcaaatatgagaggcctggtttctcaggagggagtattgaagaagggcatacataaatgacaaagagttaattcagcttgcttctcagagttagagtcattgaacgtaaacacacacagacatacatgtacacattcatataaaaagcatctcttttttttaaagtgctgtctaaaaagcaaaatagaacaaaaatccaagaactcaaaaattctacacaaccagagaagcactgggagagaaacagtactgtacgttcagcaaactgttttattttcctcttgcacgtagttagctatatttttccaacctcccttaaagttaggcatgggcatgtgacttggttctaactagtgcaatacaggcagggtgcttcatgctgcttccagatgtggccctaaaattaccatctgacccttcacttgccctcgtttcctccctttctcctcccttctcctctcctctctttatcataggctgaatagagaggacccagaagaaatctttgaggccctagaggactgctaagccactagatggaaggattctagacctcttagtcaccctgagtaggaaagtcacacaagagagctgccagaagggaaatatctgtgtaagattttgtgtgagaaggctgattatagcatttgttttgaaattacggcatttgttttttcctgtggttatcttttaatctaaaacaggaagcattgagggtatgttctgatcacttagaagaagataaggtataacatccagatttgatctctctaagaatgtgctacctttgctattctagggaatattccttgatataaacattaagacctattaggtatatacatttcagcaaaagatgattgtaattacaaactgacattgatggtaaattactctatacccttaataaggtcacgggttgtgagtctgaaaccgtctctctggtggtttgggacatagccaccatggtatgtaaatctgatgctaaaaattggagcagctagccatgtgaagaatttggatactgtacataaaccacaatgaatcttattgtggaatagtaaagatttatcactgtataaatttctgtgcactgatttggtctgtttgtttttcttttgttagaaaaatcaagagaccatgaaattgtttgagaaataattctaagtctacgtgagcactgaggcttcaggaactgaaccatgctcttctgtgcccatcccttagctcattattctcagagggatgtggatttcactttcaaccactttagcttagatagtgataacaattacctaccatttattcagtactcactacgtactatactaaaaactatatacatctcatttactcatacagcgatatagcacattaaatatttttattcctgttccacatatgaggaaactgaggcttagaaagtttaagcaacttggttcaagtcaaacatctgtaatgtggcaaaaccacatttctaaaagtcatgttcctaatcagtgctcaatgcatccgttactgacctttgtattctttatctgtaattgtattagatacctcccttttatgtataatgtccaattttataaaatatatttttatttactcttgagtgagatcaaaccccaggggatagcatatttgttcagggccattttgttttaatgattttacaccataaaatttgtttagattcttagtcactggactttgtggaaagaatgtcataatttctgtgctgaatttcatttttaaaaagccctggaaatgctacttccatgatcccttcccttttaaagagagagaatttgccaatcatctttctcactcagtcccaacattggaatggtgtcattaggaaaggaaattttcagctttcacatcagtaaacacagtggagatgcaagaaatccatagttcttactcggaaaggactgcggaattttatgatattctgaattttatagcccaacatttttaaaggaaccaaaataaacaaacagttcctcagttgcattctttttcccctttggcactagtctatcttatctgaaattttttcagttcatctacttcatgataagcacttttcttctcctaggaagagctatcagaatctcttagtatcttttttttttttagatggagtcttgctctgtctcacccaggctggagtgcagtggcgcaatctcggctcattgcagcctccacctctcagcttcaagtgattctcctgtctcagcctcccaagtagctgggactacaggcgattgccaccgcacccagctaattttgtattttcagtagagactgggtttcaccatgttgaccaggctggtctagaactcccaacctcaggtgatctgcccgccttgggctcccaaagtgctgggattacaggagtgagtcactgcacccagcctcttagtaactttctatctaattcacactatcaattgcaacaactgaaatatcaacatacacgtatacgaactaaacaaatatgtacacacacacacacacagtgtttgctgtcctaaagctgctcccatgtttcaacatctctgaaattaaagagttattatcactatttaataacctttccaacatgcaaacacatgcttcatctggatcaatcacagataatttcataataaataatgtactaaatatcatcttccacactgatcaagagaccagcttgagagagtgtgtcatgtaacttttgacaaacccaataactttgaataataatttgcttattagctaagatttgggaagctgactgcttccagaagcatctggatgggataagaaatgagaacagctatactgttttcatatagctatactgaatttgaatttctttaaactcaatacactaaaaatatgacctcacaagcctgtaggtcacagataaaatctgaaattaggattgtagacatcctgattaaatgaagttggtctcattaaccaaaagtaatcatgcttgttcagtccctaagctgcttaatgcttctgcaaaatctgggaattaggcttgaggatatctcttctgtgctgcataagccctttcctttaaagcagttttctttgtgttctttttttcttttagcttgaaattggacccagcctccaaaagtcagtctttaccctgagcttagaaagggaagacatagagttagtagtaacaggaaacatattaaatgcaagggatagaattaaagaatgtgttaatgtggaaaaatgagaaaccttgctatataatccactatttctgtcagactccaagaatctaaaatggaaaattattcaagaaagataacaacataagagaatgcgctgatggaggaaggtctatattggaaaaacaaaaacaaatgccaatctttacagagggtaacctacaaggatatatcacaagcatctacaagtgatggattttgattcccaagtgtgtggagaaaactcctagggacaactttgcagtgaccagaaagccatgattgaataaggggacacatgttcctgggataggagtgatcttgtgtttattttggaaagaattatttaaagggaaaaataaacctgatgtattagtttgttttcacagtgctataaaggactacctgagactgggtaatttacaaacaaaagaggtttgattgactcagacagagtttcacaagactgggaagacctcaggaaactgacaaccatgacagaaggcaaaggggaaggaaggcgtgttttgcagggtggcacgatgggggaactaccaaacacttttaaaccatcagatcttgtgagcggtcactcactgtcatgagaatggcatgggggaaactgtcaccgtgatccaatcacctcccatcagatccctcccctgacatgtgaggacaagatttgggtggggagagagagccaaaccatatcacctgaaaatactgcataaataacatttagcaggctaagtgtaaagacctttatcacatcatttagaaattcaatgtttcaattgttaaagaaacatgtaaacatataatattgttaagttagccaactaatataagtgattcagttttccttgggggtagagaacctatacatgtaagatgggattgtcatttttgggaaaggtggaaaaagatggaaattacttttgagctttactttgaatcatttatctaaaaaaacaaaaacaaaaaaacaatgtagcctatacttttggagaggggtatatttaacagaaataagaatataaagaatatgtgaagaacataaagaatacttcggaatatgaatgtctctagctctttgtgaggagctctgacatctctcagacataactgaatgaaaaagcacaaatttctcggttgccgtaattgaagtgtagggtaagaggaaaatagcagcaagaacaaaactcacagatgcagacaaggacaaaagccatagacgcacgaaggaaaaacctgcccacagaaaaacggtgttctcggtttggtaaaagtgagagaacttgttctttgggaagccaggcagctcctagcaatcacaactttcttttgtacatactcagatcatttattttaaaacgaatcggtagccttttttgaaaatactcaaacttgtccttagttataagcttcctaatctgcgcttgcagagtccatgatgctcagttggctctccttgattatgtgcccatattcactctttcatatctattctttttgcatccgatgtatcagaaatctgtttattcctccagatttcttttgtaaagttctacctgaccaatcaacacatctagtccctccattttatggcattatcatgccataaaatgttatcttcgagtctagtccagcaaagtttttctgtaaaaaaatcagattgaatattttcagctttgcaggccatgcggtctctgtcacagctactcagctctgccgtcgcaggttgaaagcagtcatagactacacctaaacaaatgagcatggcttaaacacgctgcaaaaacagatgagagtatgtgggtagcagtttgtagatccctatttcagagagtcttctgtttttcttgagccagatctccttcgtgagcgcttttctttggaattatgctcctctttttctctatgaactttaaaaagcaaatttctttcttgaaatgtagataaagcctgggtttgtcctctaagtactgcatttgagaagcattgaacaatcacataaaccttaaaaggatttttattcatttaatctcatttattctgtttctaaaaggatattaaagaagatccagttagtaatcttcagtagcagttttcactgtttactcttctctcctgccttcacaagctacaatctattcatttttcctctgccaaaccctgtctcaaattcttgcccccagcaagctcggcccacaaggttttcattttttccacgccacctctatctcagagctctttgttttgtaggtagactaaagcatcattgctaaatttgttcatctgtcttctccctccatcattctcagatacagaaatcaaagaaccaggccaaggaggaagaatcattgaagggaagatcaaagcttgtgaacactcctgattttaaatgtttatcctgttaaatattatttttattatcgttattggcttaagtatatttcatttacttgtgaaaaaacttctcatacattgtacatagaatgttctcattagacaaggccttaaagaccatcctgtctccaataactttagatagtgcatctcttccattaaagaagactgaatcccagcactttgggaggctgaggcgggcagatcacctgaggtcaggagttcaagaccagcctggtcaacatggagaaaccccgtctctacgaaaaatacaaaattagccgggcgtggtggcacatgcctgtaatcccagctactcaggaggctgaggcaggataatcacttgaacccaggaggtgaaggttgcagtgagctgaaactatgccattgcactccagcctgggcaacaagagtgaaactccgtctcagaaaaaaaaaaaaaaaagaagaagactggaggctggcagggagcagatagggagatagggagagactctgctacacattcattatccagcatctcctaacagactcagccatctcacactaagagacagcaaacaaagagaaggctcccagcagccacacggcaatcacactggaattaccttctgtgcaccactggacagctggaggggtgaggccagagggcctattcgtaaacaagtctctcccagtcatgtccataaaggcatttgcctgtaggaggtgattggcttccgatgaagttgctataagaggacactgacagggaagatctttgcagagatttagaggcctgatctgcaatttaggcagagagtttttggtgcagtaggaagtttgaagaagtctttgcagcagtagttattggtttacagtggaccgtctttaccagaagtcgtgaatagattttctcagatgaattgcctgtcatcagctgaatgttgaaagaactagggctacttgtgtaacagagagaggaacaataggttgtgggccttccaataatagaataataaagtaggaaggatgcttagtgattttctagtattttctagtaatacaataaccttctattacacatgggggaaatgaaaactagagagagaaagggattcccccgtagttacctggctagttagggcagacagtgaaaaatatatggatctatcaggtgcttttttttttttctctgcattgcccgttgtgattggaaatattaactgggtggcaagacacaacaagaatccttgggttgctctgctgaagtgggcggcaggaaagtataatgatccatcttgctttggaggttcagctagaactttgtttcataaagggacttcttcaaaccacctgggaggctctcgcttgtttcacatgcccagacttacctccctgggcgtaaggagtatccagctgcccaggtgatttcgatttgcttatcctcgccacttgagactccttaagtctagacagcaatggttctgaacctcaccaagcattacaatctcttgtggaatttctagacttttaagtaatattccagctcagatttaagtctgggaaattctgatttaattgaactggggtagtgcccaggcatctgtattttaagcatcccagatattctaatgtgtagccagctttgagaaatacagggctaaaggaagcctgaaggtttaagcctggaattaaacaacagcaagaaagtagagaagtaggaaggatggattggagagatcttactgaggatgaattaggtcagaagaatgtcattgcttaagaggagagtaggaaaggagagacaagaaactggtgagccttcctaggagagtaatgaggttcaaacaggctcaggtggaagctctctgggggccagattaaacaaagacagcagggcttggaaagaattccgtgaagacgctgatctaccctctctagactgaagtatatgtggtttcctcagcataaaggaatgacagaggacaaataactcagcaggaagtgtttggaattggcaggtaaggaaaaataataagggagcagccttagaaggataagcgcgtctttagtgtcagcaatccttgggctgtagttcatctgataacaaggtcaaaagtctcctgtaaaatgcacgatagaatctttggaccagagggccttagagctcaggggaatcaaccccttcacttcacagaggaggaacttgaatcccaaacaggggcagggacttgcccaagatcccagctagtgaacgcattgggcctgtaaggcagggctctgaactctgttcactcctaggagagtccgcacagtgcacagtgtgatagttaagaactactccaggcgcagaaagctcatgtaccttccccaaagttatacacctagtaaacgtgggtgtgtataaaacaccaactttctcatgttttgttgggaggattaaatattcgtaaggcacttagatcaatgcccagcatgcagtatgtgttatattaattataattattacatcatactattttgttcaagtattaaagtgacatcacagtgaataagactgaaatcttgtctatttgaggacagatatttagagaaaatgcagacttattaaagtgctctgtctttaataaaactctaaacattagaatttaggtgaatactgaagccatgtgttttcaagtgcagtttgtttaaagtgcagatttgtaagcctcagtccagatcatttgaaacagaatctcttggaggaagggacaaggaactggcattttccagatgtactcccaagtatttctgttgaactgtaaagtgtgacacctaccgctccttactggggaagtggagtaacctaaggtaaagagtcaagacctttttttccttcagtgatatagttactactggattctccttctcaccattacagatatggaaattgaaggttagagaggttgcatagctcgcccaaagttattaaccttgtgaatgacagactagggactctgaagccatatccttaggaacccagagttaccattctcccggttaccatgtgagtttgagcatttttcttatctattaaatgggttcatgttggtatctaattcaagggatgttgtgaaaattaaacaatgcctgtcaggcatattgcagatactttgctcatggaaacaatcaaatgatagctatcgattctcttattgatgttagcattgttacttgtccttttcaaatattttattcaacaaacatttgtttgacaccccctctgtgccatatactgtgctaatctgtgaacccacaaaggccagaaactaaaatttggtttttctctccatgaaccaaccagtcaggtaggaactgtaaataaagatctgtaccatagacaaaatgtaattctgatcagagaggaacaaaatgtgccctgatgatttagtaaaaacaaaacttatctaccaggtatccttaagaaatacattattctgggtagctgagttttctataatagttgaacatatacttgttagatagcattttatgtttctttttgtattggaagatagacatttctgaatataatacatacttactttttaagccaaaaatagtgtggccacccctcaggattaccatggggaactttattttctgggttgtgttatcacaccaaaatcctcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaaatgtttatgaatgcccagttgttatattaggaattctgttatgtgtagggatgcgagtatataaatgtatcttcaaggttctatagtgttaaagtttccctaattgttcattacttttttgtggtatgtaatttatattatatttaattcttaataatgatttattttcataggttattggggaacaggtagtgtttggttacataagtaagttttttagaggtgatttgtgagattctgctgcgctcatcccccaagtagtatacactgaacccgatttgtagtcttttatccctcaccctcttcccaccctttccccggctccccaaagtccattgtgtcattcttctgcctttgcatccgcatggcttagctcccacttatgagtgagaacatatgctgtttgtttttccattcctgggttacttcacttagaatgacattctctaataatttctttgcatctctacagtggagctggggcagtaactaacagagatgttttgcaagagtggaagacaaatacaattaaatgcacctgggattcaaatcccctccatctcctctgttcacattctgtattcacaagcattatggttatggaacaccttcgtgctgagcactgttccaggccttgggggatgcatccgggaacggggcaatcagctcatgttaagcttacattcttcaggcagtggggtggatgggggtacgggagagactaacaatcaacatgtaaatatataacacagtctcggataattgatatttaaaaaatatggggcaaggataaaccagcaatcgatttctttttctcccttacttctcaccatgatttgcacaaatgtgttgcttaataaataaatccttatgatttgtatcagactttactgctagatactattttttcaaggtgttatacctcattgtgaaaaaaagtctaaaggttgtgatttatataaaccacatttcctgtctttagtcaattttgtgtatttaatttactaaaaatgaaatttaccaggacaaataattaaaacagacatagtatatataattattactttgaatgttaaggaattaggtaaacatggtaatgtgaagtttatacacaagacagaccctgtaaagtccactttcaaatagggttaaagcataatcgacagaaaatttaaaaaataaaacataggacttatcgggactaggaatataaatatgtaaaaattaatatataaaaggaaattgttcctgaatggcaagatgactaattttaaagtttaaaacttctatttttatgccaccaaaacttaataatacgtatcccgttgtgataaagtacattttaaagactctgatttaagctattttactaccaagagttggaacaaataaagtcaggacaggtgaaaatatatatttccttcactttgaagggaaccacacgagggaatttagcaatatgggggcagatggtgggggaggaaatcctgcttcggaatgtgagtgtgtgaattctcagctttctgccatggttctttgttactactgattcttcagtgcaacacatacatagccaatacaaatgtaaaattattttgcaggccgggtgtggtggctcacacctgtaatcccagcacttggagaggctgaggtgggcagatcatgagatcaggagctggagatcaacctgaccaacatggtgaaaccccatctctactaaaaaatacaaaaatcagctgggcgtgctggcacgcacctgtaatcccagctacttgagaggctggggcaggagaattgcttgaacccaagagccggaggttgcagtgagccgagatcatgccattgcactccagcctaggcaacagagcgagagtttattttgggtggggcgggggggaatattttgtcatcattgctagtgaatgtttggaataaaacatgtacagattaggcaaatttatatttaagaaaaatccataaacacgtatcttgttcctccatatgaacgtcactcggtcttactctctgggtgggccgatcgtcttatcactgagtagcggcagtccaaagaatgaggctcaacaccttggtctgctgctattgatggaatatgtgatcttgacaagtattttaatgttattcagctgtagaatattgacaataatattcattctatgacatcgaaccatatgaacttggtagcattccaccattaacctacaaaacaggaagttcctaaggttcaatatgatacataattcatcatatgactatcaaatggagtatgtgtgaaagtgattttgtactgaagtattccaggtttgaatcattatgtagcaatagactattgaatcatatctttgtgatatatcatgctttatgaattgggtcaccatcccatatttaaagtgctaaaatattaatgaggatggtaagaaaaatacatgaacagttacaataaaaaaaatcaggtgtgaaccgaggatcctgcctcattggtccagggtcacttcttatttccaggtccacatctgattgcttgtaattccctgggatgacaaatattagcccagtgatctcccacctttattttgtactccacatataatggtccaagagaaagtttctacaacttcacaagtattaactcaaactgcaatttattttaaaatctttaaaggtcttttatgtacatcaggtgttagcaaactttttctacacagggccagaaaatatttttgactttgcaggtcacatggttgctattgcaactcctgaattctgctgttgtagctcaaaagcagccatataccaacacctaaataaatatggcagtgtccttaaagactttacctagaaaaacaggtggtgggatagattttgcctgtgagtagtagtttgtcaacacctaatccagatgaaagattatggtgcagattcttcactaagctttcagctatgggacttggattaggaaagtggattaaggtctataaaatctttgaaaatcaaacccaatcacttacatgtatgtcagtatgtatacttcatttttacttttttttgtttattgtgtaagattgttcagaactgtcatcagattcccataatagattctataattgagaaaaggttgaaggccactgcaattggattattttctgcatgaatcagaccagtatctggaggttttagggcagtaaacctttcctcaatttttaaatcactcattcagcaatctgagttgtctgacaaagagtgagcagccttatgtggtacagatgctcggctgaggttgcaagatcactgttaataagttaagagtttggactagatgacttaaggtacttccaaccattaggccttataattttttccaagaagttctactttttctttttccatattttcttttcttttttgtctaaattcaatttatcacattctttaaacctaagaaacctcctctacaggtttctatttccccatagtccttcctgagctccattttcatgtatctgggtcgtggatgttacatgcatttttcttcaagtgttcacagttgtgtaaaaccctaatgtattccaaacctgatgtcatggtgattacacttattcaaatgtctcctaaattctaatttgggggcagtttgtcaaaaagtaccctgtttgtaagcatgcatgttactgtgtttgcatgctataatgctaaaatgacattttaaacaagatactcaagtattccttatctttgtcttctaccaaatgccagattctagactgaaatggctcggaatattaactgatgaatttagtatagtagagcgaagtttgagaacatgttttatgtttgtggagttagtacagtttgcaaaagtgttgactgtacactttatgtctgaagagctttgcctaaggatccaggatggctaggctccagaactagatacttgtggacttcctgtgggatatgagtaaaatccctatgagtttcgtttataaaaaaaaaaaaaaggagtagagatgatgagaaataaagccctttctagtttttcccttctacggatctgtccaaaaaataaaaaacaaggaaaataatgttttttaagtgtcagtatcttattagttgaggcaacagacctacatacacaaaatggaaatgccatttcaatgtgggtaaatttgtgggtaaattatgatagaatgaactaaggacaagaatacttaaagcatgccaggttgagggtgtgaacccaaacaagatatataaatattgtatcctttctaggtgagctcagtgttggcaaatgcaaagaatatgacttgggggaagatggtggattatgtaaaaggtcaatctgtaagggctcaaggatgaaaacaacctgtaggatacagctgatgtaatagtttgctttcatgctgctatgaagagatacctgagactgggtaatttataaagacaagagatttaatacactcacagttgtgcatggctgggggaggcctcaggaaacttacaaaatggcagaaggcacctcttcacagggtggcagaagacagaatgagtggaagcagggaaatgccagatacttataaaaccatcagatctcatgagactcacgcattttcaggagaacagcacaggtggcggagaacctcccccatgatccaattacttcctcctggtcctgcccttgacacatggggattattacaattcaaggtgagatttgtgtggggatacagagccaaaccatatcagctagctaaacaatttgtaaggagggtttgctcaaaagaatgagagacaaaggtgattagatttttgtcaaggatgcagggttaatgactgtaaattctctgtcacaaaaggagtaacctaatgaaaattctgcttttgaaggctgatcattacatagtcctttaagttagaaaatgctgactaatgaaaaaggcaagaggtttagtgggatggggagcatgagtgaagggcattgtattcagagaaatcattacctttaaggaagaaattggttaggataaagaatgggccacaaaacataagacgtcagagaatttcataattgagagagaaaaaggacactccctcagaattaatgactgccaagtttgggctaaatatgtagaactttaatgggagaaattcgcggttggactgcacagtaaaaggtcatggaagaagcaagccgtgaagctgtgggcaatcagatcttaagacaggtcatggtcagtcaggagagaaaagatttctgaagatgaaaagaagccagtaactaggagaaatgagtgttgaaatatgcaaaatagagttttttaagaatattggttcagtaatatataaaaataaattccttgataagaatttttgttcaaattgtggcaaattgagatattaaggcatacacaatgctctaaatgaattttattttttgaagttgtgttttctgagagttaagctgacatggatttgagttgggatgagtagagagataaggaacttcatatttttccatttgaggttgaaaaggaaagatttccatctaaggaaaaaaaaagatgctaatgggcttaatttagagtttgcaagtgagttttggaggcaaatttatctcaagtttatgaataaatttagtcctccagggtccttgggcactgttaggtacaataaaaaggcaatacactaaaaggcatcaaggtattctttggcatcctcaaaactaagtatgatgattaatgatggaatagttatagtaatggcagggtaaattctaagtattggaatgttttctgaactaaaaatgtaaaaggaattgtgtggtcaggaatgcttctgaagctaacccgaagactcattttgcaaaagatctagggaggtggataatgaaggcttaagcaataattggatggattgataaattggatggatggataggtggaagaagtcatgtttagagttttgaatcacttttatctaagggttgaggatacttccagagtctttgagggctcaagtttccttgagcaatagtaatcctaactgtcttttcttatattacctttgagagtcagttccttctggcaacattgagaatctgcagaagggcaagcattctgtaaatatcattcacctatcattacccattttcttatgccaattttctggtcatatcgtggaaaaaggctgactattttgatgagacagaattagtaaaatatttagttgtttcatagaaaaaagaaatattcctcttaactgtgaaaacttcatattgcccaagttttgtggtgaatgaaaataaggagccatatatgtaatttagcaaagcacgaatttgaaacaatataaatttaaatctcagatttattaccaacacctgagtaacaacttccctatccttgctgaacgtaaagatcatcatgtataaatgctgacattttgtgaggtcctcaaaggtttatacctatttgtgatcccatcctcccaatgaggatatcccagtttgatcacagttggtgaggaggaggtccctccaggcctgctctattggagatttctcctgcaacattctctcttacaactgctgacaccctgtcaaggaggcctttgagccaggagatctagtagcatcaatgagcttctggtctgcatcactactaagtgctattttattttgttaaatgagtttatattgatgtttctatacaatcaagtctatttgtagttttatagctttaagtttgcatgctccaatggggagtaagtgtggaaactgttaaaagaagtcaagggttagacaattcatgacaagaatttgtttctgatgcacaattttttttcttattggactatagataaagacttagcaccaggcgctctggctcacgcctgtaatcccagcgctctgggaagctgaggcaggtggaccacctgaggtcaggagttttgagaccagcctggccaacatggtgaaaccccatctctacgaaaaatacaaaaattagccgagcacagtggtgcatgcctgtaatcccagctgctcaggaggctgaggcaggagaatcgcttgaacccaggaggcagaggttgcagtgaaccaagatggtgccacaagactccaggctgagcaagagagaaagccttcatctcaaaaaaaagaaaaaaaaagaacacttaggttttcatgaaatatatctggtgtgaaccagtgaaccagttcttcttagatttcagcttttctgtctgttaaattagaaaaactaagctagacgacctctcaggtctattatttctaaaacccatctatgcagctaaggttgtttggaatctgaaattttagagatgtggagattttcaagcacactgacagaaaataaaggtgcaacagactaaaatgacaacatttagggaagaacaggcaaagcaagagggagtgcagaccattggcagaaacctcttgatgttttcagttcacttctgtaaagttctttcttcctgaattaatgcagagtgtaagacagttaatccaagaaaaacaacttgaaaagaaaaaaaaaattgacttcgggctttctatctttaggtgtgactgacttgacaaaaacctttgaacagaatgattgttctatgagtaaattgatactgagagtcacccaaaggtaaagacttggaagataggtaggatttgcttcactcttcttgccctatggcaccagctaatctttttcctctttttctctcaataatgtttcaacatatttatctataaaatggaaattaatactgagcatgaaaagaaaaggccatgaaaatcccctaacatagaccgttaatttttctttcctttttatttttaagaaacagacactttctttaactggacttttgttcagaaccctaatataccttagacaagaaaaagctgaacttcatggtgttaaggaggtgtgtatcaagtcccaccgacaatggctgtttctttacctctggtgaacacactgagtcaccaggaaactgaggatatctggaaacacaagctgaaaatgactgatctattccaactcccctccaccacccctgtcttttgtaataaagcccccttgaagccctgagaggagtaaagttgcctcatttaatgtagccagtctaagacaaaaatgatctagaagaaaatgagtggtgatgagggtattgttttgacccaaggttacagatggaagggagggataggtttcatataattactttatttttatgtgacactttaaaaactcaaacagaccattcaaacacactatctaatcagtttaattcagcaagtatgtcctggatgcaaacgatgtagcgcgttttgtggtagaaccaatgcattgactaccaggcgctgtatgacaattatgttgcacatttaaagaaagcctctcaaccaccttctgagggaagcatagttgaagaaactaaggttcaaaggcattgagtaacttggccatggcctcaaagcatgtcattagcagaactgagattgaacctaggtcagccccattccaaaacttgcaattcttcaactctatcctcaaggagctgtaaaaccacaagaaatacagagctgagagagagatgtttcacccacaaattacctaaaatcctctgcagcaggttaattgttgaacaagcaaagtaggacagagtagcattgatgagatgaaataaaagaacaaaattcaaaggagaaaaattatacttaaattaggaactaggaagtactaagtaaggaagagagcactgagggttgggtaggcatgggaaaggcagtggggtggagatcctggtctccatgctgtcacgtgcaaggaagctgaagtttgaggagtctggaggcttgttcaagttttcacagctgattatggtgacattagaaatacagggaaatgacttttaggagtaagaacctagggataaaagcaaaacaaaaaaaataacaaagtaattacagacaggaaccagaacttactatgtggaaataagggaaattatagaaatagatgatgagtatggaaccagtgctgtttttctctcttctgccttagagatgatgtcttccttctatgtaacactcttttctgaatctgccttggtctttattattgaagatgttggtcacattatctatcagtctctttagaaactaaatctacatttctgccaacttaaaaactcatactttttcgaatctcacacactaatatcattattgttgagagcctatttgtgtggtgatgtttaccttctagtgctcacctggctttcgagctatcaggcatcccgtttggatctttggatgttggggatgtccttatgggtccgtgtatatgaccactcatatgggagtttatctgcattttggttttggaataattcatgcctttgttcatttctgtttttgacatttgctatgattgcatttacttttattttttcctatatttcagttttatctgaagacaaattttagtgtaaatcaaacatattcaaaagtgtcatcttgagagtatttataagtttcacttcaacgttaaatctatcaacttttacttcttctctacttactatttggcagtaaataaaccaagtcagccacaatctcaaaagagaagtgaagaaaattaatatacccttttaatttaaagatacaggattatcagatggtcttctaattatagggacctccttaattctcataccccactctcccatttctaccaatttaactttgttaattccttccctatataactctgttttgacctcatagagacatagttttcttcctttctttcttttctttctttttctttctctctttctttttctttcttttctttctttctctctttctttactttctctttctttctctctctctctttctctctttccctccctccctccctccgtccctccctccctccctcccttctttttttttttttttttgagacagaatttcactcttgtcgcccaggctggcatgcagtggctcaatcttggcacactgccacctctgcctcttgggttcaagcgattctcctgcctcagcctctcgaatagctgggattacaggcaccggccgccaagcccagctaatttttgtatttttggaagagacagggtttccttgccctggaccctcttcctgccctctccagtctgaatccaaagctagtctttacaattcccttaattctctgatgtaacctattcagtgaaacaacagtagtattgtttttatctattttgtttgttcccttccccagtggtataagctggagataatcacttaactgtgtaggttgggagatgacaaattcatgttttctaaactgattcacatttctaaaccctcacccttttttcccagatagtcacttaatgtctgacccactcaattttcagcagatggccttgtcttcctcctgcttcatcaagaaaatcgaagtcatcagccttgacttctatttatcttctatgaaaacctttatatctgtacttaattttgccatctacttcatcctagagtgagggattaaggggttttagttcaagacagtcctctctacctatgccttgaccttttccaacctgcctattccaggatttcttaccatgccattccctttctttccaggatcttgaaattttctctctccacactagctccttcctctttaggcataattcaggttcttctaatccaattgtatccaaaaaaacatttcttttgcacacccccatttactcctcaaaacactaaaatattttgagggtgtcattaatctacagaaggttctaatgtcaaggttgccaatgacctccttatgtcaaatctagtaggtatttttgaggtcttatcttcctagatcccattgccattgagtactgttgattacttttcattttgtttttaccttggcttctaaaataccataaacttctcagggtctgttagttctcaggttttctaagtggagccccacgtgccttttctcattgcacctattctgcacaggtcgttttatccacgctcacagattcatttttcccctatgaggaagatttctgtttctaaacttttggtctatttttcttcctagagtttaaggcttatttaagttggtttcacttttttcatatccctaggtacttaaaactcagcatgctaaaatgcagtttatcatctctctttcttcaagccagatcctccaactatacttactgatgtagttagtggaatcatcaaccacacggttcaatcaagctggaaacttaaagtcatctttcactcttcattctcccttcattagtaacacaaccaatatctgatttagcctttttactaataattgactttgtccctatcatctccattcccattgattttgcccttttgttgtcttaccttaactgatgcaggaacattctaaatagccgctttacccataaactgacatgctgtaaattcttccatcacacaacttccagatttaccaatataaagcatagtctgactgtgtctgtctcatgaatactgactgtggtgatagatacactactccacacgtgtgataaaattgtataaaatgaaatacacacacatatatatatatacccacattcgaataagtacaatagaactgaggatttatgggtcaggtcactggattttatcaatgtcactatcccagttttgatattatatggtagttttacaagatgttgctatcaagggaactgggtaaagggtacatgggatctctctgtattattcattacaactgcatgtaaatctacaatttcctcaatttaaaatttatttaaaatattttgagatatatattatttaaaatatacatatcatttatgaatattttaaatgatatatatttatatcatttaaatatataaatatatctatattatttaatatattttgatatatgtaaatatacacacacactctttctctgtctctctcaccataagtacagtacataggctttttaaaaacatagcatataagtttcttcttacctctctggcttaatctcccagcattctctgccccaaatttttcaaaatattaacacagagatgcttgtgattttctcacacataccaggctattttccattatagtgttttgtttatgctgttgtcatagagtgcccactgtgtaccattagctcttacctgaccttcctaattttcatcagcaaaggctctttccttgattcttcaaataaaattacattgttcatctttgtgttttcgtagtgctgtctatactgctaacacatttactataggtttgttttcctgtctttccttctataccatcaattcctagaagatgagacagtattatacactttttatttccagtttccattatgcttcctggcaaataagtcctctatgcatgtttaacttgagcaaatgaatgtgctattgcaggtagcttggaaatcagcattcataaatctaatagtattatcttctactgtattactagaccagaacacatatttgaaattttaagaagatgattgactatcctcatacagtatttttctaattctttataacaggaacagtaacacttaagaacttaactaattttatcctgggataaaattagtctactgattatcacaacaaatcacatattaagatgatctgcccggataatatttagacttggagaacgcatcatctgagaaagctgatgttttcctccaaatatataggaataaatgtttggaaaaaataagtaaagcaaacttcagggctcagcagcaaaatgaagcaaacagaaataggattcatttgcaaagtgttcagatgtttgcttattattaagtctaacatgcaattctacactttaattaagaaccacccacacatcaaggtaagcaactggcaataaaaaattaaaaaatattaggtccacaggtttgagtttattgtccctgagtgtgattctaagattgcggttatgggagggatgactaatctgaggaaaaaatttaaattttctgagttcatttctgtttcctggttctatttcttacatgctggtggcagaatgggcagataatcagttgagactattataaaatgggtttaatgataggtcaggcttgctatcaaatttaatgaggaaatgtttattttcttttcaaaatctacagaacacagatgtcggatagtggaggtatagagcataataatattattagttaggaaaggagagctttgatagaagacaagattgtctagcattggaggtctgcctcactttgtggcaaaattggattcattacactacctgaagaaatgccaattgtgcaacttgtaacatgtgctacatatatacctgcatggttttatagattcacttgatgttttcatgatagagtatgctttaatttaaatattcagtgtcataaatacagaaagtataatactagtttcatttttgtccttttaagtttcgtagaaaccccagctcatttctcttggaaagaaagttattaccgatccaccatgtcccagagcacacagacaaatgaattcctcagtccagaggttttccagcatatctgggattttctggaacagtaagtataaaacaagcaagaaatgttttgcttgagctaaataggtaaatgtgggtggtcaaaatattgcttactagggcatgttttttctagaatcagtagaagttatttaggaaaagttaatgactccaatgccatctctttgttcaaattcagtggtgatttttttccatttctaacaccaaaagatccttgctaatccaaggtgatgtaattttggagggcctaaggcctcctgcaccaaattcacttccccaatgtttctctgatactcagaatccattcctttggcttgaagacttatctacttttataatgcaggtactcactgagaagataaaacactaaattttgttgtttatttataccttgctgtgaaacgtattattatttctttattaaaacaggtttggataagtgagtaaattaagaaaaggtgaaaagagaatttcagcacactggagacccttaggaatcgagtataaaatactctatcacagatacatccgttatttcctgcatcctacccagtaattatctgaggagggcagaggtcatgatcctcatttaacaagtgggggttggatttgaactgcttgaaattacacatttgataagtgattgagccaggactcaaacctagagtttctaactccaagaaaccaatgagccttgctgactttgaagcagaaaatgcttgttgttaacaacagcatgagtatattttagtccctttccatgcctaactcacttttttctttcctatgtgttaggcctatatgttcagttcagcccattgacttgaactttgtggatgaaccatcagaagatggtgcgacaaacaagattgagattagcatggactgtatccgcatgcaggactcggacctgagtgaccccatgtgggtgagtggcacaggctttctcttcagtctttgggccatgctatctatagctctgttaaacctgtcttttcagtcatgtgtgaaaaggcaggtggctctgaatggccaaggcctttgggaagagagtctatgttgttagctgagagaagatttggtgtggattatggattctgggtctgccgcaaatatctataatatatgtgtttccatccgtgtggggagggagattctttacatcttttatcttgattgttcctcatgtcaaccccaatttagaaaagatggtaccagctcaaggctttctagctggtagggacagcaaaagaatcagaaatttattttatttatatatttatttatttgacagaatcttactctgtcacccaggctggagtgcagtggcaggatctcagctcattgcaacctctgcttccctgattcaagtgattttgctgactcagtctcccaattagctgggattacagacatgcaccaccacacctggctaatttttgtatttttaggagaggcagggtttcgccatgttggccaagctggtctcgaactcttgccttcctgtgatctgcccacctcagcctcccaaagtgctgggattacaggtgtgagccactgtggctggcaaagaatcagatttttagatctgaatcctatccagggcacttcctactatgacaaacaacttctctatccttctttaatgcaggaggaatttatgcacatgaattctatgtgcatatgcaggtttaagtacctggtaacagaataagagggaggaaaaaaactaatacatgaaacaggcttttcttggctataccactgagtcactcgtgatcttaggccccagtttctcatttataaagtggtgagatcataggtgttacatacttcccaggtaagctaaggagtttaatgggttaatgatattaaaacaccttcctgagatgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggagagagctaaaagacaaaatgaaaacaaatgaggttttgccagtgaggtaaatgaaatagggcacttggaggcatctgtattgaaaggaaaataaaggtagagtgagaaagaatttaactgaataaacttgcctatctgtggctgctctgtctgtggaaaaaaaaaaaaaacccctgagatattcctaacaacgtagaaatcctggggcttctcttgccttatgactattccaacatttttatattctcatatatgtccatgtggaaggccacaaaaatggagttggataacaagaatggaaaaatggtaaacttacccaggatgttaatagctagtgttctggtttagaaagtagggagtaggatccttttagattcttagtctttctgaactgctacaacaacgggtgtgagagtctttttcccattacttggtagcatattttcttttctcttttccacgtataggttaatagctaaataattcctaaagtctgcaaataaactactttcctcttaaatataatattcattaagtaaggattgtagccaagcattctctcaccatacaagaaatatgaacttatagacatgaaaaaacatgtcatattcttagggatagaaatctcgaaattgagaaatttaacccagttttactgattttttgatacaacctaaacatttataactagccattaaatggaatcaccatgttttgctctgattgttagcaaaggatatttgaattgcagagaatgtgtgccttcttaatttgaattgttttagtatcaatgaaaaatgaactccattgggttagtaagtaaaggtgagtggaggctctccaaaaaatttgacattttagtctgttttcaaggaacttctaggttcttgattctgttgtcaagtatattactttaggccaggtgcattggctcaggcctgtaatctcagcactttgggaggccgaggtgtgtggatcacctgaggtcaggagttcaagaccagcccggccaacatggtggatacccgtctctactaaaaatacaaaaattagctgagcatggtggcgggtgcctgtagtcccagctactcaggaggctgaggcaggagaatcgcttgagcctgggaggtggaggttgcagtgagctaagattgtgccattgtactccagcctgggcaacaagagcaaaactccatcccaaaaaaaaaaaaaaaaaaaaaaaaaaagttactttatatcccatctttgtattattcatagactgtgtaagcatgcctgtcatgtcttcatgaggtagataataatattaacacttaaaagttctcccagattgattgatgctaactacataactcttactttcgcaatttttttttttttattccttgtaaactttgaacccttttaacctgtattggatttttccctggggagttggtggtaattatttaaaactattcctttttgtaaatacttgttgaatcatcccagatatatgtgaagaggcttcagctctaagtatcaaaagaccaatatctatgtagcttatttgtgtctggaaaggcttaggcaacagcccttagcgtagtgccctacatcttatataatccaagattcatatatatttcaagcacatacagtaggtctagccataacaattttgcacctatgatctttgtgacacagaccatgatatccttgagaagacgataacacagcagaaaaggcaaatgtgtgtaaaattatctatgaaaagtagttagatatatgtgtttatgtgtttttataaagcacagaaaaaggaatgatttagtgtgcctgagattggcaacacattgcagagaaggtaatttttttatttaggccttaaaatatgagtcaaattgatcaaaacagggaaaggaaaaataatcaggtttgggtaactgttataaaaataattgattataaaaacataatgtgatgctcataagtattaaaagactaaaaaaattgactaaagtttatattaaaaagacataaactttaaaaattataattcataacaaaagcttaataaccccaataaactaaatattcaaaatttaataagagagataaatttccccaattggaaaaagatataggtaattcacaaatgattaatgtacaaatgtttaacagattcaaagtgttcaaattctccactaataaaaaattagggaattgaaataatgagattaattatatctttctgatcagcaaaaaatttaatgataataaccaatgctagtgagattgttgagaaacaggcaatcttttcatttcttatgagagtagaaatcgaaataatacattggaaggcaatttgtccattctaatttatttaattttaaagacactttccctttggcctgtaagttccagttttagatattccacaaaactattcaaatataaataagtacctacaaacacaaacacacacacacacacacaaacatacacacacacagaaatgaaggcttcattgcagcattgtttataataactaaaatggtaagtccaggtaaaattttatagcctttaaagttttagaaaggagtcttcaaaatggttgactggattcatcataggcacctactccatggagaggagccaaaatggcaagtagattgtcacattttgaatagattatctaagggaaaaaaccggaattcaacagagaagtgacaggaagcatcaaaaacaagaaacggatgtgagggatcagctggtagcctggagaggctccctaatgttgggcaagggtaagtgggagacccctcacggtccacattaccaccacagactcctattgtcctagccaaaggagagccctttgaccatcatgggccctgagactaacataaggagctgaagactactcaacagtattgctccagagagggagctcatgctgaatcccacaaacctctaagtcctaagcagctgcagcatgacaccatttcaaaaacccagcctccaccagactgcatcctaccctggtgcccaacggcccatgcatctccacatccttgaagcaccattgacattccctgcctggaatggctgccaccaaggctgaggcaagagccacagtcagtgaccccttcaccccccaacagagtagcagtgacacattttcatgtgcctcaggacaaatctcactgcccgcagctgctgtcactgtggtggggctgagatgcaagcaaagaacacactctcaaagcagctatttccttcccagtagaagagctatggtgtagctgctgtggcccttacctgaacattgttctggcctcccgggggatcaccctgcttctgcttaccacaaccagtgcccgcacacaccagcagggggcctaaggacaggttcgcccaacttggccctacccctcagtgcccaggaacaccatccaggggcctgaaaattgcccatttcagtgtgccaccattggcagctgagcattccttctggtcacgcccacccaaccactgctgctaccaccataactgccaccaacttacacacatcacctgcaggcctggggtctggcccacccaggctgtcacagctactgtcaataccagtgtggaacatttgggtcccagagggttgtcttgccactgctaatgccatcacccatgacatgccagctgcccaggggctcaagaacctgcctacccacctacctttccactgccattccaaccacctgagcaagccacctgggactcccaaaattggcttgcctggactcactaacaatggtaccagtgtacactgccctagggtccaaggacaggcacactcagcccactactgctactgcaggagtccaaaggctggcctaccgggtgtctaaaacccagcaaaattcactacagcctccactaacaaccacaccctaagccacaagggaaatcatagacaccgctgatgctgtttacaactgaagatattatacagaggctacaggacagtatatactgagaataaaagccaaaattgcctacccatctaatttcatagataatgtcttcaggaaattgtcctcttctatgaaagcaaattcaaaaaaaattgtaagaaatgactattctaccagatgtgcagatatcaatataaagacacaggaagcatgaaaaagcaggaaaatatgacaccatcaaaggaacacaataattctccagcaatagatcccagtaaaaattattaaattcttaaattcaaaatattgatactgagaagctcagtgagatataggagaataccaaaaagcaatagaagtcagaaagataattcaggatataaatgagacatttaccaaagagatagatatcattaatagaaccaaacaggctgggcatggtggctcatgcctgtaatcccagaacttcgggaggctgaggcgggcagatcacaaggtcaacagattgagaccatcctgatcaacatagtgaaaccccatctctcctaaaaatacaaaaattagctgggcgtgatggcgcatgcctgtaatcccagctactcgggaggctgagataggagaatcgcttgaacccaggaggcggaggttgcagtgagccaagattgcaccattgcactccagcctgggtgacaagagcagaaactccatctcaaaaaaaaaaaaaaaaaaaaaaaaagccaaacagaaattctgaaactgaagaatttactaagtgaaatccaaaatacatttgaaagcttcagcaatagactagatcaagcagaagaaaggatctcagaaattgaagacaggtttttaaaaaataacacagttagataaaaatgaaaacagaagaattaaaaaaaatcaaagcatacataacatataagatacctcaaagggacaaaacattagaatttttggtgtttccaaatcaaataaaaggattagaaaatctatttaacaaaataattcataaaaatatcccaagtctagcaagatatttatatatccagatatgagtttcggaactctccaaatagacacagttcagaaaggttttctctacagcacattacagtcaaactttcaaaaggcaaagaattctaaaagcagcaaaaataaataaataaataaaagttttgtcacttataaagagacccccatcagacaaagagtgggttactcagcagaaacccacaggccaggagtaaatagaatgatatattctaagtgctgaaagaaaaaaaaaatgtcagtcaaggatattatactcagcaaagttatccttcattaatgaagaagatataatatttccctataagccaaaggtgagagaatttattgctactagatgggcctacaagaaatgcttaagagaatcctataccccagaagcaaaggaaggatatttaccgtcaagaaaacacataaaaatataaacaacactgatacaacaaacataaaaacaaagaaaagtctcaaatgttaacactacagaaaacaaccaaatcacaattatgaaaaaaataaaaaagaataatcaaagcacatataacatataagataacataaagtgaccaactgttaaataagggaacaaagactacacaaaagtaccagcaattaataaaatggcaggtgtaagtcctcatatattaataacaaccttcaatctaaatgtaatatactttccactcaaaagacatagactgaatagatttttaaaaagacccaactataatatctattaatatataaatatatatttcaatatattttatatacacacacacacacatatgaaactcatctcgcctggaaagacatacatagattgaaagatggaagaaaaaatggaagaaaaggaatgaaaaaaggcatttcatgcatatggaaaccaaacactagcaggactagctatacttccgtcagataaaacagattttaagggaaaaaaaaaaagaaacaaaggtcattatgtaataataaagtaatcaatttagcaaggggatataacaattctaaatatttatgtactcaacagcagagcacccatgtatataaagcatatattattagatctaaagggagagaaagacttcagtacagtaatagttgggaacttcaacactgcactcacagcattagagagatcatctagaaagttaagaaagaaacactggatttgaactgcacattagaccaaattgacctaatggacatttacagaacatgttatccaacagctacggaatacagattcttcttatcagcacaaggaacattcttaaggatagatcatatattaggacacaaaataagtctcaaaaattttttaaaaattgaaattacatcaagtttcttcatagacaacaatgggataaaactagaaaaacaatagcaagaggaactttgtaaattgtacagatatatgcaaataacatgtttctgaccattgggtcaagaaagaggaaattaaaaaatttcttgaaacaaatgaaaattgaaacacaatgtatcaaaaatctatgggatacaacaaaagcagtgttaacagggaagtttatagtaataaatgcctacaccaataaggtaaaaagatttcacataaacaatccaacaatgcaccttaaggaaatggaaacacaagaacaaaccagatagaaaattagcagaaggaaagaatagtaaaaatcagagcagaactaaacaaaatatagactaaaaaaattgcaaaggaccagtaaaaccaaaagttggctttttgaaaagatacaccaaattgataaaccacttactagactaacccagataaaaatagagaagactcaaacaaaatcagaaatgaaaaatatatcaccgacaaaagatcatcagagattattatgaacaactgtatactaacaagctggaaaactgacaagaaattgacacgttcctggacatattgcaacctactaaggttgaataaggaataaatagaagacctgaacagaccaatatagaaacatgcctctacataatgatggctatatatgactaatccacagctaacatcacactgaatggggagaagctaaaagcctttcctctaagaactggaacaagaaaaggccacttctagttctcctatttaacatcgtactgaaaagtcctagtcagagtaatcaagcaagagaaagaaataaaaggcatgcagactggaaaagaggaagtcaaattgtttgtctttgctgatgatgtatctaagaaaacctacgctcttcctgaaaactcttagatctgataaatgaattcaatatagttgcaggatacaaaaatcaaaatacaaaaatcagtagcatttctatacatcagtaacaaactagctgagaaagaaatcaagaaggcaatttcatttacaatggccacaaaagtaaaacacctgggagtaaatttaaccaagaaggcaaaatatctctacaaggaaaactacaaaaaaaaaaaaaaaaaaaaaaaaaggcgggggacagaaaaaaaatgaaagacattctatgctcatggattggaagaatgaaaattgttaaaatgaccatgctgcccaaagcaatctatagattcaaagcaattcctatcaaagtgccaatattatttttcacagaaaaaaaaaatcctaaaaatcatatggaataaaaaagagcccaaatatccaaagcattctagagcaaaaagagcaaaactggaggcatctcactacctggctttaaaatatgttagaagcctaaagtaaccaacagagcatgatattggtataaaaacagatacataggtcaatgagacataataggaaatccaaaattaaattcaatatttccagctaactgattttcaacaagggcacaaataacatacattggggaaaggacacactcttcaataagtggtactgggaaaattggatattcatatgcagaagaatgaaactagatccccaactctcatcacatacaaaaatcaacacagataaaatacttaaatgtaaggccttaaaactataaactactagaagaaaacatagaacacttcagaacattggtctaggcagagatttttatggctaagcccacaaaagaacagacaaaaaaaaatagacaaatgggactatttaaactaaaaatggggctattaaactaaaaagcttctgcacagcaaagaaagcaattaatagaacaaagaaacacctgttgaatggaagaaaatatttgaaattattcatccaacatgggactaatatccagaatatatgaggaactcaagtcaacagtaaaaaaataaataatcccgtaaaaatgagattactgacatcaaaagatatgaaaagacatttttcaaaaaaagatgtaaaaatggccaataactatatgaaaatgtcagcatcactaatcatcaggtaaatgcaaatcaaaaccaaaatgagatatcatcttatgccagttagtttatttttcaaatgacaaaaaataacagatgttattgaggatgcagagaaaaaggaactcgtattcactgttggtaggaatgtcaattaatacaaccactacagaaaatagtatggagattcctcaaaaaactaaaaactactgtaaaatccagaaatcccactaccaaatatttatccaaaggaaaaaaatcagtatatcaaaaaggatacatgcacttgcatgtttattgcaatattattcacctatgtgtccatcaattaataaagaaataaaatttggtgtatatatacacaatggaatactattcagctataaaaaaggaatgaaggccaggtgcggtggctcacacctgtaatcccagcactttgggagcccgaggcaggcagatcatgaggtcaggagatccagaccatcctggctaacaaggtgaaaccccgtctctactaaaaatacaaaaaaattagccaggcatggcggcaggcgcctatagtcccagctactcaggaggctgaggcaggagaatcgcttgagcctgggaggtggagcttgcagtgagctgagatcccaccactgcactacagcctgggtgacagggtgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcatattgttaacttgtgtttcctctcttttctctcagtcttaccagaggtttatcaattttatttatcattcaaagaacttggtcagcttatcggtttcccctgtttttctctctttccattttcaacttgattatttccggccttatttgctttctttttctttgggtttatgttttttcttctttttcgagttttttaaattagaagtttatattattgagttgagatatcttttctaatgttaccattcattgctataagttttctattagacactgctttagctgcatacaatacgttttgatatatttattttttattttgttcagttcaaaatattgtctagtttttcttgagacttcctctttgacccataagtatttcaaagcattttgtttaattgctaagttggacattttctgttacctttctatactaacttagcttaatttcattatggtcagaaaatatactttgtatgatttcaaaattttttaatttattaaggtttgtttctagagtcatgatattgtttatcttgatgactgttttatggcacttgaaaagactgtttaatgagcttctgttgggtggaatgttctataaatgtcaattagatatagttgatttgtggtattgtgcagttcttttatatccattctgattttctgtctactagttctattaattgctgagaaaagagggttgaattcttcaactgtcattatgaatgtgtctttctctcctatcaaatatgtcaggttttactacatgtatactaaagctcccttgttgggtatgtcatatttaagattgttaagatgttgataaattgactcttctattaatatataatatttctttatttctgatatctgataattgcttttttccgaagtctactttagtctgtattaatattaatacagcaaatctagctttcttttgatttatgtttgcaaggcaaattttttctccttttacttttaacctacttttatcatttttaacctacttttatcattacatttgaaatgagtttcttctagacaatacagagttggctcattcttatgcattatgatagctcctgtcttttaattggtgtatttacatcatttacatataatgtaattatcaatatggtacttttaggactaccatttattagttttctattggttccctcctgtgctcctccctttctttttatactgacttcttttaaaattatttaacctatttttagtattcaattttaatttatctattttagttttggctatatcactcatatttttagtgatggctctataaatctcatagaaattcattatttcatagtctgctgagaatcactattttacaaattcaaatggaaggtagaaacattaccataatattggctttataaccctcacacctttatgtgatactcatatatatttctgtacattgaaaacttcatcagatgcttataatttttacttttgtcagagtaaagaactcaagagaaaaatagcctattttattgactataatatttattattgctgttgctctttatgccaaagctaccattttgcctggacatcagcaagaagaatagagaactgcatgcacctcttttttttatcagatgagttttttctaactgggaccataaaccaggtcaaagctctagtttgctaaattttgaattgatcaaagttttataaatatttccttaatacctctcttccttctttcctccatccttgcatctgcatgcatgtgcatgtacacgtacacaatcacccacatataactcaatttgaacaaattatattttctatatagaattggattataaaactttctgatatgccaattattttaaatcttcatttgataaattttgatctttaaatagatattaaacacgtattgtatgaacatatcagtggcctactgaaaaatacattgacccaactccagtcaggctgcaaggagctggttaacaatattactaggtgagtcacttaaacactctaaatcctccttgccgtgtgccttttcctggatcaagaaggttgaaaggatctgatttctgatatgtcatagaaacagcaatcattttctatgtgtcttggtctcctagacttctaggattcacaatgtcacttaactttaagtctgacaccaatatcaagctcactacaaagaaagcatctctattttccttctcttctcttcctacgttggtctctatcaggctcctagagccactctcacactgccattatcatcctccttttgttcttcctatacattctctttttccttttcaagttccctacttttcccccatgttgagtatccacttttttggttacccagaaaaccgctaaaattcagtgtaggcagatttgattaaaggctgctgcttttttttagggctttatgatgtatgatttactttagaattgtaacatgggatttgtactcagacacactagagttgaaattctgtctgcactaatttaggtgcgacctttacaatctttatgagctgcttcttcctcatttgtatagataaacagtatttctcattgatctcagagaattgtggtgatacctttattggtgagtttcattcagagttactggtgcataaatatacagccgaatataaattgtcattcttgctggttgtctctctgtaccatttttcctcaaagctctgtgaggaaggtaaatatgtatttatttttataataaaatatcaatttatacatttctcacattatgaaagcaatacaaccaacataactttagaagtatcaaaaagacataaatcccaaaccagtgataataactatgaacatttttggggttttaaatttttttctagaaaagatttaataaaacatttgtgatcatgtcatactaaatgttataatatacttctttcattctatagcaaacattttatttactaatcttcaaaacttaaatttcctcattatgtattatattttattgtgtacatataccatggtttatttagctagtctactcacatgtttttaagaaaaaaatgtttaaatattttcttgtgctatatgcttagaagtgtaattattgggtaaaattatataaacatgagtctaaccaaacttcttttcatgaatcttgtttttttaatgtttgttatcagtttacattcccaccaactgtgcaaaagtgtggcctgaaatcaatttgattatagacttgaaatcaattggatgatacagtctcctctttgaaacatgcaagtacttttaggtgactgaaggcctgtctagatgtctgccaccaaattgcaatagtgactctcgatatacctttgattgtggtctatggaagggatagtagttttggctggaggtgagtaagacatcttgaagaatggagtatccaggagtggggtgagcagacctagctgggatggaaataatatgagtgaagaggtggtaaaagagggctagacaaagtctatttcgagactttcacctaaggttaatcttgaacatgggaatggacataatattttccccttttccttcttaacccttgcttttagtatcccaaatgcttttatccctttggcttctactattaaaataatcatttaaacataatttgtgtcaaataggctctgggtatgagttctgtaaatattaattaaacaagtaagaaaatatatttcacatagcaaaaatcctctaatttttggaaagtggatttgtagctacctatgtggcttatagggtagctcaatattcactccgtttagactgaattccggtgtccccataagagcagactgtttctctgttctgttctttgtacagtatagccaatgggaaggcagcactttgttaaagagtgccaagtcggggactttaccttaaacacaagtatgcatttcaaaccctgaacaaacagccttcttaataaaataagggaaagagttttctttcttctattctctagaaattcacaaatatcacttgacaggtgacagttcttcccttacaaaaggggctgtttgccttttgctttggtgtttgggtaaactgcagtatgcactggcagagaatttattgcctaggggaaggtgtttgcagttgctgtgtttaatctgaaaagaaacccttttccttctgtctcctccctctctttttaaggagggagagttggaaatgatagccccagggaaatagttcccttaacacctgtctttggtgtaacctcagcaatgttacttaagacactgtgctcagactgtatgcattaggaatgacaaagttgaagagggcagataaacagaaagggatttcagcagaaacacaggagctgattctgaccttgcatcctcttaaaaactgatcaggtggaaatcctatcatgctggctaaaaagaatctgatttgtttgaagtaatactcatgctattagtcatctgtcctttcctttggcaaaatatgcatacatacatatatatatagtttcaatctgtaaaacgtgaaaaattctacaatgttatatttaggaactttagacctgctaattctagtccaacctttagtagatgagaaaactattaagatccaagttcatcagtggtgacttctccaacatttctgataagcatttttaagaaaaccagggctacacccaactttctggatttctggacccatttttccagctattatcagaggtggtgtgaagaggtcaggctccagagatagatggctgcctgtgtttgaatctagctcagttattcagtatttgggtgaccttgggtgaattacagaatgtttctaagcctcagttttctcatctgcaaaacaaggatcaggattgatattggtgacatcctataggagagctgttctgataactgagataaggcatgttagcataacacactgcctgtggccagtcctcagtggaaatggttgttgctgttagtctttagactgtgttaaatttggaaacagtgaattattaatcctaaatagagcaattactgatgcaggacaagaaaaaaatctacacagatttgtatttttgtttttccaaaaaatatgatattatttgaagatacactagtgttattgtaggtagctagtcagacatgagcaggacaggagagggctccaccccctacccccaaccctcaccagcaatctcagacgaccataaggtgatggtcaggcagttgttacactatttcactcaaataatattaataattgttcgtggttgcagccagcaccagggaaaggcagtctcccgatagatagaaaaaaaaccttaaactagtgatcagcagcttcccaaaaacctcggagttgggtgaatgggctcaagcatgtgtactaaggggcaaaatggcagagtttaactagtatatgaccttctaggaacattcagactagtaaagtgagaacacctcaagcaggggtcctcaatctttttggcaccaggaaccagttttgtagaagacaatttttcacagagagtgggtggaggtatggtttgggaatgaaactgttctacctcagatcatcaggtattagttagattctcataaggagcacacaacttagatccctcacgtgagcagttcacaacagggttcgtgctcctatgaggatctaatgcccccgctgatctgacaggaggtggggttccagtggtaatgctcactggcctgcctacctctcacctcctgctgtgtggtccagttcctaacaggtcacatattggtaccagtccatggaatggggccgggggcccctggtctcaagtgagcatgcatacaactcgagtaaacacattgcacatgcagcccctccttagtgcacatgtcgacagcccaccccaaggaataatcaggggagaagggatgcaagactccagaagtacaccaacatataaaaccctaagtcaaaggtcaaaccaggcacttgatctttcaagtcacctgcttggcttcttccaagtgtactttacttcctttcattcttgctctaaagctttttaataaactttcactcctgctctagaacttgtcttggtctctccctctgccttatgcccctcagttgcattctttattctgcggaggcaagagttgaggtctctgcagacccatacagtttggttgccactaacatactttggtgctgcatgccttggatatgttccactgctgacactggcaggctgtgaaatatgacttgaccatcatttcccatttgaaactagacaaggttgagttttcttcaaactaagatcaggattttgaaccagacagacttcttatgaaagccaacactcttttgtctgttcaggtttcagagaactcacaagaaaactttattttacttgctaattttgtttatttgggtgtcattcagtaatgataacataatgaaatattccctttgccagtctaatgattaagagcgtgggctttgcagttgagcacaccaatatacttgagtttaaatcttagcatgataatgaagtcagagctgaatgaactcctatatagtttaattccgtggttctcaccgtgtgttctcagggccagcagcatcagcatcatctaagaacttgttaagaaatgcaaattattggatatcactccagatctactgaatcagaaactggagggaaagtgagagtggtgatctttctataagccctccaggtgattcagatgtttgagaaccagtggtacaatcaagtgatttagtatatatttttatgggaggggacagaactcgggctttgggaagtgactaacctgtcaaggaagaggaaaactctgtaaaatatttgaagaggtttattgtgagccaaatatgagtgaccatggccctcaaatttcaagaggttttgagaacatgtgcccaaggttgttggttttcagcttgattttatacattttagggagatgtaagatatcagtcaatacatatgaggtatacattagtatgatctggaaaaatgggacaaattgaagctaagggctcacgggtcataggtggactcaaagattttctaattggcaactgtttattttaaaacatggaatcaatagaaaggagtgtctgcgttgagataaggagttgtggaggccacagttcttattatgtagatgaagtctcataggtgaccaccctcagagagagtagctgttgtattactccattttcatgctgctgataaagacatacccaagactgggcaatttacaaaagaaagaggtttattggacttacagttccacatggcctgagaggcctcacgatcatggtggaaggcaaggaggagcaagtcacatcttatgtggatggcagcaggcaaagagagagcttgtgtggagaaactcctgtttttaaaaccatcagatcttatgagacccattcactatcacaaaaacagcactggaaagacccgcccctatgattcaatcctctaccactgggtccctcccaaaacacaagggaattatgggagctacaaaatgagatttgggtggggatgcagaaccaaaccatttcattccacccctggcccctctcaaatctcatatcttcacatttcaaaaccaatcatgccttcccaacagtcccccaaagtctcaactcctttctgcattaactcagaagtccccagtctaaagtttcttctgagacaaggcaagtcccttctgcctatgagcctgtaaaatcaaaagcaagttagttccttcctagatacaatgggggtataggtattgggtaaatgtggccattccaaatgggagaaattggccaaaacaaaggggctactggccccatgtaagtccaaaatccagtggggcagtcaaatcttcaagctccaaaatggtctcctttgactgcatctctcacatccagatcacgctgatgcaaaaagtgggttcacatggccttgggcagctctgcctctgtggttttgcagggtatagcttccctcctggctgccttcatgggctggtgttgagtgtggtttttccaggcacacagtgcaagcagtcagtggatctaccactctggggtctggagaacactggccctcttcttacaactccactaggcagtgccccagtagggactctgtgtgggggctcccactccatatatcccttctgccctgccctaatagaggttctccatgaggaccctgccttgacagtaaacttcttcccaggcatccaggcatttccatacatgttctgaaatctaggtggaggttctcaaacctcagttcttgacttctgtgcacacacaggctcaacaccatgtagaagctgccaaagcttgaggcttgcaccctctgaggccatggtacaagctctacattgcccctctcagccacaggtagaatggctgggatgcagggcaccaagtccctaggctgcacacagcacagataccctgggcttgcctatgaaagcactttttcctcctaaacctccaggcctgtgatgggagaggttgccacataggtctctgacattccctggaaacattttccccattgtcttggtgattaacattaggctgcttgttacttatgcaaattgctgcagccaacttaaatttctcctcagaaaattggattttgttttctgttgcattgtcaggctgcaaattttccaaacttttgtgctgtttcccttttgaaactgaatgcatttaatagcacccaagtcacttcttaaatgctttactgattagaaatttcttccaccagataccctaaattatctcactcaagttcaaagttgtgcaaatctgtagggcaggggcaaaatgccaccagtaactttgctaaatcataacaagagtcatctttgctccaattcccaacaagttcctcatctccacctgtgaccacctcagcctggaccttattgttcatatcactatcagcatttttgtcaaagccattcaacaagtctctaggaagttccaaacttccctgcattatcttgtcttctgagccctccaaactgttcaacctctgcccgttacccagttccaaagttgcttccacgtttttgggtatcttttcagcaacaccacacttctggtactaatttactgtattagtccattttacactactgatatagacatatccgagactgggcaatttaaaaaagaaagaggtttattggacttacagttccacatggctggggaggcctcacaatcatggctgaaggcaaggaggagcaagtcacatcttatgtggatggcagcaggcagagagagcttgtgcagagaaacccccgtttttaaaaccatcagatctcctgagactcattcactatcacgagaacagcatgggaaagacctgctcccatgatttaattaccttccacagggtgtctgccacaacaggtgggaataggaaagctacaagatgagatctgggtgagaacacagagccaaaccatagcagatggcaaatgtttcctattcagaactttaaaatatactagactttcagttaatttcttcaggattgggaggacctggaagaggaaagatctagttaatgttaatagagattctttacagatgcaaatttccccccacaaaggctgcctgttagggccacttcaaaatatggcaaagaaacatattttggtataaaatattttgttggcttctttatctgttatttggtatgtcagagtcgtggtgtttaaggttcagggaaacccctgtgatgggattttatggtttgtagggcatgactcctcaggtcccttagatagcttttggggcaagagagaaaaaaggtcagagtttagtcctcaggcccaaaggtatacagctataatgacagagaagaaatttctagacccatctctaagataattatttctgactgtgactcattttaaaacatgtggaagggtctgctgggttttatcatttaaaaagttaaaaggtaaaatgtaatactttaaaatagtaattaaatatgattattcagtggttggctacatgtatctttataagtaagatgttaaatgcattctcatgaaaatctcttccttggcaaaagaactaaaatgtcaagcttgtgtacttattagttcaagaagcacttactgagtatctgctaagttcaacacactctgctaggagtgcaacgtttaaaagagctgagtctatcactgcctacaacttagagtgggtgaggagacagatatgaagtcaataaactagattattaatgatctaaattattgtacctgggaaaatatttgctgctgaaatattgagggatcgatagaaaagacaataaatgggcatccatcattgaacaacagaccagagttctgttattaacaaggactgcttgccaggtgtggtggctcattcccataatcccagcactttgggaggccgaggcaggaggatagcttgagcttgggagttcaagatcagccagggtaacctagtgagacccctgtctctataaacaaaatttaaaaattatctgggcatggtggtgcatgcctgtattcccaactactaaggaggctgagatgggagtgttgcttgagcctgggaggtcaaggctgcagtgatccgtgactgtgccactgcactctagcatgacagacagagcaaggccctgtctctaaaaaataataataaaaaaggagggtactgctgggctatattactttagagacagtattttataccaaactctatctgaataatgtagagcatgatatatttttcatcacgcagctcagtggtcctacattcagttacgtttgatgcttgctaaactggaggcaatgtggagaatgaattaataaacaaaaagcaaattctgcccctaaggatttcttagtttgttatggacaggagacaatacaagcaactcatgtcaaggtagagattgctaagtgccagaggaaagtaaagctgtaaagagcagaaattctgatcaccatttgtatttgaaagctcaggaaatagcctggtcacttgaaagaggtggggagaggttatactaggaagacgaactgtgtttaaggtagttaggaaataggctgccagcttaaatgtgtgaaacactcagtctgacatgaaatggtgatgcttagagctaaaaaatacttgactcatcggaagtatttaaattaatttttaaaagtgtactagacgtgcagaacatatatatggccatcagtgtgacaacccttacttaagtgtaaacatgactttgacagaatgtgcaatgggaggagagtcagcttggtttgatgtgaaccctacagcaagataaattatatgggaataaacaaacagctgagggtcaattaaagaaaaataggaatactctataacctggtgctcttgctgagctgactgtggtaattagaggatgggtggctggggatgtgcaggtccctgtgcatgcatatgacctcaaactctgcacccttgtatgctcattgacaaaagaggtgggtgtcttgggattatgattaagtccctctggcacactgttctttgcagataaggccctatgaattgtctactttttctgtcccaatatccattcagaatagactacatgctatttcttggagtaagaatagaggaaaatgagagtctctttagttttcagtctaacgaggaatacaggtgcatatcccactacctaggaaacaagaaccatgttgataaaatgccagaatacaaacagagctgataaaaccaatagctggatggcttatttctgactgggaggattacaggtgtcttcatcaggtaaaaggtaaaaattgaaacacccacgcacacacacataggtcatactcttagtgtgtgcagtataagctttttactgggagctattttgaagatgttcccttggctgtctactttgtggacataggttggctgactggggtgctcatcaggagtatattgtctgcagtgatgtaagcttaattctagtctcttttgtctactaaagttatccattgtgtttaggaaagacatacaattcacttgtagattaaaaaaaatagttctaacttcattgtgtttacttatcatcctcccaagaagctgggagctcctaatggatattattcaagtcatttctcaccacacactcttgaagaggtagaaagagcccaggtattttaaaatctcatttttgtacttcggcggcacagcgtaatgaatcagaaaataaactagaaataagacccatgctttgtcctggaatggagcgcactttgttctagtaaatgttcctacctgcttttcttaaaattagaactagatggcttataaaatgtggcttttaaaaaagaactcttttagatgtctgggtggggtatcagatgatttttctgtaatcaaagctttattggagcgttgtggatttagtgatgttggctgccctggatgaaaggaatcagcagaaaccatctttgctattgaattaaatagatgcagccagtttcccatttaaccaagatattttattcactttttagcaataagcctgtttaggaaaagagacaactcagctgcttgatgagattttatggtttgatagaaaactaaggagaatatagagcagaaaaaaaatcagttttgtgactaattgatatgagaaacaaatgtatccccgtatattgtttttttcccccctgagatccaagaattaatctcatcaagtaacattaagttctttggaaatcctttgacataaaaaggaaaattggggttttcaatttggggctttgtaaatatcctgtcctctgcttttttttttttttttttttttttttttttttttttttttttttgagacagagtgctcactactgttgcccaggcagagtgcagtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctttctctaacatgctgcctctgtcttcctcgcaagccctgcaggcagtgttctttccaaacaactacttgcctaaccagttcattggaatgtcttttctccagactgtctcctcattgagatttcttctgaaaattaacctcgctaaaaacataaatcatgtttaaaaaaaatacagtggtaaatattgcacataaaatcttttctctggtttaaaaaaatgcacaaacctacctaccactttgaaacagcaacagtaacaaaaacagaaacaattagggcaacagttgcttttctccttttaaagaaaatacttttcttggttgcaattgttctttggagtgacagggattaaactctttggatgaaatctttcctccttattgcacacctcctatccctcaccctgcagcctgggagtgattttaggaaatattaagtatatattttcttggctggcactttaaataaggtataaattgtggaacaaagtataaaaatcacgtatttccacaaatcttgccatataacaaatctttccccataactttttgtttgtttgctttcatacaaacaaaaggttcttcgtctatggtgaaaaatgtaatggttgtagagtatatacttcaaaatttatctttattatttattagcatcttaggcaatcacagatgtcagtggattcttttccttttttattttatttgaaccagtttctcatccagcagttctacatgaaagaaaaaaaaacatgaacagtaataactcacataacatgttcttgttgttgtgtataggtactattaaataaatagggatagtttgtggtttgaattcattgaaggggaaaaaccagtaaacatgtaccaatctttcaatttatgcagcggaatcaggatgcttttcatagtgttataaaaattcaatttcgctttctctggctaaaatctgaatggccaagaatggaatagtcattttctttgctagtttcgtatttgaagatatccccagaatttgaatcaatctgaagtttgattttcatttctaactcctctggaacaatatgatgaaacagccatactcatcaggaagttcagctaaacaggagctcatggttggaaaaccgtgagtctcaagttttaccatatagagtgtaggatactaaattgtctgatagacaatagaaataagtcatcatcttatggcttaattacaggagaaaagaatgttcagactcaaatatctcaataaacagactgttgtacagagacaaaagagctaccttagaagttttggaccctggattgtagtcatgaattctctaccatttagtgatgtgatctgacacatgtcactaaccctctctagtgtcagtttcgtcacttacaataatctaaatatttgatatttaatccaggattttagaataataatacatatgtgaaatcacatacaatatgtcagcacatcacgtaaaacaaatgaagtagcattttattgttagagatttattttaagaactaggtacttcaggctctgtgttcaaaccccccgcgtgtatgaataactaaccatctctaggttttaggggttttgttgctgctgttgctgttgctgtttttttgcaaaacgggattaatatgactatggtgaaaactaattgagatagtaaatataaagagcttaccacaatagcattggttcaataaacgtgggcttttctttactatttacttttttaggtcagtcattgaacacaaggggctgttttaaataaacacaatttaaggggtgattttgtatagaagttacaatattttaccagcatcaacatccaattcctcttgtattttggtagcgatgttattctcatgattatgtaattcttttaaaatatctcgaatcacaaacgtaggtagttgcatgttactttttaaaactgtttttgccacctccagataatcattactcaaactgctctaaaatcctgaaagacaaatagtaagaaaatattttaaagtcaacacactattattaaacaattgcttatttttccttcttataaacacttttgaccaaaaattccaaaacgtatgcactgcaatggcctatgatacaatatctcccgctgtacattgaggattgacttgtcattttatagttgacttaatattaggttgttataagagaatgtactgaaaacttatttgacagtggcaggtgggtgccatagtgagacttcatgtacagattaaatgaatgtaacggataaagcatggagctgaacaacagcaaaaaagcacagagttaaaacttcctagtaaatgacatttacaagaagtataggtatgttcacgaagatgaccagagaagattcaatctagggtcagaacaaaagcaaattaatctggctgcagaagacctctttgaagctcacgtctaaaactaactatttgtgtaacatcagccaagttatttcatctccctgtttcattacctcatttgtaaattgtggattataatagtaccttcctcataggctgatgtgagaattaaaacaaaccatgtatataaagtgctcagaatcatgtcttgccttaaaaagtgtttaacaaatggtcactgttgtcattctctgactctgtttatgcatatatgtattttttcaatgtttaatactgcattaaaggcactataaattctatcatcttccgataccttgattccatgtaaggatcaagttgaataatagagtagaagtttattctgggtaaaaatgaaagcacaattttatctcattaaatgttattctagtcagttcctttgagaatattggacagtaaaacactattacagatgttcctgtttatgtgtatacatttgtggttatttcagtctgacaagccagctctaccatgagtttggattagaaattgtgtatccactggatgtaagaactatgtttgatcttttcttggtattcttccacttaattggtattcctttaaaataattagaattaatccaattaataaaattaatatggtctgtgagtacaaatatgattataataaatatagccaataaatggtttatataccatataggatgtatcaaaagaaataaaactttcaaaatgactgtgcccatttagacattttaaaatgtttctaagtagccattgtaggcaattatgttgctggacttcctccttgtcactgaccttcaatgaaagattattcagagcataaaagtgtccctattttaatgctaatttgttttcagaattaaaattatcttatcctatttgactactcatgttacactctaaatttggctgaataaattttctaaaaagatgaacatttgttaccattgattatattccaataataagtcacagactggttcataacttacaacagattgtttaccagggttacaacttcatgaaatcagaaattatacgtttttgtgtgttaaacatattataaagcctggcacctgttcatttttagcaaatgtttgttgaatggtttgaggcggtagtagcctcatctcttgaactaaattgttagtgcctttagaaaagtggtacaatctgaatcttctaaatgctgcatattgccttgatctaagttttgaaaaccagacacaatccttatcattggggcaccatccttgttagaattttttatctgttgctttctattcatctggaatgtgtaaatattaaattaaaattattttgggccgggtatggtgactcatgcctgcaatcccagcactttgggaggccgaggcaggtggattacctgagatcagcctggccaacatggtgaaaccccgtctctactaaaaatacaaaaattagcctggcatggtggcacatgcccataatcccagctgctcggggggctgaggcaggaggattgctggagcccgggagacagaggttgcagtgagccgagatcgttccactgcactccagcctggccaacagagcaagactccgtctcaaaaaaaaaaaaattactttgacatctattaagaaatttgcagcaaagttaagcagcaacaatttacgcctttggggaattattgaatattattatgcctagaaggctgtcccttctttttcattttaaagaacatttttctctgaatttatgcaaatttgaggaggctaatccaagtcatctctacagatagttaggcaagacaaaatgtttgatactgcaaattttctcttgaaatgtatcagtcacttccactgtataaatcatgtaatatgtcagaggtttttgtttggatgaagtaaagctaattgcagtaaagatttgaagaatgatacttatccatcaaaaacaaacaaatatcttatgtttgagtaatgctctacagtttaaaaagtcatttcacatcttttattacccttgctcctcacaacaacaggcaatgtatatctactaccattctaagtgcattatctctggatttttggcttaattaactgttatgaaaagccacttaacttcattagtgaacaggttagtatgtatgactaattaaaaggtacccataatattttatactaacattaaacaagtaaaaatgtggctattgttcaggagctccaagttgaatgagctctcaaagataacgttttctttattattgtttcatgttattctacctgcaggtgacatttttgataaagctaagacaaatatatatataaatatatattatatttatatatataatatattatatatttatatataatatatatttatataatatattaaatatataatatattcaatatagactatattatatattaaatatataagtatattaaatatataattatatataaatctataatataaatgtattatattaaatatataatatttaatatataattaatttatataatatataaatatattaaatatataatatagatatgtgtggaggatgaaagcactgatcagctgattggccttgaagatactctcattttctttaattttcatgattgccttcctgttaataatgtgacagactcttttttagccctcctgagttgaatatttgggcacacgtggcagtataagtacaactcatgattgaatagtcttgtttggttgattgctcagttatctgagagtgagatcttggctctcatttggataaagcagtaaatgtctgagcagtgtctgctaatgtcgggtcagttcacatcaacattcagcaaatttgttgattgattcatttattcttaaaatatgttgaaagtttcctatgcatatgaccctgtttaatatttgtatgagaatctaatggctttagtgtagatatcattctcaatgggattcgatagcatttcggaaactgttgagcatggcagagtgataaattgtgcttttgtttacatgactaattgtaagggtttggaaacactcccttgatgtactaagagcagctaatgaagacagttaaataaacaaaccattatgatgaatctaggagttcatatagacattctgctaatttgcttcttgtccctttcccaaagttttatgtatatcttcccaagcataacaactattttacatttcatggagagctagtttgtttttcttcataacctaatgctctattcactcacttagaatgtcactgctcaaactggctttagagatcacgtactagctagctaatgctctttaccaataaggacactgaagctcctagaagtgaagtgataagccttagatcgcattgctaattggtgatggagccagtctagaatccaggtctcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcccggccgtattctgtcttttgaagatcagaaaatattgctgaatatgaaacaaaaacaaaaacaaaaaaaccaagttcttagcttcatatttatagtttgtctaaagaaaaaattgctttcttccaacgaactgcgtttcctgtagaacacaaattttatacttggaagaattatgtgtagcgattttgcaaccatctttccttatgaccaaatacttttgtgagctgagaagtctcaggttgacataattaaagataaaatgtgacaggaattgtatgtgcacctgtgtttgaagggggccttgcagtaagtagaacataaagatatatgcatcgctgttttggtcatctcaatatagtattgactataatctcatatttttcccactttataatttataaacatttcaactcatttgacaacccttacagttacctgtaaatgagatgatgtaggtgttgttatccctatttaataattgtaaaaatagagtttccaattttccccactgctaccaacctagaaagtatcagaacccagaccttttgactcccggccaagtatgaagtgctttcaaatagggcatcagatacagcaaatcatctgttactatgaagtactgtacaaaatgttagtactgttattgaatatattctcaagacttaggtacgcggttggccattgaggtacaaatcttttcccatagaaaggaaattgacagccgggcatggtggctcacgcctgtaatcccagcactttgggaggcagaggcgggcagatcacgagttcaggagtttgagaccagcagcctggccaacatagtgaaacctcgtctctactacaaatacaaaaaattagccaggcgtgatggcaggcacctatagtcccagctccttgggaggctgaggcaggagaatcgctggaacctgggaggcggaggttgtggtgagccaagatcgtgccactgcactccagcctgggcaacaagagtaaaactctgtctcaaaaaaaaaaaaaaaaaaaagaaagaaagaaagaaaaaaattgacttgtaaactacatataaagaagtcatttgctgttactgagtccactgtgttaacttgtttacatcttcaaactcattctgcctcaagtcagtcttattttcttttcttcaccccaaacctagaggattctgccttcttgctgggttctaggttctaccctttcagtataagatgaaaaccaccttccacacagctacctagatcgtaatatgccatgttttctctctccttgttttcacttagttttgtctttctatttgattgcgggtgctctttggatcgagttttttgtaaagtaccttctaatatacttgggcaactattatacttctctgaatgttgtaagcatcttatcctcatttctttttactgatatctaaccttctatctctctttaattcacacatttttaagtatcttttttaaggcccaaacatagaagtgaaaacttttcacagagagaaacagaggttaccttttactattaccttagtatgtttattggaaacctgtaatagtcaccaacatttaactgaatttaaagcagaaattgaggcagctgaatgggatgattgagataaagttttggtaccctagtaatataagccttgggccacaaacaaaaatatacttagttctcatagttaaatgtaatgagtaatgtaattatttcaaatattggatgcaatactaagaatgaggagagaaggagagccacttgacacttacaaaatagttgcaaatttgggaggctgagacagaaggactgcttagcccaggaggttcagattagcctaggcaacatagcaagaccctgtctctgtaatttaacaaaatataaaaaatagttgcaaaacattgggacacttattttcaatctttggatttcatattgtctttctctaaaataaaaacgtgtggttatatgatttctaaagtctcttgatgtaatattctttagttttatttttatcattgcttgcaattactgctcatattatcattacaataagcccgacattcgttttcatcccttatctttggaacaccgtgtttccctccagagacggagacagagcgcttcctcctttctcttcctgtcttgctggggcctaagaagagaaaggggcactatctttatgggtgaatacatgtatagccctaggaaataatgaaaaaaggatttaggagtggatgcttaactgattgctttctattaaaggctcacaatcctacagaagagtagcaatgaagaaatggatctttatgtttgaattcctaaatttatcctgaaaacaaaagccagcccctgctgggttagagtcctccaaagctagggatctgttaggagcactggttttgccttacagacctaaatgtaaatgttagtctcagatgggcagagagttgaactctctaattagccctgcaggtcagtcttgaaagaaacaagagtgtagcatccagcaatttaaaaaggcatcctgtgcaattgtttgctgagggtcagagggtaaatgctgttgtgacagttgggtggacttggcacacttctctacgcaggataagagagagaagagaggttgatgttgatctttggtgatagcaatagcagaagacagttcccaaaattctagggtcttttaaatgtcctttcaattcacatgaaaggcttccgtttgcaatccaaggaattgaaatatcaagtcataggaaataagaggcctataccttttcttcagggaagttaaatcataaacctttctggaagcttaaagctgaagtatatttctcatatttacttcaagtatgagaaagatacagataattcaagtccaccacagtcttattccaacatgtctttcctactctatcttccatctcatgtcattccaggctcacctaactcaccctgttatttttttatgtttatttttattttattttgagacagagtcttgctctgtcatctagactggagagcaatggcacgatctcggctcactccaatctccgcctcccaggttcaagcaattttcctgcctcagcctcctgagtagctgggattacaggcacccgccaccatgctcagctaatttttgtatttttagtagagatgggatttcaccatgttggtcaggctggtctcaaactcctgacctcaggtgatccacccgcctccgtctcccaaaatgctgggattacaggtgtgagccaccatgcctggcctcaccctgttattctgaatgcataatttcatgtctctgtcttttgtcctatactgtttcttaattagattcctaaatgtcgatttcctcttcctcttctatttcctttttaccttaaggattcaactccttatctcttcatgaagaattaatcactcctttctctctgttcccatagaactatgtctgtaactttacacttacttagtcttcactttagttactatttcacatgtatttcacccgactttgtaaacatattttttttttttcttttaagtgtatgtctcctatactagatgaggaagtctttggacagatgctgagtcttcttcttcttcttcttcttcttttttttttttttttttttttttttttgagtcagagtcttactctgtcacccaggctggagtacagtggctggatctcagctcactgcaacttccgtcttccgggttcaagtgattctggtgcgtcagcctcctgagtcgctgggattacaggcatgcgccatcacatctggctaatttctgtatttccagtagaggcagggtttcaccatgctggtgaactccagccatggctggtctcgaactcctggcctcaagtgatctgcctgccttggcctcccaaagtgctgggattacaggcatgagccactgcgcctggccgagtcttattcttctttaggtcttattgcaggataatgtacaataaagcattcagttagtgtttgaaaggaaatgtgtttgtctacaggtgtatgtgggagaaataaaatggcctctaactgatggcctctaacacacttctagtattaacatacactgaatgggtctatagtttgatgtatcaataaaatcaaatcaactaatttttaatcagctattatttactttagccttcattttttattgtcttgattccctgtaagaggatgaaaaactcaaatgtgacaatctttcctattatgtgaaccagtaaacatttttgaccttttccattctagagtcataatggaatcgaaagtagaacttgtctgatgggtgaggattgtgcatgagttttaatttgcttaagtagtcttctagctattgatcatgaccaagaacttattattgttgctaaataggaattgtaagaatgtggatattttgaggaatgagttaggagaaaagaagctgaatatatcttttaaagagatgcttagactgaagtatcagttcccttttttgtccacaatcttatagatctggtcacaccacttacgttgttatcaactcggccctttaactttgtagcttaaatcccttaccccatagagaaactatcacaaaacctcgtgaatcaaagaaatacttaaagaagagaatgtaagtaaatgattaagatcggtataatattaccatttcattcacttagcaaccaagttacaaataattccttagctttattttttattttgctgaagccagctttcccatagctcgtgtgtgtgtgtgtctttatatgacttataatgaagcctgactttgctatgcatttctttttgtgatttaaatacaacactcatactgaatccgtttgaagaaatgatttcatcattatcaggaggctacagtctatagtttccctttacttttaagcaacatatatattaacactaaagtagctttcaatctttgctggaaattacctatatttttaaaatgcatcactcctcgagtattttttaatccctttgtgacattattacaaaatcgtctagttcatgatcaatgcagataatgttttcttacaaaatcaaaccagcagcctccataggccagaagatctggcttaaccacccgggtcacagaggcacacctacttggttgcaccactttttaatcaacttgtgaatcaggcttgggaaggtggagttaagttagttcattgtgtctgtaacagtaggaagctcagaagaccaacatgtagggaaaaaagctgcaaagaaaatccatgggagccatttgtgtccacaggacctctcaatttcccttgcagagcatgcaaataaaaaaggtgatttgctctgatatggaattcctgcacaatgttcaggcatgcgtgcaagacagtaatctcttctgtgacagagtaacctgtgtagcacaggggagcatgaagtttggagccagcaaacctgagttccaagctccagccttaagtatagtttattgtatgaacttgagtatgacgtttaacccctctagagcctcatttccttatctgagaatcaaggacaataagacgctgccaacttcacagacttattatatggatcaaaccagaacagacatctcccaagcagaatgtgaatgcttactctgcatactttccaagctgcaggaaatatagaactaaattgggcatcgcccttgctctcaagcttctatttcagtgtgggattcatgaaaacataactaaaaggcaataagatcagatcaacagtaatataggtatcccaagaattgagtaaaatgttaacggagagagcaactgactgcctagaaaagacaagaaattacaaaaaaaagcaagaagacagatcctagcaagcacaagctaagtacatagaagacactcaaccagtgtggagtaaaatggaagtagcagttatgtgggtgttaaagaatgtgtttgagtttgcctgttggagataacagaggaactagggtctacagagctgccaaattgtgaaatataagagatgtatgctttgtaagctgcaatgcaggatacatatccttaagctcttattacccagccccaaatcactgtacccttctttgcccaccaataagacttttccaaaagaagtactcaagttagatcatcctagacagaaatgtagaatactttaaagctagaactgatcattaggttcttatcaaaatattttcttgcactcttgaagttggatttggtttttcactttggaaaacagtttcctccatagattacttataggcccctatttcctaattctatgtacacttcactctctcctgtactcagggtcactgggacaaaaatgacacaaggaaggcacttgtttttatgtctttattattgttttggaccaagatctcctacaccccacacttagagtgagtggaaattgttttcagagacaggtgctttttctcccatggcttagtgtcacagaaggaagatgacaccagcctggtgacatttgtgcctgggagagctgccagtccatgctgcttccccagttttaagaaacactatggtttgtcatacctaaattacttccacctctctgctggcggtgacagtgatgtcagttatcctgggtccagctaaggtttcagtctgtgtgttttccggatcatgttgattctcttcttcttcttaaaatgcaatttttctcattttgtgtttgtggtaagggctattttctgccaaaacagacattatcaaagcagttgcatagtgagggactggtgtcctttataagcgtagagaaaatccgagaacgtcaggcccagaaaggactttagaaatcccacaggatttggccaactctttgtcgtacttgcaagaggctgagaaacagacagactagatagctatgtcaaggccttgtagcaagtcacagcatgagaaaagtggaactttaaaaaatatagatagctacagataccacatttacatataccatttctgtatacttaggatttaagggtaatgtaatcctgaacagtgtagcagagaggattagtgaaaacggggttcttggagtgacttatccaccctcgtggttcatgatgcaaaggtggtgtgcatactggatgggagattcacaggtgggattatccacggattcctgatgtcacaaacctgtgacttctcctattttctaaaactgaactgtggctactagcggacacatatgctataactaaaggtgcagaccggcagcaattaaaaccagagacggacgctagaactctctaagagcaaaatgcaatccccgccccacctggagttcatctaggattccaaagtaaatacacctcctttctgttttgcctagggatttttttttttcctggaaagggtggagaagatttacgtaagaaagctgagttgcctcaaaatacagcctccagaaagaatgaggcatctcctgcccaacctattattcctgctgaggagagagaaattgaggaactaaaagtgaagcctaaaattgccagggctgaaatcttggtagaaatcaactagtctataaaattagctgcctcactggccctttagggtggaaataccataaggagcagacatctgatgtaaagttgagagggaagttgtctgtcttcatcaatagtaaatcaaatctaggttaaatagacaaatgccatctccaaggagagtaggatcacaattatataggatgccgaatatataatgacactaaatccagttaacaggttgaaaacctgaggcatgggcaggggaagtgtcttgcttcaagtaatgtaatgaatttactggcagatgcagaacttaacccaaaattcatgactcttagaacagtgccctttcatgcatgatcctgaaatgcaagaggggtttcatttttatggtttcaaggtagaatgaattatgaaaatctgggcttgtattataatatatcccagtgtggaatcagaaggaaaagtgatgtgttatgcagtgaacttgagtgaatacttattcattatccattcagcagaagagactaactcaaaatcaaagaggtgaaacccgaagcccaggtttcctgatgttgattccagagttctttccactattccttgctggcagttgactgcgtctatgaccatttgccatggtggcagctgtatggaggatatggcagtaagtaggggggccagggactggaatatatagttttaatccggctattcaaacataagacaatacagtgctttaaaaaataagaatttataggagatatttagtagccatcttcagaaatacatatattgataaatacaacaataaaagatactgaaatttatttggaatctatcataaactaaatagtgccatagggctgattagggaagttaaatattataatgtaaggtgatattttaccttttagagatgaaagttcaaagaaactaaacacatcactattcaaacacaatttagtttgatttaagaccttctctttccaaagtagaccagtcaatgggagtacagatgaatatgtttattttaatgaataacgtataatagcaataggaggaacttaattttgttgatgagtttttactctaagaaattttaaaaaatattttaaataatagtagctgctagtgcttgtactagtgttgtagtaaggtgagctctgtaatgcattgttggcctaaacataaacaggtatactgtttggaaattaatgtatctatcaggctttaaaatatttttgtcttttaattgaataatttgcttatatgatagtgtattttaataaatagtgtaataatttttgctgtatgattatagcggtaaagaaaaatcgaagcaaattgaattctcaactaattggaaatagctaaattaattcaataactatgtagcagtttaatttctttaattttaaaatttaacataatgcattcaatgaactgagaacgtactcattttagcagattaatttcaaaaagtaggtatatgcatctgtatacacagatacatatgtacatacttaacaaaatatatctttggtatttagtatgtgtacacctggtaaaacacatacttgtgtgtaatatgtatctctggaagagaataaaccaaaatgctaatggtgtctacgtgtagtttctaggataaatgactgcaatttattccatacattgtgtattttctatattttcaacaacatatttgtaatctaaacaaatacatgtatttttaaaaatcctaaagaagtgagttttgtataataaaataattagagtttttattttaatgtatataatactaaaaaggaaagcaatttggaaatacttgatgaatatgttaaaggtttaaacctttattaatgaagacactactccctcaacagagcagggattgggagtaaggcaaaatatattaatagatcatttaaaggagaaaggcagagggctaatgaacatattgaaacacatgtaatatcactagcactaaagggaattaatatcaaaatgaaatatttttttcatttataaagttggaaaagataatcctctcagtgctgtagtagttagcctcattcaaatgtaatttggtgcagtctttttggaaaataacttgatattatatccatgaagtgacttaaatccataacatttgacccagtacttttagttgtaggagtacttaacaggggaaaatactcaaaatataatgataactaaaaaaaaattatattgcatatgatctcaatcttgtttatatacataaacacgggaggaagaccatagaaacttttaatgtaattctgagagttgcgcttatagttgactttcattttttatttgtattttacttttttcttctaaatttcacactatttttgtaacctaaaatttttaaatccataatacaaaacaatatgaggagagattatcttatctctgtacatttgtatatctatttacttgaactgtaagtaaggcactatctaaatccaggtaagtggtaaaatactgttattacaatcatagcatgggctatatggtaaatgaactgtaggacatacatgacattgaagaaggataaatacaggagtagggggaaaagtaaatattaagatgtaattaaacaatgaagcagtgtttgtagattccagtctcaaaatacacagattcggatctcaattccaatgtttaatatctatctgcatttcagtgtcttcatctgtgcaataacaatgaacatagtatctaaggcataattttgtgagtattaaatgagtttgttatatgtaaagtgctttgagtaccttaaccataaaaagtgcagaatctaaattctgtctaccattttatcttttacttgaacatgtatacaaataaaaaattaaatctagaatacaactgtaagatttacgacagaactcgtctccctttctatgcctatgagacttacccatttttcagaacttagctggtcaccctaaaatgggtgagatctaatatcttgctttggaacttagcctcagactaaaaattgatttgttgaactaattcagtggccttcagtagcttcctcaaatgctaattcttatcacctatctgaggcaggagaggaaggtaaacacttaattcatgcaatattagaactttaaaagttactcagtgtgttctgttgatcatccttcaacttaatggtagctgataccaaaaagatctcattggttttgttctgcagcagcctggaaagccccaacatttcttagctttcacgcatgttctaaaaaccccaaccttttttgactattacaggtttttcatgctgacaactgtcccttttcacaaataattatcaagggcttgagatacggagcttgaattgaaagcgatattttttctctcttctattttagatactatactttgatttttacaagatcaaaaggcatctctctgtaaaatctctctgtaaaaaggcatctctctgtgtccgtctcataataaatgctttgggtaaatactcttctaattctagttctttcttatagaattatagaactgtttaattgagctgatactcaccgagcttttggagtactaaatgtgacatgatgaacataaatgtattctgacttcaaaaacttcacaatcttgttgaggagagcgttaagtatacaactttttgcattgaaagatagaattttattactgcttttatttatattcatataaaataagagaaggtttaacttcaactagggtttagagaaattctcacatcggtaggctttaaagaatctaaaagtatttgaatatatcgggaaagcaaatgaaggcattctaaactgagggaccggaatgaacagaaggacaaaaatagccagctggggtccacatttgctaagcaaagtggattataaggaaagtgaagctgaaatggtagtttggggccagattttaaagggccttgaatgccattctaagtaatttatctggtcctgttggcactgggacaccctgaggagtgacatgatcagagttgcactttaggaaagatgaagttatatagtgagggagctctagcagggaggaaagaaagtggagacattgctgtatgttccttttttgccctcattcagcattcaggtagatttgttattaaaacatagaaggattgattgtcagcccctgtacctgctagttctgtattcatggactcaaacaaccatggatcataaatattcagggaaaaaattaaaaataaaaatacaacaaaccaaaaaaatccagtataactatttaactttttcacatagggatgtcaaatggagccattgacatcggtattttatgaaaatggcatttcaaatctgagaaaaatatatattattcgataaataataaagatcagttttcgattgatgagagtggattttcctttgtttttcatacagacatacattctggaaagttaaaagacttgcatgtgaaaacattcaaaaatcctaatattgtaatatggttgcaaaattttacattgggctgggaaaggcctttcacgctgtgtctgaaacacagtaagtcataaaacaaaaaaggataagttgactatggaaaaattagaattttcctacaccaaaaagcaaaccataatactgtatgcaaatttgaaagaccagacatacctaaacacacacacacacacacacacacacacacacacgcatgcacaaatacatatacaaacacaaacacaggaaaatatagcacttataataaaaagttggatgttaaaaaagatagtcaacaaaatgttagcattttgttatttctggaaagcatatgcttcgatctgacatcttggacttctattcccaaagctatggctttacagcgccgccatttttacccagggggcagcgtgacccctaattcagagaccgtggagctttacgaagtctgaggaaatgactgagaaaaggcaagagctctaaatagagttgttctaactactgaggacttgggacattgacgtaaaatccttgcatttctttatttatctgaaaaatgtagataataatactaacttacaccactaggtggttagaaaattaatgcatgttactaaacatttagtacatttgagatccacatataagcattgttgttgagtgcagagaattgttacttctttgtaacctgcttaaatcaatgcatgatatttacatcagctactcactaattctgaaaccaaacattatcaggtatactttaattagctcttttatggaaatgtttgtgctgagttcaaatctacatgaactattagcgaatttttcattgtgaggataccttaaagcaaaaaatatggattttccaccaatatgttccttttcctttatgtcatttaagtatcttaagtagctgtgcagcttgactacttcacttgtacaatatgaagatgagcaaactgagggacaaataaatatccgagtaaaatcagaggaatatcctctaaatcacttctctgattctggacaaaaacaggctcttatctttgtaattgtctttagaaatcatttagctctgccctcatttcacaaatgaggaatctgaatccagagtggttaagtaacttgccccaagggcacggagctcctgtctcctaactcccagtccagtgctcttttcttccaacatactcaaagttctcaagtagccatagtggatatattgtcttagattttgtccagaatctttgtagatatgttagacagagaccgtatttggattcatgctgatagctgaggtggcacatggaaggaatctgactttttcatctttcaaatcttgctgggaatcttttgacttcgtgaaaggtgaagtttgtttacatttttagtggatatcaatacttgggaccctgagccttagatttaggtgttcaaatggctacatgatcccattagtgtaaaaaacaatttaataatgactttggtaggcagttgtgctaacagcatttcctctagatcattgattcccaagcgtgactcatccagaaccgcctagcaggctgtataaaatccagttgttggggctgtaaccctgcagagtctgattcaggaggtctggggccacgtccagaaatctgtttttaaaaagcaccctggatgattttcaggatcatccaagtttttgggccacaggaattatgcatacctttaaggaagtaaccatctgctttctactgttgactcttaagctgtcagtaggtgtagaatttagacacattgtacaaaaaattatactgtattttgtaagtaggttttttttttttttgccttctaggcagtgctcatttggttaattataggtagaaagagagatcattcttcccaatatatgtgtgaagaaatgaatgttttgtctgatataaatttgtagtgttacagagtactgtcatattcttgcatactcaagatcaaattatattatgggagttttttggtttttgtgtataaaagaaggaagcattattaccagtaacctatgggtcttatatatcagccaatgaccacgtcatcctttaagtgcataaattttatggatgcaaaagtagaagtaaaggggaggcaaatccgaagtcgtgaacgtatttgcaaactttgtttctgaaatgtatgttctaatctcttctggcttccaattctcttctaaactttgtgtcttctaaattttagaagaaatcacaattttcacttatagttatcttggccacttacaacctttcaagcaaaatagaggaaattgggtccctgagtggggggtgggggtgtaggatgatgtcaagaaataaatctaactgaattacaaatactcagcagtaaagagagtattttaatgaatcagatgataaccatcagggtgcatttcatctccactaaatcttcgtaccaaggccagattctacatgaatgttggtaagtatttatgtaaatgtatttttaaaacaaaagccaattgatatcttatgctttaatacttattccactaatcatttacatagatgcatcacgtgcagtaatcatttttattacctattcacaagcaaaaatattagtataaactgggtacaataaaatagagaaaagaaatattcaaatagataagcgttttgttaaaaaaaaaaaaaagaagaaagaaaggacacatttatcaggattcctatttcccgtacataatatggatgtttgtttgtttttgtaagttaacgggaccggtggtttaacttgttattgaaacatgctcgaaaaaatcaggtagcttattttgtaattgcttgttatgaaaccactggcatttctctggggaaaataagttaaaaactctttagctatcaggcagtgggttttaattttttatattggttaaatgtaacagtggatttgcgtactctctcctaatttctaactttgtgtaatcattcttgaaaccccaaatctagattttaaaaaagaagccttctaaaagttttcctgaagtttacttttcagttacaaagagtaaaataactttctgaaatgccttctgtaaatcgtggtggtggtgcggtttgtttggggagatttgttttgtttttaaaagacagtgcactttcttatgaaagagacagggaaagttttacctgtctgtctcctgggtttgttttttttttctttctttctttttcttttaaagattggtgataaggaattctaactacttaatgagatgggagaggcctcactccattggagtggaggagtccaggtggaagttgatggattggacaggtaaagagaagagtcccgcctcctcatgcctatagttgggtatatattaggaaaccttaaattatgtacagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgaggtaaggattttagattttagcactccatttagagatgctttttaatttttatttttgtaaaaaaacttacgtatttgcggttctcggtcacccaatgtaatgttttgcaaattgtatataggaatctccttttcttggttaatgttttctgtggtggctgtaagatttttttttttttattaagtaggagatgaaacagtaggagaagatgaaaaagaaaatctgggtgacattatgtatttgaaaaaataatattcaggagtttataaaatcactttttagaaaaacagactcagagagcagatcacactctgctagatacattgcaatgaatcctctgatgggtattcatgtaccagtaagaaaaatcagttgactgtgtcttaacttcttagcatagttctatttccagacttcatcctaaaagcaaatgaagcttttttcaaaataatcaggtgagattttttaaagccatcttcgtttttaagtctgtcaatccagagacccacctaaatccagaaggggctgtgataacgtttctgtcgtctggagggtgacttgtactttcacgtgtgatgacaaataaagttattttggagggatgcattgttaaatatttatacatgcatacatgtaaatgtgtattatagcatacaggattttatttaagaaactgattatttgcatttctgatctcttctcagcaagtttgtcttaggtatttaaacctgtgcaaagggataaaaaaaaaaatcctgaagagactgtaaggctttgaggaagtttcctaaggttgagggaggtctaacaacaatattagtttacattcctcagaatggggcagctgtgttgacactaatcagattgggttgtggtggggagtgttgtggagagagagagttcggtgtttcagataaaaatgcttgcaggtgagtgcttggaaaagtggactagagtactcaaattgagctccttaaaaatcaaaacaaaatgcatagtattccggtgcagaccgcaagaggaagagtagagcagagggctgcgaagcagggcctgtgctatcgtattgaccacgctattgtctagactcctgaactgtgtaaatacaacaggggaaatatcgagttatctaaagaaggaaaaggaagtgcctatttttctttaaaacattcaagcaggcttgcttgtcctcagtagagaaacttgagtttcttgttttgcagttatattgaaagttagcttaaaatgttaccaatttgtttttaaataggattagcttttaagatcttcttgattctattggatccaattttgtccagttttaatcattcagaaaatgatctgtccatcatgtcatacctgagtttgtttgtctttattcatgaactatttcacacacagtatttataagccgcctaggatcttgtaagtcaaatgggagaagcaaaagtctgttcattgatatctctaagtgaagcacaaggttgatgtaaagtggcaagaaatgattaattttaggttaaatataatgtcgtgaaagaaagcaattgcattaatgttgtgattagaggatatttgtagaaattatttccttttatggaggcaaaagagtcatattgtatgtgagaatatggcatgcttatgaaagaaaatagttttatacacaggttttagtttttcacaactctaggtaaatatgtaatcaagagctacaaaaggcatcccttgtctgttttctattggaatgctgctaaggtcgacaaaaaatatctgtaaaaaacatggctgcacttccctacctttctatgtctttttgcatgttgcctgcatgactttcatatccttccaccagtgcatgtattaggttataatttcatggcttgacttccattctattacgtacgaacaactttctttctgtacaggattatgctttcatatctagtcctctgttaaaattcagtgctacatctgagtatatgaaatgcctggcaccacatggctctgagaaccatgaatttaatataaaagttataatgtatagggatttatgtttattagtaactgtcaatacagaaaaagcaatctactattattacacaagaattgttaaacattgggtagattaaaaatgaaaaaggcataaaactccctgtaagagtgaaaattatttaaaaactataatccattctttgacttcaaataaatttatagtttaatttgctagcaatttctttgagttgataactcaaaaactatataagaacactgttccttctctattccttttcccacaacttttgaattcttccccaacccttagcagatttggatttgggggagctgctaattaacaggaaatggtccggaagggaggagaacacaagcaggatataacaggcaaggctgaaggctctacccttgggtacagcggagaggccgcaagcaagctccactccccagtgccagactaggaaagacagagcctctgggaatggtctcagacttggagatagagagggtcaaaataaaggaacttcttcacagatcaagttttaacttcaactttctggcaaaacaaaacaaaacaaaactgggctgtgtgtgtggtgtaagtgtgtatgtgtgtgagtggggaggatctcaaactccttcttagaaagagatatttactaaaattcctcatccggggttttagatgatgaaggaaagacactttggtaaatgggttacagtattttcgaactaaatgggaaatcaaggttcatatatggaaacacctcattttacaaatcagggttaatgatttttctttctgtagttgagagagctatatgtatacgatcgtgttccctttactcagccactttctttttaataccaaggagagatgggatgattcatagtagatgctccaaaacagtttccatgaagaacagttgtacaaagccagttgaatgcaagaaaaaaagtgtggagacagcagtgtaaactccctgtagtccaggtcattctcacttaattgacttctttgtctgcttggtctagggaaaaaaatctgtcctgtcctagtactatttctactgactcaaccatttaaaagatatgggtgtgagttttctattgatagttaataaatgtattaagctgtcccatgttgtacttctgagctagttagcatcataggaaaaagcacagtgggtgagaagcagaagctgcatttttaattagtgtcagccaggtcgtattcctcactccatgctgttgccatagattgcactacttgttttacagttggttgtcctcgagcccagagggaactaggagaaagacatcttagatcacagatcacagatcataccttccttcactactactggaaaaaaaaagattttgagacaataaatcacttatcctttacctcgataaggaaaaccgtgtttggtttggtttgctttttagaagagcagtgattctcaacagcatgtcacacgtacagcagaaagcatcaatggatgtctacattttctagagcaaccaaaaaaatattggtttctttttcattatacgtacattttctgaatgcaaagttgctaaaacattcctcaatgactatggacagaatttagattctgcgttctgctataaagggagtatatatctaatgtcatgagattttaaaaagggatttggatcaaacagttgagaaatatgttaccacaaatacaccctggttttctttgatgtgcatatgattgctctgggtggaatctgagctggtagaatagaggggcacaggtaaaaatccttccttcctagtataacttttctctccccttgaatatttttaaatttctaattgttttatgtcaacaaatagaatgaatacaggtaacaaaaagatacttctgtgaaaaacaacttgatgatttccataatttataagttttactattttgaagataaaaaattgttaaacccaagtgggcgctcaattttctttagatgtatgttgaggaaaatgtcagttgactaatatagcattattgtccagtgccaatttagtggaacctacaaatggtatccaatagagtactacattttgggtctggaagagcatggattcaagtgtcaaggtgaaacatttgattcaaaagttaagttttaaatcttattcctaatcttaaggacacaatttgtgggcccaagaaaatagtgaaatgtggcttattaatgggccaccactctaaacattttataatttttacttatactttttgattaagttctatgttgacaatattcatgaaaagtagtattgagaaagagaaacaggttagaagaagaactgactgactcttaaaaaaatgtttactgagcatcaattatatgtaaaatggtatataggatctaaaaataattaagaaataattcctacactaagaagtttatagttctttgggggaatgagctaagtatgcatgcaattataatacaggagagattttaagtgtgtgagcaagataatataaagcatcaaagggaaagagagtccatgatgtaggaagatcaagaaagtctatatgcatatgtaagatgaagctgcacttggaaggacagatggaaatttccaagttctagaaatataagaaggaatgaggattttaggtgaagaaataagcatcagcaaagggaaggggggtgaggagtgaatgctggtacactcagaagcatcaaatagttcaaatgcaattgaaattatgagacgatcaggaaataaagttggaaatgcaagatagagtggctcagagatgaccataacactgagaggagagtacatttatcatagtgacaatgaaaagccatggaaggatttcgaacagaagaatggtgtaattgtgtaattggagctctactagagagcacagggagaataaatggctttgcttgagattgcctagaagtatgaaaatgcatctctctgcattgcacattggctgcctgttttgcagaaatatctatcagttctcttggatctttggaaggatacgcatggattgtttctaaagtctcatacaacctgtgtattttctgcccagtgctctttttaatagctatggtccctgccatagacaaattgggaactactggtcttggtttgtctttatttatgcctgctattctagcataattactaatagcacaccttttcactttcaaaactgtcccatttagaagataaattatatagtcactctgtaaagaccccattctttatttcattctcttccacacactaacactccaccccaaaatgaaaaagtagtataaatttggctgtaagccagacacaatgattttgaagtaccagccacaaatcattttgattatttcccccactaaaggaaacacttccttccaacccaacagttactgaaaacttataatagtcactgttatatgcactgtgaggaaagaagaaattagtaattcacagcttctagcctccgtgaattcataatctgagggagttatgaggggttcgtaaatgactccagtataaaacagaattggtaaaagatatcccaagttttgaaagagtgaaatcgagttcaaactgtttatgataaaggtaatattttatatggtttgagaactgaaattcagatgtggcgtgaggggaggaaagacattctatgtagaggggataaaatttataaaaatacaagggaggactgtgccagacaacgtgaaggaacatagtatattgatttaaaaagaaaatgtgttggtttaaacactgatatgtatttactatttatgtcaaaatggaacgcttttgtagaaatagcaacaaaagttaattggaatattgatctcactaagagcggaaacctatatgtgttttaaaagtgtgaccagtgttcagaattcgagattcaaaacttcacatactctagggatgatgagtgacatcttgcaggaaggaaaagaaaattagcccgaatgattccttaggctgaaaagttgaggattaccttttcccgttccttagacttctacagagccagatatggtgtcctatcatttatagggacttagtaatgacattttaaaacttatcaaagctaggaacaaaattcaaactgactctctgtgtttattatgagttaattttatttattaaatagtcgtcttagaaataggaccagaagtcttttctctggtcactgctctaaatgcaaatagtaatcctgaagctgaatataagacatttattcagaatgagaatcccagctgggaaataaataacagagcagagggaaatatgaatatcccatttaaaagccaaccccaccaaataaaaaatttaagatattatctttgccataaaatttttaaatttgactttgggacaaggatacatgtgtaagatgtaatatgtaaagataaatattgggagaagacatgtcttttcccacatcaatatcctccctttccacagcctccttcatcacttccatctcacccaagaagaccacgtgggcaattgaagagataataacagggcaggggagggtaggccatggtgggaggaaggagtgaaccagtgacttgatttaaagccaaagggagtggataagagaactgggcttcaagataaataaggagacatctaagctagtactcatttctttctcttttttttaccaacctaatcctccactttcaaaaagtagattttgaaagcatcaaatgttaacatatgattgtcctacagacattaggggaaacagtgaggttccactaaatacaacctccttaaaagaaataagtagttcaatgaagtgtctgtaaaatcttttcaaaagtcttactttatacttccccacagttgatttccttagttggtctgagaatatagcacctatactattcaaaaactattcttttccattttctgcaaaaaaaattataaatttcttatttctaagttgattgattgcatgtttgatatggactaactttattctgattttgaagttgttcaagcttctttttcaaagacaaagtacaaatggatcattgtatggattcgagctgagatggcttcaccagataatgttcacctgtcaatttaaaattcagtcactggggttaagatagagcacatgttggttctaggtgagggaataactggcaagaataaaacatttttggaatgttagtgaatgtgtgtgtaacgtaaattgatatttcatgcaaaacttgtaatctgaattgcatcttgtctgtatttcttaaatggcaaaaagatttccttataaaagctgaaagagggaattttgagtcaagctgtggtgtgttgccagaggcggaaatttatgaaacactcttgtcagctatgctggaaacactacaaaagaaatagttctactttcttattggtgctaaagccactaataggtgcagtttagtataatacccctatgagaattaccacccccgaagtgagcttgccttggaaggaactctgtacaggcattttctttttccttttaagcttgcgcaaaacacccaaaggggccatttcccacccagccagtgatctttctcaagtttattctttctcagatcacagagacaatggggaatatgccctgtttactcaaatcagtctggattagtgtcactctattgatggagtcagaattaaaaggaaaaccattaccctctcaaagggcaacatcagatgtttggggaatggcgtgattacttttaaatagaccgtgtgagactctgtcaccagactgaggttgaggactccacaagacacacttgaagagaaacagtaacactgggtgaggcaggaagctcttcataagccttaggcctgggaaattatttcaacagacaatcccaaaatgcttgaaaggctgaaaatcagaatggtgagacttcagagaagagggcttttctgccttctttctttgctccaacacctcacccccatatatttatctccaggtcaaatcctttccagtcattaagccctgctggggagaaacttaaccctgaaaaagctctcagattcccccattcaggataacacttccatcctctgaactcttttactctgtttcttcctcattgctctctgtgtacaccagatccttcctccctatcctttgactgaagaccctgggagggtagaggatgtgttatgcttatctctgtatcccctacagggccactcagtaatgttccctgaatgtgatgaggacatgcatctgttgctgttgcttgaagggatatcttcacctaggaatatatggtgtattgtatatacttaaagggctgtttgtaattgacttgtgcacaaaaataaataaagcgagccgacatattatacaagcctcttctatctatatgttctgcaggtaaaccaaattgtgtcattttccttcacatcttgcaggtcatttgtttttgctgtttgtttgttttaataagcccaatattatttccattatcttttaaatagcaagaaagtttttgaaagacagggcagatgatttgtttggtatcaagtaattagtgtaaagtatgtgctgctttcacataattgattactcacaaggacagagaatgtgtttgattaaaaaaaagtcttagatttttatcttgctttgcaggccctttttaaaagtgtttacctgtgtctgcactgttcccttgattcagtttatcccctgcagttctctctgtcctcaccagagatgggggaagtttgatctgggtgaataagcttgatgatttgcaaacgctctctccttttaattctctatagtgttatcactaaaggatgtctgagaaacctcaaagcaatttttctcttaaacgtggtattccaacttttggttttgctcatatcttttataataggacaaatagaataaaatgaataagacgagtgtcttttcaaaagtaaggcatgtcttctgcatagctcaaaacttgagttttattttgcagttaaagtgacagctgagaggaacactccaatgttatataggtcaccatatctaattgcaaagtaatcactaaaaactttaattatctcaaatataacttaaaaagtagcaatcagcaaagaatttgacaaacaaaagcaaattagaactcatgaaacagtgttccccgcttgaatgcctatagtctaacaagattgagtagtacactccttgtttcaagcctcagttttccagttgcaaataaaaactagtgtttcaacctttaagtgtttgttatattggagcataaatttatatcatttgcaagaaaggatttataagtctgataaactataatctcagttccttaaacatacaatcacaaactgttaattatggctttattctaaactgaattctggctaactgggcataaaatcatggaaattaggcagggagggaccaattttgtggcctatctaccagaaactaaatgtctttctctaagcttgtttctgggtggtttcttttcaaagcaacctgcatttggccatgtgctccatcagtaggaagtgaataattatatgaccacaaagatataggttcttattgctgacctaggtgcattcgaaacaaaacctagaccatcaggttaaaaaacactgccttggcacaaaagtgtgtatgtgtttgttttaaggaagtagaagctcattaataaacttcccagctaggtgtgagctaccaagtattactcattgtattgtgagtgacaggactggctattctgctactagttcccataaaagctgaagctaaaagcacaattcccacctaccaagacaaagctaaacaaaaagtaaagatcatagagattatttagggatgcactataacatttgtctgacagtagcatataaagaaatgaatcaaatttggacacagactcaggataaaataaatgatcagttgtattagaataaaagagatactttctgcaagtaattttcatgttgaagtgttttgcatttattcttttaagaactgtctcctgagcatctattatgtttcagccattatcccaggtattggggattcagtactaaacaggccagatatattctctcattaacttattgcctagcagagaagaccaacatttttaaaagtttatacatatagttaatttctattatgattatatgatacaaatggaaagtgctatgaaaatgtggaacaaaagagaataatctgtctgaacagtcaaagaagacttctgggagatgacatctgagctaaaggttgaacaaggaattggaaaacagctggcatgtgcaaaagacttgaagactgaaggagttagcctttaaaaaaatgaagaaagttctatttggccagagcagagtttcaaatagtgcctcacaggccacgttaaagacctgaggcctttattctaggagaatagggagctgctcaaggaatttaagcttgagagtgacaagatcagatttgcaatgcctttcaagtggtagttacaaggagttgggtctctgaccctttgcaattatacccattctaactaagaatggggaaacttttatatcctgtctttaatgagtaaaaaaaaaaaaaagaaaaaaaaagcaaataaaagaggtgcgcttttcttgattgtaactttcagataaaaattccaggcagaaatgtgagtgattcctatttacatgcagtcggaatgaaagctacttaggaaagcgggttccggagccagatttactggttcgacatccaggctcttctcactaccttgggcgagttacttaaccttgtggagcttcagtttcctcatctataaaacatggataaaacatggatattaatgccatgtgtctcatgagaaataagtaaaaccatgcaaagcacttgaacactctaagacacatacttagaactccgtaagagaattaataatagtagaagtaattgctcattttcttttatagaggggatggaagatggatgataagtagatttcagagttttaaaatttatttttatttttattttttgctcctgatagtcaccattactttattgaaactgatatgtcttcagtttcatgtcatggtaacgaaagcttattttctgtgataaaatgttaatcacatttaatcacccgttgttttaagtcacaatttaggatatgaactagacaaatatactaccaacattatttaaaaaatatttttaaactcactttccaaaccaaggatgcattactgctgggcttctaaaggcagtatggtatgcttaacataaagatggcttaacattcattgaagaattttattactatgtactttcttcttttaatattaccatatctgctatatagagctatgaaaacatattgattgctatagattgaaaatctcttcaaacatattttgattcacttggaataaactgaaattctgaatatttcccctaataccagaattaaaaattattaaatattaaaattctatcctgctttctgcttagtttgatacttctttgatataaaatgataataattccttcagaattgggatgccttctgattttcattttgttgagttgttatgattattataggagtatgtactaaaataatataattttaaaatttatttttcttaattgagttctacacattttaatttagctgcatttggatcaagttttaattttaatacctttcccacttcctgtcttttcaaatgttgtgtcaaatgtttgttgacattgttgtccacctgatcagacaactttgtatttatttctctcacctgccgttggggcttctagagctctttctcctaaattatggaatcttggcactcaaaggaatcttgacactttgtgtcagaacacaggacatctagtgaactctctgcttacagtcttgatagttttgggtgcgtttaaatactttattcttatattttgttctttgtatgagtatatattaagtattcactttttatataattttagaaaacaaaatgagtgacatattttatacctaataaaatctggttttgagaaaaatgtgatgctacataaattcttcggttggaaagatggtgttttaacttgacgtttgaataccaatatattttcttaacctggagtagaacactgtaagtcaattgtgtttaattctagcataaaagaaaccatcattctctgaggtggggcaggtggcagaagacgaaaaaatgacaagtatgtctcccttaggcagtgcttgttgaaaagtcactatcctgctgatatttggggatggaaatgtagtactctctgctaaagtataattgaatgaatgcttttaaagccagggtcatcaagtaaagctgttttctttacccatgagggactgtagaatgttcataaaagcacctccgtgaagcctcaggtgaaaggtggttatcagctgaggaaactgtatgtgctgcctaaaatgttttagatttctaagtttggtcagggacatctgtatagagagagaacagttaccttagaaaactgttttgaatgtggtcttatagcattgttttaacgtagcttcacagatgaggatggccataagtcacagaatgttagaactggagatccctctcattgaatcctcaaattcagtctcctcaattttacacagactttggattatggtaaactaaggtccacaagttgttcagctaccttgcccagaggtacacagcacactagtggcagtgttgggacttagactccatgtaaagaagtttaagttcagaattcttttgcatcactaggatccatacaggagtgtaaggagtactgaagcgtgttcaatcccctagcctcatccaccagtcactcatggattataaatacaatttcttccaagtgaaatttgggaatactgttgtatcttgtaacaaaggtctggttgaatcgagataagttatgattatatatcccaacagtaatctcttctacccctgatttggtccctatcccatttttttaataacctcttactatatattgttgactattgttgctatagtgtcataaatttactattatagatagtaatatctgaaaaaggggacattttaaaaaattctcttggccaggtgtggtgtctcacacctttaatcccaacactttgggaggctgaggcaggtggatcacctgaggtcgggagtttgagaccagcccgaccaacatggagaaaccacatctctactaaaaatacaaaatcagccgggcatggtggcacctgcctgtaatcctagctactcaggaggctgagggaggagaatctcttgaacctgggaggcagaggttgtggtgacccaagatcgtgccattgcactccagcctgggcaacaagagtgaaactccatctcaaagaaaaaaaattatcttttacagataaattggtggagagagattttcaaaaacacaaattataggtaaatacctatttctattgcattggtcaaatagcttcattggaatctctttttgatgttaaatacttttataggaaaataattacgtcatcaactttaagtaaatataaatccaattatttaatattgagttatagcaatatatattgacacagttttgtttcttcatggtgaaaacagtttgagattcagctcctgggtatctttatacctaccatgcaagctgtatgtttcagaatgccctcagggtgttctatgattgcagggaatatgtcgagtccatgtgaccaaggcgtacttcatcctttctgtgatcagatcagctagtttgtgaggaacctgaatatatcacaactacaaataaattttccagggtccaaacagtgattcttctatttcaaagttattttatagaaaatgaagcatctgtttggaatcacaggaaattattttactttataagtttcacagtagatatcacagaagttgtgttcatttttgcctttatgttttgtggaaagaatactgcctcttttttcagacatgctgagatagatatataatgtttccattcactcattatttgggtgtctgcagggtatgttaaggttattccaaaatcaagatgccttgtgtttagaaagggagaacctgcttcctatttcatttcagatacgccaataacttttgttacctaagaaatacatgcatatgggacatgggggctctatggagttcttccaaaggccgtttttatggctgatctgaaagtatagtgttctaatctctgagactgactctttgacttgtcattgtcagtaagcattgcattaacatcccagcatattacacatttctctcctctgttatggaattattggctgtaaataaggcaagaggtactgctccctttaccccgccagatttgctgtgatagaaaataagggatagatattattcacttgacctgggacagcttcatgggcataaaaactgcaattggtcacacagggccctatcttagaaaagcaccattctttgtttaatgctttgctatcatcattttgaaattcttaatctatgaacaagaggttctgcattttcatcttgcactgagcactacaaattgtacaaattgttttgctggacctgtctgggtgacacttgttcttcttgactataatggccagcccttggcttccaattgtaccctgttaacacacgcgatctttctttaaatcaaaggaataagtgaataagaatattttctttaaactagatattttaaaaattaacttctgaagaatgaatttattgatttttaataaactaagaaaatatgtaaatggatttccagtcattcagttctgactttggtgggtttgttgttgtttctgttcattttaagctaacattcaaagttagtagtgtcagttttacgctttccaggaaaagacaacggagtatactacttggcttatatttctgtaaagtatcacttgagaagcgtttcaactgaaatgtgttttcccactttgattgtgtgtagtaggctgatttctcatcaatcctaagaaatatacctttatgttatattaattgaggatttagcattggtaacaaatcttgtttttcttacgtacaaaatctcccttgggactggatataatttaaaactatgacgcctaaaagtagatccatcagtacccacattgctattcatgacttttgaaatacagtttctgcttctttgttgcttctcaatggttcagtctttctatcattccaaaggactcttgtgactcctcagtaaatggaattttccctttcttttccttaatatccataaaatcagtttactcaagaaattatatagcagtatacagcctaaaccctttctcaaaattgtcactagcttttcttattcattaaaacattttcatctcattacaaatgatttcttcctttaaaatttcccagaaagtatggcctctgtattttctgctgctcagtttaaacacatcatcaaagacagataattattaatgtcatatgagcataacaggagatttataaatcagaaatgtattttctgggaaccaactttcaagttagtcaggtaagttttattaacttcactggtgaagtcctaggataaagcagtgcctagatcaggcttgtttacccttggccttatatggcaccaaacactgtttcaggacagtggaagaacagcctgggaggccttcggccttggccagccttgccgaggcccgctcaccaggagaaataggaaggaaggccagtgagtgtgcaaaggagcatggcttattttgaggtcctgaaggccagtgagtgtgcaaaggagcatggcttattttgaggtcctgctgattgcaggccaacaaaacaatggcaggatttgaaggaagaaagtattgcaacagagtcaccgtatactttgaactgcaaagggagactgaggaaatgttgcctcaaggccaaaaaccctggctcaaaacacaggttcctcaggtgactcagaggcagaccaagttcaccaagtcaaggacattttcctgctacccccctggggagaggggccttcaccaaaccaccctggacatggatctcctgctgttcagaacccacccaataaacaacagaagcaaacactttttttttttttttttttttttttttgccccttacacggaattgtccctttttgtaagtccttgttgaattgaagagtgtttgctcactggcttttaaagtgtggtcccaaaacttttttcttcgtttatattgggttaaaaaaaaaatcaaggggcccatgcgtctttgttctcatccaagcccacaattagttagctggggttccttctgtgtagctagaagcaggagggaagggggtggcccagcaggcattttactgcctgcgagaaagtgctgtgagtttctttgtcctttttgtcagggacggctgcctccctaattgtactgctgtagggaggcacgtgcctttgggagcattatctgattcctacaggacgttcaagagtgctttgtatactgacccttaacttgaacacaaagaatatcttttcaatccccttccgaggctgttgcctcaggcttggatacctaagagctttagttcagccggggtatggaccatttatatgggctcaggttttatttttttgtcccctagttgtcttacctgcagtttggccacacctgccgggagagaaagctgaagatggtgggtaagtggtggatagcagctatagaagtcagaagggagagaaagcgagacaaacagctgctcttgtcagcatggggataagtgtaaagagattaatagttatttgaagagcaaatggggacatggcattcggcagtggaatgcgaatgcatgaatgtaatggaatgagcatgtgactattaacatttagacaaatgcttcctggactgaatggaatggcaaagcccacttctcctccccctgtggaaaaaaaaaagttcaataaaataattaaaagtttgaaatttttaaaaagataagcctagctcctatttctttgtaagtttgttcttctctatagttttacttaatctgggactctcagttacatttcaactgaagagctaggcctatttcctttataaaatatgtacgaataggactgccttaatcttgcttttgatttttttttctcattcattaggttgatgaaacaagatttctatgtgtcggaaggttttacaaaggaaaagcaactgtaccataagctggttgcccctttgttcattttggctcaggtttagaaatgatgataggctgatttgcctactcaggctgacagttttgatggcatggacagagccctgaagtcagaaccagaagattcagcaccgaaagccccagtcattgtgttagcagatgctagggcaaatgctctacctctccgatagtaatatagtcaagttttttgtagagtaaatgaggcaaaattaatttattctttcataaatatgttcttgagtacttttactctgtgcttgggcccattcacatagaagacataaaaacgtttggcagaaggaaatacatgagctaatgtatttttgaattatattgaccatagaattttcttcataagtagttggtatttctcttacaaatgttctactctagaaaagaataaatttctattaagaaaatgaaagaacaaataaaaaagaattagaccagtttggatgatttactagcatgttactttttaaaatacatagttgggtgtccctaaccccgctacccatgatcctccagtctttgtgaaaccagtccttagggggctgggtggtacactcttggtactctgggacagaatgcagaattgcaagattaagagaaaattcgaaggtcatttgattttgccccctatgcaacaatttaacacttaaatcccctctggaacatacctatcaagtggtctttctcattttgtgtaacacgccccaacccccaccaacaacctcaaaatggaataacaggcagtatttatttaaagacttcctaagcagctactgagcactgggaacgttttgcctagtttgtgaataagcatatactctactttcaaatgctctgtaggaagtcagtctccagaggtggcacatagagctgagtgatctggaaaagccgttacaaacacacacatgctcagacttctcttgttttctctgtttaccaaaaatcaacggttttactttgaatgtgaagtgcttccgacgtgaggtccatctctgtagaatgcattcacccatggatgcctttttttggagcaatgatccgtggcttcagcggctaatattggggtttctgggtgtccttgcagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacggtaagagcagcgggcacgcacatacctgaccccccaagtccaaggatgggcttcaccacgtcccagggatttctcccccttcccagtttagcgattccatgttcatggtggaaaatttgtctttgaatatttaatactgaaccagagagagagaaagtgccagttagtgggaaaagtcccaatttaggaaccaaacgtctgcgttctagccagctcctggcaacttcagtcagtgtgttcctgcctgcttcacactgttgtatgtgaaagttcatggcaaggtaaagagcgctgtgccaacaagaagtatcataatcatgggatatgtgtttacagtctccagaacgtgaacgtgtttaccagtctcattcttgtaaagaagtaagtgtcacattaagttgtgattttaaaaactgagtaaaataataaatatagtgttataaaaattaagaaaataaaatcccatttatgaaggaaggatgaatatgtttatacatgtaggtatcaataaattataatttatcagtaaattgtataatgtcttataaattactatttataatttatcagtgaattataatttattgatatgtatatatttatttaatttggaaacattcttttcgaaaagaaagcctttaaatagacatatcagagccctgaattagtccaaagaaattgttaaagaaaaatctttctgcatataagttttctaaggaagcatggaattttcttttcataaattaggaagatacaagaattagtccaaagaaattgttttaaaaaatctttctgtatataacttttctaaggaagcatggaattttctttttcataactagatccaagaatattttatttcgaagtgtattttgaaatgtattataacaagaataaagctcaagtataaaagaggacacctacaaagttggttttaactggttgatcaaagaatgttcaagaccaaagtggtatgtttgtcaaacaacttaatcaagaccaaagtggtatgtttgtcaaacaacttaatgtttacatggattatagaaatgcttccaaatatcatcatcttaataaaaagtagctttagaattgttttgacagttttttccctctttgacaaatggatttctttggaaagcatttctatgtttatgttatatatagtatctagttcattccagcctttagtttgtatagtttataaaatgatcggcatgcctaagacctattacactctaacatcatttcacatccatttcctctttttcacctcatttctttgtgaagtacccaggacaagttttataacttccactgtgctagtgaggaaagctgaagaagttggaggttaagttaagaggcatgcctaaacttacagaaacttgtgtgtagctgggcctgtttttcatttctgcttccctctcactggattgtatcctttctttcaaccattttatatcaggatctcccaaaattgtctaaaaattaatgttattttagttctttcctcttgtggtttgagaagtaattctccggtggctcatatttcaactgtagagcatgaacatcagcttaaaacttgatctctcctccacgtgttacttatcaatggagtcataatccttagtttcctttacttttataattctggaggcgatggatactgcaggtgagtaaacttagagtttataggcttcaaatagttggttgattgatctaagtagtatcttgctaaagagccactagaataaccattttataaatggagcactgatatctcttaggtcaccaaccggacatttacagtcaccagtcttcaaagctaacagttactaattcagtttactccgccaggtctccattatattaggagtcagcatgtctgatgagatgatgggcatattagggctgctaaatgaataatcgctttttttccctgtaaaatttttagaaaaccatggggatgaatcttgatgtaagttcaacatcaaattagttatccttccctgtcccttcctcactacctcctcatatagaaatcttaaaagccgggcgtggtggctcacacctataatcccagcactttgggaggctgaggcaggcagatcacgaggtcaggagttcaagaccagcctggccaacatagtgaaaccctgtctgtactaaaaatacaaaaattagccagacgtggtggtgggtgcctgtagtctcagctactggggagactgagaaaggagaatcacttgaacctgggagacagaggttgtggcgagctgagatcgcaccactacatgtgatctgcctgcacaatagaacaagagtccgtctccaaaaaaaaaaaaaaaaaaattaaagttattttcaggtttagcataatcctaaaccatcactcaaagcccctctctcagagaagtcaattgtcttactcaaaaagttggagatctctaccaaaatgttaggttcaaaagaaaagaaaatattctggtacactggtaaaatttccttacatgtgacagcagtaatatcagtgccctgaaaaaagggatacactgtggtgatgagaaaaaggcactgactgagagacagaaaacctggattatggtcttgatcatttatgcaaacttagccaagtcacttgatctttctaaaattcagtctgtgcctcagatgagaaagaggatgagaatggagaaacctactctgttttcttaaggtgagatgatagtattaataattaacgtagaaagtttttagaagggctttggttcgcatcgatatattgtctgccattcatgagtgtccttggttaagtgattttgcttctcttggatttttgttcacttttctgcattctacctataaattttacaatcaggtttctactcacatatcacatggtaattatatttttattaaatttctttcttgttcacaaccaggcttatttcaggcccagttcatttcttctaaattagggcacttgaacccttatctgagcagctactgagatcacctaaaaagatgtaagttcttcgtcatggatacctgcatcttagcttctaattctttgagccaaattatatatcctcatgtttatacacagacttcccattttaaaaagtattttttcatatatttatcttagttgagcctcataaccaagtttgtaatccccagttttatagatgaggaaacttgaagatgtaaaggtcacatggctaataaccagccaaggatggggaagaatccaggcctccctcaccctaattcaagtctctccaccatcctagttagactgtttctcctctggtttgagaccagggaggggcatacaggagcaggcagtgcctgtgtagtttggagcttgcctcttatgtcccagagtccaactggtaaagaaattttttgtgccttattatacaacacctatttcttaggcatttgtgcattttagagcaatttttcaaaataaaatgctgcattttagaactgcccacaaactgaaagaaacagaagctgctgtcattagggggagatcatgcttatcgcatagtcttctggtaattctttaataaaaatatttttagtaccattttatcacttgcaatccttttatgtcaagttttcttttttaacttttctggttttaccctcaggattactgtcaaaatatagctaatatatttaaagtatatgtgcatttttcctttgcgtttctgtgttttaaataacaaatgtgattatgtttccagttctacaaaaatatggtatttattttaaacttctttcaatgaaatgaagtaaaataagacaacatttttcatcttctctgtttcacacacacatacatacacgacaaaccaacgtttactttagtttcagattttcttatttccacaatttaattgatactagttacagaggcctatcatttaatataatgtagtgctggtctagcattgtagttgggaatcgttaatcataggacagttgaaagaatggtagtgtggagatggcaagaaacttaaattcagatttcaactcggaaacttactaacagcatatggggctttcaccaaaaattcaatctctctaaacctcacttttctcacctacaaatgggaacaaatgggaacattaatactttccttatcatgaggattacttcatgtaaacatacctattagcacctagctactcatatgctcccaagtgtttattgggtctgaatttgaatttcttcggttcgtgagttcattgtagttttgttgaggcttcgacaaaactttagtacctttagttgtactaaaggtactcatttgagagaatgaaaaataaaatttcaactaatgttttttcttaaagcttttgggctattaacatgcatactttatagagggactgtgatactatccactatccaaatatatgaatagatggtatagggtgataacagcctctcctgcatgcagacttctgcaggctggctctgctgctttccgaagcctgcccaagcagatgtaggctctccttgccagtgcaaggagaggccctttccagatttaagaacctgttgatttttgacattcgttcctcatttttaatctgatgcttcatgatgggaatgcctttttgtattctttgtgttaaggaataacagtgggccttacttatggcagactcaagatattaatgtataatgacaaactactggaagcaacctgatcagtcacccgtgaaaaactagatggcatgttataagcaataaccatacggccattagaaagaattctctgtactgataaggaaagctttgggagttgctggtgagggaaaaagaaagctttctgtggcacctgcttgagaattgagagtcctggtaaggaaccccacttgtaggggcggtgtttctttgtgctcccctctagtgatgaggcttcttggtgaacatagttcagtctgtcttgattattggcctcacacacctttgccagttggagagctatttttcaccgctcatgacacgagagtactctctgtgtgcatacgccatgaaaatcctcaggttgtttttttttttgcattgttttgttttttaaattgtgttcagactgaagtaaggaccctacccttgggacataggatcactttttgctgttgtatctttctcctgtcattgacctcaaggtcttgtatggcagactccctgatctagtgcccagcacaatgtccagcacacagtaaacctttaataaatgggaaggaactttttttctctcataattaaaggaaacaattgtagttcccagcaggagccctcaattctgactctgattgttaactgcccgtgaatttgttccctgtagccttcacccatgatttatagagagtgttcttcctttgcctttcttaaccatgccagcttcgtgtcatgttcagagctgtggagaatttgacttgagcaagtggagagattagggaggtggcgtttgaaaggggaacagccagttcccgggagagttccattgatcccagcatatgggtcttggtctcgcaagctcactccctttggctccgcaggcaggctgagatgcgcgcctgcggcccaccctccctgtcatcaggttacctgtaatgtaagacttttagaaaaaggctgccagctctgcagaaatctaatgcaacccagccaattgcgtggccctctggaatttagagactcttaagaatagcccatcaaaggacaagatgtacagacaaactcttcgatggtaaataggatttatcagttttctttcacagtggaagcacttcccccattaaagtctgagtctcatctggggcttgatctaatcttacaattcagtggctgttagattttattggtgaggggcagaagtcagtagctcgtgccactggtacatgtgttcgtgtttatcataacaagataatttttacttcttgccatagctgtttcataaattatgtgagatgtgtatcaggtgcctttttgtgccactcccatgatgaagaaaataatagcattgagcatattaatctgttatctaaactatttcttagttcacagagtattgaggaagaatgtactaaataaagtgcttagagatttttggtgatggttcaagtaacttacctctaggttttggatttaaaatgaatattcattgtaaggcatgcttccgaagagttgttccctcatccagagcagaataactgaatcagcgttcttgcctgagttttagattgactctaggttaacgtattcgtgatgagccagtttaatctaatctaaggcttatcagcctcccatactattttgagtgatttgttcactgcaccgtggagtgtctatttaacattaaactgatcttgatttattgcatgtgaacattataaaaactattgattttaaaaatgaataatttaaataaagcttatatttcttttcctactacaaagagtaacagcaaaaatcctctgcttttcccttttcttctttctccctattcttctcctcttcccgcatttcttctcccccttctttctactccctccttctctttttttcttcatttatgttattattgttagttaatttggttttgtaggtatcatcagctacatggtatctttctttatttttttttactatagcttcactcttctccataaattaatatggagaacatgatatatatcaatcaccgtggaaatttttatcaggattaaattatcacaaccttttcatgtaacaaatcactttggtgaataataatgggctgctttagaggtagcaaacccaaatgtcattggggtcagggaggtagcataaatgagccgaatgataagtacagaaactgtggcaaaagagcttatatactgtatctacaaggacatctgctttacaatcccagactgttgtcacaggggaaagtagacctagtattaaaatatttaaaatattaaattcattatcacaatattaactcttaaatattaatttttaaaagagtaactagaaacctgggtttgcatgtaatatcttcatatcttaaaatgatgatactaattcaaaaaaaagttgtaaaacactgcaggccaaacaaaacagtacacaggctgcatgccatcctgtgcaaggtgttaatggtaacaaggggagattactaaatgtttaaataaattaattggaagttagttattaaaataactaaaataactggaatcagcatctaagagaaaggttactagtgggtatattttattcacaagtaataattctttattcctttacaaagtcatatagattaatctcttgctgcatttaactaagcaatacattatcagaacatatttttctcaacttgttttcttacagcaaatgacctttctgcttctcatttttatatcattttatattttaaaaatctaatggtatgcaggattggatacttggaagtttattgtttgtttgttcctgtgcttatcattagagaattatggaactctgtaacttaactccttaaaattggccaaagttgcactcacaaaagagctttgagatttaaagggcttctaatcaattttctcagcttactaacagatagcttacttttaattggcacatagtgtgccagaacaaaaatcatctgataattgaagtataaagagaaaataatgtcataagaacttttaatgactctggaaaactatatcattaagctcaaaagagatcccttaaaatgaatgcaaacttaaaatcggccctgagtgatgtgtaccatttattgtgggattgtcgctcttggtacatttccatacatgagctttgcacattctcctgttcgcattccccaaattaggttatttccataacgtgaccaagtctatgcaattgttcctacccgctttggtaaagggccgatgtatgtttctcatgaaaagtcctcagcagttacagctgtcatatcgcgagtaaaaccatataactatatataaaaaccccctggttttatattagcagcaattggtatgtctagtcaggtcactgtgactgaaaggagacttgagataatgtagctttccaacaacttccaattcttcaaaattaaagaagagtttattgtagaatagaaagatagaaagataattcttcagttctttgaagccctgcagacattttgtagatatggaatggtttttagaatgatggatcctgtaatgaggcacacagaggcgtaaaggtagtgatcttagtagatttctctcttgtggtttttagtaacgatcatgaccttatcattaggtccccaacgtgaaatttaaaagaaaatttgatagtagtcagagaccctagatctaatttattgtgaggtaaattagggagggattctgactttacagatagaatgagacttctcattttagtctgaatttaataatgaagattcatgtggggggaaaaaaaaaaacctacaacttgccaccttgttattgtatcagaaaggcctgaaaacagagcagggaccttaattgctaattgtgttagtaccaacctttcaagttcattgattaaataggagttccttcttggattaatgcctaagtttttatttttgttttgcttcatgtgctgttcagccagtatcatctgcattgaatcttataaaaactataatgaataagttggggagactatttctaaagacttttcctttgagtggtttccaagttgtattaaataagaagactaatgattacttaagggttctcatttgaatttgagaagacatctgacaggctcctgaggagtgtgactcattaagtagaatacgggactcagaaggacaactttggggtactaacaagctatatgaactggggcaggtcttttgtctctgtctgtatgttaaatgagtattataatttttacttggcaagattgctgtgaggcttaattaaagtttataaagtgctttgggagcctgagagatgaagctctaaaaacataatatgttattatctcatcctggatttttgtttttagatttacttgcttgaatctgtatcataacgatgcttacaattcaggcagttttctgaggttttttatttctacaaagacatgaaataaaataacataaatatataagtccctagacattcatatgggatgaaaaaattacacataatttttttctgatgtaaaagagtttcttcttaaaaaatgtttaattgaatcttatatctgttaaccagctttatttttttaaaagcatttcagtgttttattcgtaacatttttgcagaaccagtaaaaagttttaaaatgcagtcatctttactgggtcatgagaagaaaaatttactccatttaaaaaatgtaaatacttatttaaatgtaaataaatatgcgcatttagatatatataaatataaatatattactccaattgaataacaatggaattgatttacagtaattagaatttgataatttgggcttgaaagatattcctttcttctatctttctgccttacttttttcttctactgtgtgttcatttgagattttcatatttataaaatataaaaatgtatatagagccctggagttaatataaattgccttgaaaattctttttattcctactttgtattcttgaaagaaaaatcatgttttcccataagaacagtgtcataattatggataaaatttctgaccaagctattgtcatcaagtaagtaatagatatgtttaactctatgtcataaaagcaaagctattaccaccataagccagtataattattggaaataacaaaatgattctcattgtcatataaactttgcttaaatattttatatgccttgacatatatgtattaagtttacttataaaatgttatttttataaacttatctagaactgactgctattataataaatacttttaacattttgacatgccataattttgatccatttcatggggaataatttgagaagcctatgtttctcaaaattttcgtaggaaaattagaatggatacttgtataatatattcctgttactaggaatgatgcttaaaaaaattctatagtgtaggtcagtcttcattttaagcaattgaatccatttttaatgatattacttaagaattttgcttgtaagaaaaaaaactgtatctgattgaatttgaaaatgtagttttggagtgtatttactcttcctgcctgataccccactccccaaaacagagtagtcttgaggaaataaaaggtcctcaaaggcagctagatatgagaagagtttgaattgctagtggggaaacttctagacctttgccttgatgttagaaaaggaatttgagaacatgatttatgtgttagacccagagtttgtctttaaacacaattcaagtttatcacctttcttataacctttctatacaaaaccatggatttagtgaataaagcatttggaagacggtggatagttgatagataaagcagattgaccaacatgtaaaaatagaaagtgttttcatagtaggaatttggaataactttttctatattcccatagttagaatggatgcctagaaaatgtatccttattgtgatgattaaaaatctctttttgaactaagacacgtaagatagtaacctctttctgctttgcttattctcccacccaggctgtgttgaagttatataagtataagcaaatgtgcactttttttttaaattttattattattatactttaagttctagggtacatgtgcacaatgtgcaggtttgttacatatgtatacgtgtgccatgttggtgtgctgcacccattaacttgtcatttagcattaggtatatctcctaatgctatccctccccccttccctcaccccacaacagtccccagtgtgtgatgttccccttcctgtgtccaggtgttctcattgttcaattcctacctatgagtgagaacatgcggtgtttacactgttttataaaatgcttttgtctaattttgttacctttaagtttagctacttggcaaataaacatttttaatactgcttaagtcaagtcttttacaaatagaattgtcaacatccaagagttaccaaaagatacttcattctttagatttttattgttctttcacagtactcactggtaatggattatattttacctttttttttttttttttttttctgagacagtctctcactctgtcactcaggctggagtgcagtggtgccacctgagctcactgcaacctccccctcccaggttcaagcaactctctgcctcagcctcctgaacagctgggattacaggcgcgtgactccatgcccagctaatttttgtatttttagtagagatggagtttcaccatcttggccaggctggtcttgaactcctgaccttgtgatccacccgcctcggcctcccaaagtgctgggattacaggcatgagccaccacgcccagccctattttacttttatctattgtcaatgactacattgaatacttttgtatgcaaatgtaacaaaggcatattttgcagttatttatactttatgtctgagaattatcacataatttagcaaacattaactcatctgtttaccttttgctgtaaaagctagagcaagtgatgtagatggggacaagaaaatgactcactcagcctcagaaccacaaggaactatagacttcttgcagtctggttttctcttcaaaaagcaattaaatatacgaccatttgtataagtttccacaatgcattcatatttcagaactgatttcttacctagcacggcatggatttcagttataatgtttctccttgcacaagcatggtagacatggggttagtaggtataagaatgcctctgggaacaatcttttaaggttttatagactcttttctctcaccactcccccaacctaagtgtaattgtcatcttagacactttgagtttaggggtggagatagggagagcatcatcagaagggacaaaaggagaaaggggaagtgaaatggtttgttggatactagtgagtggagccttttacagaagtacaatgcacgcattttacatttgttagttagatgttttctaagatggttttgtagctctgatggtatatttttatggatataaacttctaatatgaggaagagacccaaaccaattcaaatagcatgttaaaattcaatctatctacaatcttcacgtccttgattattacattctgtaatctcatgggtatttttgcttccaaatataaggacatacctattatttccttcagttttctttttaggagagttgactgaactatttcaggaaagaagatgtcttactttcctttgcctagtaagccttgctgctttttgaacacagtgcattttcttcaaaatatacccactactttaggtggtcttaatgaatgaataatatgtaattgtgtatacttttctaaaattctttgaaacttccaggaaggaaggtctcattaaatatctatttgaattttagtgaaaagaacaaaaaaaagcaataacaaattaagacctttgattcatgtgtactagcagtggttttattttggtagctagtgctgtgatgtaattgaagcagtattttcatatagaagcattttttacttttatgttctttctacttgttagaagtattcttttattatggttacttttgaatgtatgtttcccttgcactaactcagaatacagcctcacttcacagcgcttagatttgattcctgcattcatactgtttgcatttgagggtcctggtgactgcagtaatctccacctcctccagagccagagagaaagaaatggccacagctactttgtcatcttttgtcactggtctcaatagagggtcaagcgtgcttaccacatggaggatgcttcagaacaacaagggaaagaattagagtgttgcctgggtactgcccacactgctatatgaacagtgagagaggttatattttcctaagcctcgcttaaagcattcccaactaacagattttctgtttctaatggtttgaacttttgtttttaagttgttatttgggcatgtggttgtagggcatagattatctcctaatttattgctttcttaatttgacattggaatttagacttcagaaacaaaaaatgcaatactttgaattatcttctttccataagttcctgatttaaaatgaaaatgtccccttaactgctaattacgagatatcgtataaagcatatgatacttacagtatatcttttttggttgttttataagatgaagattacaaatatgatatttagcacatcctggctcttcttgaaagcagggactatggctcttttactaaaggacaaatagtgcctaaggaaacaggagggtgtaggagaaagaattcagctttgtggtcagatagacctggggggttgaatttcacttctctctagctgtatggtgttgggctaaacactgtctctagagcggcttcctcacctttcaaatagggatgatactcctttaggtaacgacgttattggtaggatttgatataataagtataaagtgcctaaaacaatgcctgtaaatggtaatttctattaggatggatcatagatttaggattagaatttacactaaacctaccttattcatagatttgtccagaatcatagcaggaaatctactccataaagtagctctagcctctggtgcctagtagaggtgatgtattaggatagtactttaaaacttttaccccaattaagagcagaggaaaatgaatggctagattagccatcctgagggtttaatctgaaatggtccatagaagacatatcattttctttctgaaaaacttatttcaactttgcattcaaatataaatatatatttcaatatagatatttcttcccctcattaaaaagtctttaaaattgttgttccaggaagatgagtagtatttatcttgtaacattgagttattatacccaggcgcactaccaggaacacttctgatgtacaagtgccttcaataattgtttcagaagcacaattttgagataagttaaagtgccctgggaaagagcattgtttatttttggagccttagcccaaaatgactcggactcatgctacaaaatgataacgctcttcatcagttgtatagagctccttctttatggccagctttcctagagatattttagacttctttagatgtccccaaaggcacaataaccacgtaagaagggaagccacaggaaggcagattgcagcagaaaatgaatggtcagggttctctaggggtggctgcactgcctccagtggtggtgagttctccacctccagagagtgagacacccttgactcaagttttagatgagagaaacaatcaagcagcctctgaagttccccttgaattcaaattctttgcatccagaagagaagtattttgtgaccagaaagatacagattgactgcaattgaccttttctatgccagaccattggttaactgaagagagtagactctccagacaggcagtggactcagcctacaccaaaacacacagcaagccttctgtgcctttccccaggacagtgactcttcttttctctctgaagctgtggttctatgtaggaaactacatagggtgaagctaaaaggtaggatgggccagcctatgtagggtaaggctttttaactctatcgcatgggcagtgtgctgacattgcatactttttcagcacctcttcagatcggtatataaagtagattaacctgacagcagatggcggttggttggaggggcctgcagtaaaggagagcagtttggagaatgccacggcatgcagacgcacactgtggagctgagcactcagtcggtgatgtggctcactcaccaggggaaggacagaggtgagatagggcaagagtcagttgctgaagtcactactccaaagggctagatagaaaggtagggaggaggaatggagagccagaaaaggagccaaaatgattagctattttactagagcaggtctgtcctaaaggcttggctgccattctctagctgggaccttgacgaatcacttcctccctagtgcctcagttttcttgtcttcaaaatgaggatgatgctacctatcctgaagggttattgtgaggattaaatgagatgatggggtgaaagtgatttgtaaactaggaagtctatcatgcaaaccgcatgatagacttcggatagaggcagcaggtatacctttcagctttctgtcttgccaaatgaacatttgtatcctctcacctggtgtccaagatgaaggtgctggttcagtgagataactcttatccagcctaatctcaagacttcctttcatgctctctctctcacacctagcaataaatgccaaaagcctaatagccccccaaaccttgatcgtttcaagaggatcctttcaaaggaaacctgcctttcctctctccttgaggagaaaccaaagcagtccagtgaataaaattcatatttttctcccaggctgattgaaatggctggccgtgggagcccagggcctttttgtaggactgttttatttatttattttattattattattattttttttttgagacagagtctcgctccgtcacccaggctggagtgcagtggcacaatcttggctcactgcaacctctgcctcctgggttcgagccattccggattcgagccattctcctgcctcagcctccccagtagctaggactacaggtgcctgccaccatgcctggctaatttttgtatttttagtagagttggggtttcaccatgttggccaggctggtcttgaactcctgacctcaggtgatccacctgcctcagcctcccaaagtgctgggattacaggagtgagccaccgtgcctagcctggacttttccaattaggctgtgccggggctgctgtgaaactgttttcctgtgaagacagtgattttctccttagggtggctgctgtcacacggcactgcccctttccttataatacttgatcacagacacagtaacatctgtgcctagatcacaagccatacttactcaggacgattttcctcttaaagcaccagggagggagaggcccttgtcagaattctcacgactgaatcattgccatgagctaatgtctccagttttatgagtcagtgctggcccaggcatcggttttgtaggtttaaaaaaaaaaaaaaaaagacatgggttagactcccctaatatcagtagcttgttcagggggaaagcaaactgagctatcatcagacagcagcattttagaaatcagatgtttggttcctctcctctgtaaggatatagaataagtggaagaatttcagaattaaaaataatagtaataaaagctctctgatttgtgcgtgtgttttgttttgcttctggcaaagaaggtaaaatggtgtgtttgggagatgaatgttcttgtaataggcaagatgtagcttgcaggagaacatctgcaacaaacccttattctgcatgagatacagccaagacctgtttgtgtgttagtgcctgttcaaacatgtctaatttttaaaatgatttataaagttttggaggaatcaccttaaaatgttatttcctcatataataggcatatacattcacagcgtggtggctaaactatacaccctgttggagtttgagcagtgccaatattgagctaagtgatataaaaatggttatcaatatgaagtagatagaaaagtattaggaatatctgcaatcattcgtgagtctaccgattaatccagcagcaggcaaaaataaattatgctttccacgtttttaaatgttcttggtagagaatttatgcaaagaataaaagggaaatacatggatatttgcttcaaaatacccagaggtattgctcaaaacttgattaaaaataaaataacagaattggggatggacgtcaataagaaagaataagcttaaataatatcagtatctattaaacaacatgatttttaattgtgtcttctctattctttccctttatcatatatttacacataataggaaatgccttttaggaaagatagtggaagccttctcttttgtttttaacagccattgcttatgtagtgctaatgcatcttcttaaatccacgtgctttaaaaaaaataatattttatggtagtcatgtacttctcaacacatcatttggaaagaaagttaggggtatgcgctgtaatttgtacccagtattcagagtttacaagaaagattgctcttccctgcagcctctccacccttccccctccttctctctctcccccacttgcttcttgctccttgtttctttctctgaagaaggacgtgagctacatggaggacagggcagaaaagggaagaaaaaaataggaaatggtgagaaaaatattaaggacatttaaaacttaaagttttatggttctttttagctaaatgaatcttttgagcttccatgggggaaattagtgtaattaaaattttctagttcataaaaccaaatctttacatactgactgagcccactgtaagtattgactaaggcaaggacaaatgttatcctctgacttggaaaattcaaaagaagcattttgtctcttaaatgaaggtaggttgattatatttgatgagcttcttggaaaaggcattgattagtccacatccagaaatttaacttcccttttgcttatactacttgaaaaatgattttatggacaccgtgatgtaaacaatgagtctctctaggaagggatactgtgtatattttttgttttatttttaactttctggcattccaagacacatacagtgtttatttgagggaaatattcgtaaaatagaatacgaaggaactattccaaagtcaggagttgagtgaaatatcccaattaaaaaactgaaaggattgtttatcagtaagttgcaggatatgtgtagagctccacaacatgaaaattcagtattaataattttggcttgaaatattttcagttctatctccttataagcttcagaattactaaccaccgaaactggtgtaactaagaggacgcatagcatgagtctcataggatctctccaactggtgccttgtaattttgtatggtatgcatgtgcacacatgtcccaagatgcgtttgttgaggcttagttgaaggccccatactatgaggtctcaaatgttagagttcactgaacagcacctttagtttcaacatgcattttctaagcactggaaggtacacattgaagaaaaacagatataactccacagttgactagctgggttgactaggcaagtgacctgatgcttctgagactcaattttctcttctgtgaggtgaaaataatctccattgaaggcttttgaaagttcaatatatgaagcccataatatagttcctgccactgagcagggccttgataaattgtgctagttattattaaggctagacactattgggtaattatattaatagataagttagccctttctcaaagagctcacagtcaagaagggcaaactgataaacctagttgtaatttagtgtgacaggtgctataatctgtctggaatgttcccctagccaccaccacctctgtctgccaggcagacacctacttattctttaaaactcattggaagcattaattgtagatgaacacttgccttgtgatacccaccccccaccagctcccccttacagacacgtactcaggagttcagaggcagtagctttgacctttcatctctgggtcttagtgctggcacatataatgggtcttaacaaatatttttcaggtaatacctattacctaaacaaagtggaatgtagtacagaaaactgattttgctagtttcacagaaaactttgcatttaaagttgggccttcaaggataagcaaagtcttgggaaaaataagaatagatattccaggtagagggaccagggtaagtaaaggcatggagacatgaatgtgttatgtaagtctaggagtgggaagcagtttggtatacctggaccatagaaagtttgcaggaacaggagtagcaggaaatgaggctagagagaagtccacagagccagattgagatgggctgtgaataccaccctaaggagtttggctctagtcctgcaagtgttaagaaaacatggaagggctgtgagttgggagatgacatcatgttctgttggaggaagctaactggcagcagtttggaggtagggagactaaaagcagggaggctaattggaaaggtgttgcaatattttagataagagatatgggggccaggtgcaatggctcatgcctgtaatcccagcactttgggaggccgaggctggtggatcacctgaggtctggagttcaagaccagcctggctgatatgatgaaaccctttctctactaaaaatacaaaaattagctgggctaggtggtgggcgcctgtagtcccagctactcgggaagccgaggcaggataattgcttgaacccaggaggcagaggttgcagtgagctgagatcgtgccgctgtgctccagcctgggcaacagagcgagactccatctcaaaacaagcaaaaaaaaaaaaaagagagagagatacggagatatgggcaggcaaaggggaaaggaggtgagtgtggggtttggggtggttttgcagtatatattttagagatagaaacctattttccgtaattgggattattttgactcctaccattgtaacattttctagacattggttttagaggtacttcttataaggactgtaccaagaaactagttgaatgatatattcctcaaggtttggggcctttttggtgccatgctttgctttctttagttaggattagtcttggctatttatccttctgctttgactatgagaagaaccacatacctgtaattggtcagacaaaagaacattttatattctctatgtctctgccttgcactagaaatgtttgggtaaaaaatttattggtttaagaaggaagaaatgtgcccaaatagccaatgattggcttgatggctttggctaggccgttttgctgctttgagcttcagttttcttatctgtaaaagaaacatattgagctaaatcttgatatctttttcctatttcttaacgtggtatggaagttaacactttcgtccttttactgaatgaaaataatctaatagtagcttaaagaaaacggaagcatctttcacttcagtgttttgagcgtaatgaaatgaatgctattattataaatagcagtaccattttacaaaatcagaagctaggaaaatgtatttggcctttgactcgtggttggtcctcagtgaatgttcagtgaatagaattataaaatctctttgttcttttttgctgagtactaaagaccataaatttattacagatgatatttactgataataaagtacttttatttttactggtacccaaagaaggattcaaaaatcttggcagataccatattaccaaatctaactataggagctggaccaagagagaagactctgtaaatcacctgtctacagacccaagacccaaccatcttaaaagaggattcaggaaatcatttaaatgtttcttcctgctttcatgccttgaacatgctgtttctgagcaatacactacagagattgccctaattgacactaaatatgagttttaagcatttattctgaaaactagacccatgtaaacaagttagcatccaactatcaattcttagaaaatctactttccctatatgtctactggattatttgtctcagatcttaggggaggaagtggaagagctggagaacagcacgtgttattttagagttataactggaagtatttggaatggcttctatgaaagtttatttcactgaaaatgtggaaacagctttggaactaaggaatgggcagagactagatttggaggagcagggtactaaaagcctagagtctggcgaggacttagaagagaaaaagattctggaaagtttggagctcttaaagaaaaataaaaatttacttcacttctaactatttggttggtgcaaaaataattgcaggttttgccattactttttcaccaactaacaaattcagtttcaaagatttctatactgctgacagtttttttcaaatattagcccttttaattatttcattaccagaccaatataaccttaatttttttcaaccaagataaacaatttttctgcagtaaatttgtatttatgttccagacacatctcatctgatatacaatattttcttaaattgtataaagagaaattattgtacatcggatgagctgtgtctgggattaagtattagctccactgtaaccttcattttcttgaacactggaaagaaaggccaacggtcatttagtagggttggaataggatggggaatggggctttggtgagagagcattggactgttggttatagaaacacagttcaagtatatctggagttcagatttgagatctgactaggagaatctgtctagtgaaaaaagctagacctttacaaattgtagtcaggagctaccgttgtaacagtctgccagagttcctgatacaaaagattgataatttgtgtgtttgaaaaacaaaacaaaacaaaacacatctaccttcaatttgacttactgcaactctgattttcatggcaagggatagagacaaaattcattctataaaatttgaaaaaaaatgtatatcctgaaaccattggaaattggatatcagcattaattttattggactgaaaacctccagtttactaacaggagttgaaagtcatcacttttcctttcatcatagtgagttttcatcacaaaccacaatgatatgcttatctcaaatatattcatttacttgttttacacaagtatcatttctgtttacataacacgcaattttgttgctgctgctgttgttttattatgcctgtcacttgagtaaaagatggataaggtaaggtctccatttagaaatgtatagtctcttggcagggaagacaaataaaggcccataattatcataacagaaaaattaatatgtgacgcaagaaaaaataaagatactattaaatttctttgggactttgaaggaggaagggagcatatagacacttagtaaatattgtttgaagaagggaatgaatatgtaaagggagaataaacctcacctataaggtctagggcaatttaaacacaaaggagttgtgtaggattatttaaggtttgcaaatgtgtaaaattatctcactacaatactagggaaatggaaaaacaccaaagttcctctgccagcttttgctggatgagatgggccagaagtagtaactgcgagggcagcctgtatttctgttgttggtgtggtttatcttcccagtgccaatgctgccaacttcccctcaaataaaaacccataggggttcagagtctcatgaggtgagaacagacttgcactatctgtgacaacaacaaaagcacttataattttgatgtggaggatcctaattgaaatctgctgtttgaggttccttgggtcctgcattctttcttaaatatttctacttgagttggttattgatccttatttattttccgtctaatcgattgactttataaatctattgcagagggcagattaaataggcagacagttttctaatttgctgtgagggtatttcttaatttactttttaaatactgattttatttatacatttatatgcacaggtcattttcatttccatgatatcattcgagcttcacaaccacactccaagttcagtgttgttatcttcatcttcatgttgaggatgaggacacggaagctcacaggtaaagtgacaaaccccagtctttaggctactagatggtggagttcagactctgattttctggccaggtgctcatttgatgatagcagcatgaagctcttcccattctgcaccgtttgagctcctacccttcctaatcttctttctctaatacgagaacactgtaattaaagtggtatttggctgataagtagtaggttttgatttataacacatagagctggcagtgtaatttttgtcccagaacttgatgtgccatgaaagctattatgctctttttttttttttttttttttttttttttgagacggagtctcactctgtcacccaggctggagggcggtggcgtgatatctcggctcactgcaacctccgcctccagggttcaagtgattctcctgccccaacctcctgagtagctgggattataggcatgcaccaccactcccgcctaatttttgtatttgtagtagagacagggtttcaccatgttggtcaggctggtcttgaacgcctgacctcatcatccacctgccttggcctcccaaagtgctaggattacaggcatgatccaccacgcccagcactataatgcttttaatagagggaaatgaatcttcagatgatgtcagcatcctaattttttttctcctcttggggtttttctaaatgactggcaaatggaaaacctgaaagttacctgagacttctctgcatcgggcttgttggggtatactgttcttcttataatcaaccccagggactgacagatggacagttgttagagacaaagtcctcaatccaaggaggtcactcagggccaactttccttagtatatatcgttcattacattagttggttatattacctgtagtacaactcaagtacaatagctgcaggaggagacagctcgccagctaaacctaaaagttacaacagtgacatagcaagcaagggtaaaataaaaggctcttgacttattccttcattttttaataaagcatgaagtttgacataaattttaacctctggccgcatagtcagttatgcttattatcttgtgtgtattattatgctgtcaggagttggccactgatgaccaactccaaaatttagatgatagagataaaactggtagttaatatatgttgagtaccaggtcaaaaactccataagacactttacactgtgggaactggttcatgtaacagttctccaggatggaggattaatattcccatttcacagatgcagagttatgtgtctttctagacctgacaacacctgtcacctaccaaatgaatagagagctatgctataagtctagggatgagtgatccttggatgcagagcacttcctactagtattctgacttttactattatgcgtctgttactatttgacagctctcatttttgcctgtccaaatttaagcacgtttaatgagataaagagagcagaggcaaaggtgagactggatcttcccttgtatcttattgatagagagtaaatcgaatccaatttgctaaggccttctctctcctttcatgtttcctcactttgcctccaccaccatgaggttgaaaaatgagtttccatttagtttaagccttttgttattcattacttaattttgcttctatttccctcttctatctatgacaaattcagcacagtgaggggaagaaacagtgatgatagtgatggcctcaagaagaaaacagggtgactgagtaggagcaaataagtatctcagaccagcatataaacaagttcatttgtagtgtaaaagaacattatgcctttggcttgaaaactgcctttccaatttatgagcatgtttaggattatgtaagtacagtgtcttcataacaagcccaacacctcttacccaaagaatgcaaaacgctttgcaaacagtagaactcacaattcccctgtgacctggggacttatatgtattttcatgcattattttttatagattgagaagtgaacttgagacctaccaatctgtccacgttgacaaaatagatccaatactaaactcttaattccagcttcctgtcttcttagaagcagatcacactgaaagaggaatcttatgtcaagggtagcaattttctctctctctttttttttttttaaagaaaacacaaattacatagtagatatatttgcataaaggtagatcttgaaaacatttaattaagacagcggtatctatttccaggaaaaaatagaaaagccagatctctactccactgaatttaaaaattagagcagcattttgcagttaaaaacgattattattttgcattctgccatttgtctttacatgaagaatgcctgaattcagaatggaaaatattttcttttgaaaagtgcataggaaagaattgttataaagcaaatgtgttcagaatgtatgtagatattaattataagtaaaagtaaaagaagtaggatgtatgtgagcgtatgtgcatttgtgttgcagataaaccgattttgaaggttgagagacatgacgatacttgttaggtatgagggagacaagaccagaggcgccgggaagcttgactaccgtggagagctcagttgagacttgtctttgcccatggcctgcagcgcttatgtagaaattggggatgcttttactcgttccaaagcctaacctgatcagacctgcccaggttggagtttgggaaaaaaagtgtttgaagtaaacaggaaaattactcaccttaatgatgtgtcttactggcactgacagtgctttgatagtctgacagtctttttttttaagttttgggaggaaagacgggggaaattattaatatgatttttggaaaacatagattcttatgcttatgcacttgctaataaggtggaaaaagcgggctttgcaccatttacagttatggactcgcgtttcctcctaataaagtctatatcaggaattttccattaggaatttctaccaaaaagaaaagaaaatacgttactgtttattttgtgtacttgtgccatgtgtctccacaattgcgctgtggctgttcacacagaacagattcttcctagcacttgggctgtgggttcccaaacttgcaggtcgctttcatctgtctggtgattaagaccataaaccaagtggtgtgatgagagagtttggtgctctagacagagcaagcacacccttttttcataagaagcacaattcttaaatctctgcacctaaatctttccttaggatgggtcagttttttggaaaaagcaattatatatgttttgatattttgttgaaacataatagatgttgatttcatatggtttttttcctttttttttttttgtctttgctaaatgtcaaacggtacattttttctaagcttgaagacagagaactgggtcatatgtctctaaacatttaaatcttcactgagatagggaagagtgacctgatcttatggatcgtccgagtcctgtgagacaaaaatgctgggtttttcatgcagtccctaattcactttgaccttggtggagggagtcaaatctcctagtttgagatcccacacatataaagctctagagtttcaggattaaaatctttttaactttatattctcagattctgtatagcttattaaactagatggagggtctagttatactgtctagaaggacatagatgaatagttatattttataaaaattaaactcctaatgataaaaggctaaatggggagagaataaattatagtttatgaaggcatgtaaaacaaaagatgtctgccaatttcctctctttggttctctgactgggaataactgtatcgtttttactttttttgtcctaactgtgtcctaattgtaaatgaatctggtgcccagtaaaatcaaatgaatagaaatacttaccatggtgtgtatataccagcctcctggtgtctcagatataattaacataatgaaagcattgcaatacattcttaccgaatgctcagttcctgtcctgtcagcaactgtttgcctacaactaaagcaagtctgggttcaaagcattttaaaatgttccaaaaaagtggggaaggcggctgggtgcagtggctcacacctgtaatcccagcactttgggagaccgaggcaggtggtcaggagttcgagaacagcctggccaacatagtgaaaccccatctctactaaaaatacaaaaaattaactggccatggtggcaggtgcctgtaatcccagctacttaggaggctgaggtaggagaatcacttgaactcaggaggcagaggttgcagtgagccaagatcgtgccattgcactccagcctgggccacagtgcgagactccatctcaaaataataataataataataataataataataataataatgataatgtaaagtggggaaggcaagatttggctcacgagtcagacttcctatcaatgggtctatctttgaagcaagtgctcagagtgtctattcctttgatcacacgggtagtggtttatttccatgagtatttgctgttttcaggagatttcactttgggttttgtccatattccacattcaggaaactgttaattttggaagaagagattgtttttacttggttcttctaaggaaattaatcaaatgtacacgtgcaacttaaaatcaaagaatccctgttttaagaggagtttttcttatttcaactggcaaacaatatgaaactgaatgtacccaaagtgttggaggtttacaaacatgatcagcacttgttaatgacaattttctcctaagaaaatggaatgctaccttctagcatggggacttgtaggcagtatttctgtgtttgctagccttggaaagtataactcttatagggttgggcaaagcaaagcgtttttgctttgtaacctgtagaaatgattacgtagtgtaatttggttatttaatataatttgttaataattctcattcatctaccagaaacttaaaacttggtactatcctgctaatttggttttggtaatgtctcttttccctaattttaatatccctgttccttggcaaacccatccatacacctacctgttgttcaactggtgtgataagccccatcagtgctcctagacattttcttttcctactcttcctcttcagtgtcaggcagaaggatctttctaacactcgcctcagttcatggattgctgatggtccattgttggtgactgcatgatgacctgtaagcatgtcacactctgaccaaagtgtttgtatttggcccaattccccacagctaataataatccctttctgtttggaaaatgtcttatatttttcaaaacacacacatatatgtattatcacatttaatcctcataacaaacctgtcacattggcaggtggtattctcacttctcacatgcaaagttatgtaacctttcttgagattatacctcagtttggaaagtaggggaatgagccttctgcctctgtgagtaccgtgttcttcacggtgtacgatgcttccaaatatatactcttcccaacaggcagaggtggtgtttcgcagtcaacaaaagatgatttttgttttgttttcccttctgcatgccctgtctcctgctacttcctctgttcaaaacattttttttttctctctctctctctcctctcactgctgcctaccaaaattatgtcacataatttggctatttaatgtaatttggttaataatcctcatctatctaccagaaacttaagagttgttatcatcctggcaatctaccttgaagattggcaaaatgttagttaactattgaatatagatgatgagcatatggaattaaatttgaaatttccaatttcaggttccaaaaatccaatttcaaattaagaaattttaaatttaaatcttaaattaagaaattttaaatttaaatcttaaattaagaaatttaagaaacttcttaaaatttttacttatcctttctagctagagttgccagatttagcaaataaaaaccaaggatgtcagttaaatgtgaatttcaaataaaccatgaaaaaatgtttagcataagggaatcccatgcaatagttattacttttgttttattttgttttgttttcttgagacagagtctccttctgtcacccaggctgaagtgcagtggtgcaatcatggctcactgtggccactacctctcaggctcaatcagtcctcccacttcagcttcctgatggctaatttatgtattttttttttctttagggacaggggttttgccatgtttcccaggctggtctggaactcctgggcttaagcaatcctcccgtcttggcctcccaaagtgctgggactacatgcatgagccattgtgcctggccaatattccttacttatgctgaaaaatttcattgcttttacaattaaattttaattaggctggagattatctggtaaccccattcccagctcaatcaccaactctctaagcagaaggaaatttttcatctctcttgccatagtgaggtcaggattagtgaggtgacaagattaaatatgagctaagctatgacacttgttttccacagtttcctgagcccccctccctccttttctctttcttccttcctacctcccttcctctctcctatttattcttcctacctttttgttgttgctgtgagtgtcttcacctgtttccttccttcctttatattcctggtaatgtttcaaatttattggcatgggcagcttctcataataggtttgtttttattatttttcttgttattactaaaacatgttaatagatagattctaactctatggcacaactaagacagttgtgttacattcttttccgtgttggggctaattagaatattaagtttacaaagaatgcagaaaaagcgaacaagatgaagcacgtttccgtcttaaacaaatgaactctaaagaaataggaagtaacatgatgacaagcttttaagagatgttgcaagtagaggaaagggtttgtttaaatctctccccaagcaccccctacacctacccccagccaacacagatgcttatgtattagtggcccacacggtacctaattatcaacgatggaaatagatgtctcaaaattgtttcaattatccaggggttcccttaaaaaaggagaggagagcaaaagtttaaaacttggcttgaaggtattaaagagcaaatctgatctaattgattaagttacacctttcctttttggcagtatcttaatacccctaggatctcagtatttcagcatattggtttcctgtacttatctagaataaagaaactcagcaatttgcctataggatagtagagccttgaactaaatttatctcattattgttcacttgaaaccttggggacagctgtagttgaagggaccttaaagtcccttaaacttctcagcatttgcaggttcacttttaaggtgcactaaaaagcaactagtatcctaagctaaaaaaaaaaaaaaaaaaaaaaaagaaaaagaaaaagtagatttaagtataccaatgagcatggactctgtttatgttttgaaatccatttgctactcattttcctcgtttttaaatcctattatatttacacctgggcatccatttctctgaagagagaagaatgaaggatctaaaatgtcagaataacagtgattctcaacaattattgtcggcactctttcatgaagagatttaaagctctttgcttatctgacttaattcctgccggaaggacagtacagagggattacggtttaaatattgcagttagaagcacaaagtggaacctggacttccccgaccttggaagaaaaatagtaaagtgtggttcctataaaatattataggaacttcagacatagaatggagcatccatttatagtgatttaagttccagtattgaaacaggccttctatttttatttcaatctccctcccctttattttctttgttttgtgattcaccccaaaacgtatcttcttatacggtaatattaactagtaccttagtcaaagattgatctccagaagtttgtttaggaaattccttgtgttacttgtctagcagttaaactgcctagtggaaacaacagctcagctaaatagtgtgatgcaatcgtgatagctgctgttcatcaggcatttaccctggaccaagcactgtaccctgaatatcatgtggctttttctccacactcaggacaagcttgcagtgggcagtagtattatctcagccttgaaatgagtcacacaaggttttgcagcagagagaactgtcctctttttcagccctgtacaggggaggagcaagggtgccgcagtgaggggatctggagttgaatctggcttagtagctgtgaaagattgggcaacttatttcacgtttaggagtttcaatttacttaactggcaaatggaataacaatgtctacttcacagcttactgcgatgatcatataagacataaagaacttagcgaagtgcctagactgtagatcacagtacgtgttagctttttgtgttttatacatcaagcgtaagtcttattttttacatctgtcatattaccctttccccagtattcagagtatttgagtgtatacgtacgggtggtaagtgttgtttttcattgaaagtgcagatcctaactttttttttcatgcagtaatcctcaaaaaggtagacgtctaccataattcagtctattgctccaattggaggatgtacagttgttttaggagttaaggaattgagttttttcttttttgcttttcttcttttttttttttttttttttttttttttacaaattcttttattcttttcttctccaaattcaggcaaacagtattaaacactttgttttaaaaatagattgtgtacgtgtgtgtgtgtgtttatgagagagacagagagagagatgggagagggtgagaatacacagtaaggacttggaacatattctttgtgtgaaatgttaaaaaattgttcacggtggctgggtgcggtggctcacgcctataattccagccctttgggaggctgaggtgggtggatcacgaggtcagaagttcaagaccagcctggctaagatggtgaaacccgtgtctactaaaaatacaaaaattagccgggtgtagtggcaggcacctgtaatcccagctactcgggagcctgaggcagagaattgcttgaacccgggaggcagaggttgcagtgagccgagatcatgccactgcactccagcctgggcgacagagcaagactcagtctccaaaaaaaaaaaaaaaaacaactattcaaggtttcccaataaccttcttgggctttgaagctagagagcgctttggaattcatgctccattatatgtgtgtcttaatgctatatactgttgtaggtcagcaatatttatatacataagtttatatatatgtatatatagatcttttgtaaatagagggtggatactttgtccccaccttttcccatcctagcatgcagtataatgatttgaacacggcaaggacaccacaaaggcacaggaagacatcctgcaatgtacatatagtatgtgccttatgtacagtaagggccctgaatttaaagttaaaacctagattggagaattctaactttgtgttatcgtgagcaaagtagtttacttaagtctctgattctgattcttccttgacagaaagggaatacaggtgactttcttatagagttagctgaggattaaattaatagctgtatgaaaatgctctataaactgttaaggactatacagatgggtgagtgatggtgtcatttatggaaatcagtagatgccattactctccatactgtcgatacatagtctcccatttcttcttatcagactggcctacctagtcttccggtaaaaagaatatcccgcagatacaaattaccattactggaacagaggactcacttttagagcagatgtacaaatgaaactccaaaacaagccacaaatctaccaggaaagagaaccaatatgtgtggtattatatcgccaaggatacctgagtcatttcatagaaattgagctgtgagtgcctcccagaatgaatggtttctgaacgtgtttctgttaggaatgatgcaaccttcagtagagaccagagatttaagaattctatactgtgagtcattttaaaagacaatcaaagagtatgtgtggaagcatagacaataactttcacctctagcgtccaggtgttgaaggaggtcagctaccagggaaggactcctacgactttgggtgccactgcgtgaggctttgtcttggaccagggggtaaaacatatctcaggcaggacgctgagctctaggtagggctatcgtttttgtagaagcatgacttcttgatacaacaaagtaagagctgaggaaggaacagggaaaaccagtttgggcccagaggggaaagaaatgatagtgtagtagcccgcggttttgcaggcagttgggagtagcaagccacccttagggggaggataatgttttctctaccttaagggaaaatgatagctgacttgcagagcagtgtgctgagacagacatgctgctactgcagtggaagggggttgcaacgtattgtcttctgtctggagagagagagagagagagcgcgtgtatgtcacgtctgtgtccataaagctctccgatctgcccaccaaccctgtcccccaccaataacatcttaaagagaagaggtacaggaatgttttacagtgaaaagattacagggctggaaattagaagccacaagttctaattatgtctcattgctaacttctggtgtgatattttctctgggtctctcatttatcggggagttaaactaggtatgtccagtaggggtgaggggtaagagttctctgcccatccagggtttctactagaagaattttgactctacagataattgtgtcttcctgtattgctgaggaatgtccaggtttgttttattgaggggcaggggagcacatagatgtccagtagtcaggaaggtggtttgcaggcctttaatcagcactgagaagagggaaaactaactgcagttcagttctcagttccaccattcactggagtgctgctttcaacttttgagctcctgtttctacacctctaacgtatcagtgtcatctcaccctggcctttttctcatgatggtcgtgactttaggaaacatgtaagagtaagccgaccttaacacgagtacctgctgtatgacagtcactctgacaaatgcctcccagtgtctgctctgtgaaggtaactgtgaatgatattactggtcaggtggggttgacagaggtggccctggcaggagacactaaatgaaaggtcattttaccctcctggggagataaagttgcaaaattaccgatcaagtctgtcaaatctttttagactgggtttccaaatccataccctcaggcaactagaacaaggctggcgagctccacccccgccccttcccaaggtgggtgccaacatgctgcccttcagcagggaggacacagctgcctctggggccagtgcccagggctagccacaaagctggctatggcctccccaagaagacccaggacacattactccctgcagaggttttgctgctttgtggcacggtctaagtgtcgccccactcccaccacctgccaggcccagtgggctcctggctggtcctcacggtaagtgagtagcagacagcccacctgcttgatgtcaacatttgtgggcgcggcccgggaagaatgtgccgctcccagcctccttggctcaggtaattaatccccgcaactgacaggtggcaacaggcggccctttggctggagccatcaggaaaagtgcttggaggaaggatttttttaaaaaaatgatcaagagcacaattcgtacatgtctggcagctagacggctgtggcaggaagggaggcagggagaagtaaataccttgccaagacgactgtggggccaatgttgggatctgcgtctgcctgatcattgtgatagatccaaaaggatatggtggccttggacttgtttgcaagctcactttgcagaattccccttcctttgatgtggatacagtcttaaaatggaatgcctcatttgtgaatcaaaaaatccggggccaaagttggagccccagaggagaaataatttgcccaagatgatgcagtaagtcagtgggcaggtagaggactagaagccaaactcaatgcctcttggctttgtttccatgattcactgggcaatatttactgccccattatacacatgtagtttagaaatagaatgacaaaactggggtcctagtcaaaggaaggatgatcagttgcctcttgaaagatattagtgttttcaatctaaccacttaaagctgacttctcaagagaatgcccccaccccaaccccagaccacctgtacccattcaccccccctactttttatttttggtagttcgggacactgactatcagaacacattgacctgatgtttattaggatggatatattaaaagccattgaaatgaacacttttcctttttcttttttttttttctttgagacagagtctcgccttgtctcccaggctggagtgcaatggcatgatctcagctcactgcaacctccacctcctgggttcaagtggttctcctttctcagcctcccaagtaggtgggattacaggcacgcgccaccacgcccagctaatttttggcacgacctcagctcactgcaacctccgccttctggattcaagcgattctcctttctcagcctcccaagtaggtgggattacagacatgtgacaccacacccagctaatttttgtatttttagtagagatggggtttcactatgttgtccaggctggtctcaaactcctgacctgaggtgatctgactcggcctcctgaaatgctgggattacgggggtgaaccactgcacccggccaacactttttaaacattacattttttaaaaaataatatctttctcgatatgaaatttaaaatgtttttcaagtgagtttttttgtagaggacaaatccaaagtatagtatataattagcccatataacttcatgtgataatcagtgtctttgaagcagaccaaactgaagctgtgtctcagcgctaagggtctttttacattttactgaattggatctttagaattaatttttcaaaccctccttatcaaaagttattgttggaccctcaaatttttattttcatgtatctcatttctcttccctaaatcttgcctcccaccagattagctgccagaactttatctggttctctggcaaccctccatctgttttgtatgatttttcattcccagcagttctaattattgatttcatcaccctcttacccttataaaaggacatttttaatttggcagtcccaaggaatatagcttataaaaagaaaaaaaattaagtcactgaatgttttaggagagcactaagttaagacagactttgtacttgattaacggaattgttctgagagctttagagcttgacttttttttcttcctgtcaagtattttgggttatttgagatagtacagacaacactttacctcttaagttttttgaactagaagccataaattagaagtgcacctggcatttcctgtttgtgactagtggctatcttttagataacagtgaagtcctcaatgtccttgataggttcttggtaaactgcgaccttaaacaaaatgatgtgcaggagatcttcgagtaattgtttcatacaatgttattttcttataacagtgatgagaaaaacaaattgttttgttatatgtgttttgcttaaagttacagttcccaaaaatctatcaaaaatgttaaatgaggattcattgtatttgtaaatctcattatttttctctcttttttaaagaaactaaattcaaattcattcagaaagccaggcataaagtgagactaatatgttcgttggtgtatttaagcctttcttagagttttcttttttttaagacctcagtataagaacatgccagacgtgaattgatctggaattgcagactcgggagggctttgatgctactctatctagttgccttccttgaagagggattgagaagagaggtaggttatagaattaatgatttttttttgttccgtgagagtttatttcatccatagtctctaagatttagggctcaagatagccatgtgatttgagatttgcatgtagtatggcatttcttctgggagaggatgaaagagctaaagttcttgttttttggttttggtgtagtaggcagggagggttttgattctacctttaggaaagggaggtgttgaaaaattacgcaggtgtgtgctgatattacctggcacctctatgcattgtgatactgaattaccagtctgccagccaaaagcgtgtaatatagtatgtctactgaggcaggtggtaaaggtagggtcctagtcactggaattctttttttttcccccttctctttgcaacatattattagtaaaggagctgaatttacttgttttccaaaatcccctggagttgttttatttgaacatgatatttggctttaagcagctcacccctcgatattccaaacttcctcccctccctcccaaagcaaaacaaaatttaggcaaagcttacttatccattttgacaaggatattttataaaaagaaggagtttagttcatttgttagttttcaggaacttcttttccatgtcattgttgaaatatttagttcatgtggatggccaaaactgtcatgtcagtatacaaggaaatttggttgaagatcagtacaatattaggctcatcattcttgcccatgggctggtgcttcctgggaatgaacaaactattgaatatatgtacagtatgtatacagaagaacatatattaagttctactttatatatttatacatatatgatcagaaatggccagtagggtgtgtgtgtgtgtgtgtgtgtgtgtgtgtgtgtcatcagaaagattaccaacactttgttttccacattcttttttttttttttttttttttttgagacagtctcactctattgcccaggctgtagtgcaatggtgtgatcttgactcactgcaacctctgcctcctgggttcaagcaattctcctgcctcagacttctgagtagcagagattacaggtgtgcatcaccacacctaatttttatatttttagtagagatgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaccccacttttggtcacgcctataatcccagcacttctggagattgaggcgggcggatcacctgaggtcaggagtttgagaccagcctggtcaacatggtgaaaccccgtctttacccaaaatacaaaaattagctaggtgtggtggcgggcgcctgtaatcccagctactcaggaggctgaggcaggagagtcgctagaaccttggaggcagaggttgcagtgagctgagattgcaccattgcactccagcctgggtgacagagcgaagctcagtcttagaataacaaaaataatcatcatcatcatcatcattatcatcaaatggaagtaacactatacattatctattttcccctctatgaatgattagctcaagatttggggggatcatgtaagttgccagttatttctcagtgagtgtcagatatttatgacttctttgaagaggccaatcgtttttgaaaattatttcagatgtgctttatttccccccacccatcacagtattttatttctgatttcacttagatttgcataatgcaaagagccacagttgcactgggggtcctttctaaataggcaacgaggttagtgcaacccactgctgacttattgaacccaggacctgatggagtagagttgattcttaaagcaatgagtgggcattttgtgttgtttttatgttcaagctcccattgtgagaatatggttacactttagggaagaaaacctcaactcttagacaaacttctttgcttaactaaaaataagtatatatactcctgtaagaatttggtgatcatatttttatttttgttagtaagatggcctctgagctttacacttgattgtctaatcatatattttctaatcatgtgtttattcactcaaattcactctggcacgaatacaccagttccactttggcctcatactataactgttaaaactgtgtgggacgtggggaagaacactggtctgtatgtcaagatggtcccagttactgagaacttttgagcaaatctcttctcctttctggggcttagattcctcatcggcgaataaagtggctgaaccaaatgatctttaactttgaattttcctgatctaacttttccttttccttttcctccctctgcctcctcctcctcctcctccttctctctctctctctctctctctctctctctgttgcctaggctggagtgcactggtctgaggatggctcactgtaacctcaacctgctgcactcaagtgatcctctgcacctcagcctcctacagatgcccccatacctggcttttttttttttaattttgtataggcagagtcttcttgtattgcccagactggtctcaaattcttgggttcaagcaatactcctgcctagacctcccaaaatgctgggatgacaggcatgagccactgaacttggcccctgatctaatgttctaaaaaaatcttagcaaatgtgtgttaaactaaaaatgctttgaaatgggatgactcagtaatagaaacatagaaccaagcccttgctttaagatgtcaagttggatttctacagaaattctgtaattagaatataatattgtagtaaaagcattatcttcatagaactaaggaaatctgagttcacttcttcattacccaaatttagttgtgcaacctttagaaatcattttatcagggatgcactcctgaccctctgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttggtgagtggtgaaaaactcccacacatttggccacagaagtcatcttctgtgttgatgattgttgctgtggtaatgtgagaggagaggaaaaaacacagtttgagcatttcccaaaacatcctccaagctaaatagacccccatgttttaccttctctccttttgcttttttttcaagacatgtgtcacaattttagaaattattttttttaatgtcagtacttcctttggatcaactcccttagtgtaaggtttaccgttggttccctaatagccaggacaaggactggcatgaagcgcgtgctcaataaatatttgctgaattaataagcttcacctctttaagtctcagttttatatcagaaaattaggagaagaaggtttggacaagaggtgctataatgttccttctgagttctaacatcttctgtattctctgtcttctaaaatcataggtctgtaacaagtttacaggttggtgctactcataataatttatgtattaaacattttaagtgagaaatatttcaaggtcaggtgtggtggctcatgccctataatcccagtactttgacaggctgaggtgggtggatcacacttgaggtcaggagtttgagaccagcctgatcaacatggcagaacgctgtctctactaaaaatacaaaaattagccagaagtggtggcactcgcctgtagtcccagctgtttgggaggctgaggcaggtgaattgcttgaacccaggaggtgggtgttgcagggagccaagatcataccacttccctccagcctgggcaacagagtgagactccatccccccgtaccccttcccccaccgccaccaccaaaaaaagaattatttctaacgtaaaaaaagtaagtaaattaagacatctgagtataagacaaaatgttaacatttttccatattgcttcaaatcttttccttaaataaaatataaagcaaaaagtactcctccattctatctcatttcccttctttcagccattaaaatgaataaaatatacctgtatataagaacatggataaatctgggaagcatgggaattgaaaatagattactaaggctaaatgtaggatgatgtaaattaaattttaaggacacggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaaataaaaaaaattttaaggacacgcaaaattatattacatatatttatggatgtgtattaaaaatgtatgggagtaaataaaattctttttttataaatgaatctagtaatttgaaatggttaagaacttaatgattattaatagataaatatgaattgtgtgatttattttaaatggttaacattcaaactttagcagacttttactatgtcaacaaacactttctcaccaggttgagatacagttttcacagtgctgtcttaaaattacttaagctatgttaaacactttatgtggagaatcttagaaatatgaggcttcagtcataattgttatacatgacttttattttgatctttgcagttgagtaagaattttttaatctattttttctttcaccttaagagatgtgaactataattttttccattttatatgtgtaatggtgaagtggccaaaatgtgggttagatgttattgtatttcaaagcgagcttgggaaggggcgcaaagcagtctgcctttaaatgtgttatttccagccaggcgcggtggctcacactcgtaatcccagcactttgggaggccgaggcaggtagatcgcttgagcccaaagagtgagagaccagcctgggcaacatgggggaaaccccgtctctgctgaagaaaaagaaaaatagaaaaaaaaattaaccgggcgtagtggtgggcgcctgtaatcccagctactctggaggctgaggcaggagaatcacttgaacctgggaggcagaggttgccgtgagacaggatcgcgccactgcactccagcctgggtgacagagcgagactctgcctcaaaaataaataaataaaataaaatgtgttagttcccctttggagcagaaagaagtggacacttttataaggtaaggagggaagtgaacaagggcaggcggtccccctgctagcttggtgcctcatctacctgatagttgagttggcaccaacccgggcagaaataagttgtgaaaatggccaagcaggcagacttaagatatgcccttctgatgggtgaaagtcccaaggccaccccgtgaaggtgaaagttccatggcaggtgttctctggtttgcaaatggactatcagctctccaggagagatttgtcttggagcacacagttagaacttaccctgcagggagtatctggtgaggaggacgtgaagggttatatttgcatttctgaagggctaagtaggaaacagggaacgggaggaaaggggacaggataagagaaaataataaaaataatagtaactcattcctcttttcttagaagaaatgggagtactcagttaagactacatgaaggcagagggagggaataaaaagaggaggcagaatttaaataggattttttaactcctagtccaataaataaatgatgcccacagttgttggtgttggacaagagtctgttttctgttgcttttagatctgagaactgagccctctccttcacaacaaaattggcctattaattccagtgttacttcatgtaatttttttatttgtccagaactaaaactatcctttctctattgtcgacaattccattggctaagccaggtttcaattgtctgctgaatatcaggagctctgtgttaaaattaactcattcattctgctttgattttagaaaacagataaacaactgatagtatttttgcaagcatcttttgttctaaagcataatatgtattggtctgttttggtacttccatgtatgtatttcatgttaaaaccaagaaggctgaatttagtaaatccaaagagtttcccccatcatgttcccttttcattcatttctactgccctaggttgggccttcctcatttcttgtctgaatagctcctgatgggtttccccaattttactttgcttgttcccaccacctttgtatttctgaatacaaagaactgattaggtctttcccctaccttataatcctcagtgacacctctttgcctgctcatagtagttaacggtatcttgtgacatccaaggctcctcagaatctggtaagtgcctttctagctcagcctcattgacttctgctcggccactcctcctccttcccccatcccatctatatttcatccacagttaacatccccttgcttttactgatgatattctgtcttcatggaaagcctactgttgtctcctggctttttcttcctttctttcttgggtgcacaatccaattggtgaataataacttcttttttaaggcctagtttaaatatcactacctctatgaaaattgtcttttctattttaattttctctttcttatcccagccagttcatcagctaatctggtgacttctcatcacctctactgctggtctaagccactctcatcttacacttggattattggcaggagccccctgactggtcttcctgcttccgtctttgttccacaaagtctgtccttcacataacagctacagtagtcttatagaaataaaaatcagaccacatcagttgctcaagcccctctagtggcttcctatctcacacgaaaaaagctcaagacccgtcctgctctacaaggccttgcgtgatctgggctccctattatctctgatcttggatcttaactcctaccactgcaggctttgcttacttttctgcaggtgcactggcctccatggcaagcatacccagccaggactttagcacttgctgtctctagtacttggaacactatctctccaggtatatatatggcccagctcattatttcctccagacttttttctttaatatcatcttattgaagaattctttcctaacaatcttggaaaaaataatatcctcttcacactcactcccctgactcttggctttttatactctatcccctttgaatttaccctgatttactttttcttatagcacttatcactatctgacatagtagttatttgtttattctagaattctagcatttttagggcatagactttgtctttgtttaatgctgaatttccaaaactaaaacagagccttggtaatagtatatgctcaataaaaatcaaatgtattacctagtagttaattgttctatctctgtaatcccataacacttgcagatggttcctttatacccagtgtattttggttgtttttgctgtactctgcctctagactgtgagcaacttgaggataaagatcgatttttttctttcaatttattttatatttcaagtaccatcctaggcagcatggatacataaaattctgcattccaggattttaaagtcttacttctatctgttcccagtacagaataaggacctagcattgtgcaatacatgctcagtaagagttggctagattaagtattgaatgttgtacaaatgagaagagctagctctcatttgtggtttatgatggcaactgactagcagcttttagtgtagtctctcctatgttgttgtttttatgtttgtttgtttgagatggacttttgcttttgttgtccaggccggagtgcaatggcgcaatctcagctcacggcgacccccgcctcctgagttcaagcaattctcctgcttcatcctcccgagtagctgggattacagacatgtgccaccacgcccagctaatttttttgtatttttagtagagacatggtttctccatgttggtcaggctggtctcaaactcctaacctcaggtggtccacccgtcttggcctcccaaagtgctgggatcacagatgtgagccactgcgcccggcctctcctaagtttgtattaaaatattaatattacaaattccagaaaaaattaaactaaattggacactcaagccattggcagaattttataataattttatgccctaaaagcctgataggatagaactgaaaaatgtcaaaatgaaatgaaagctgcaaacactagctgtggctatatcttgctatgttcatggaaaagtaaaaaagcgagaaagggcttatattaaaaacaaacaaaatcctatctataggggaacatcgttttaaatactcaagaaaatcaacttaggaactggaagaaatatttagaagattactttggtgcaaattaataagacagtaacactgtaaagttgggaagacatggcaaacctaaaattgcaggctgagatgtaaagaggactagtaaaaagggatgaagattaaataaggaaggacatttgaaatgcagcagaagaagtgaaagtattatttgtagtagaatagagcagaattaagtgtagaaaaccatacacatactgaagacaaatttaagaagctttcccaaaatgcaaacaataggaaaaactgcataaaatatatggcggatagaaagtggagatcctaaagtaagacttaacgtgtttctggaaactgatacgagcagaagaaacaaaaatacaattgaagaacaaaatgtattgaggtcaagcatgaaagttaaaaggacccaccaatttccaagtaacttccattttaaaaatcacatttagagacagtgccactttattttttaaaaaagataaacaaaattctacaagaaactatggaaaaataagcagcttacttaatttaaagaaataaaattcagattgaccttggacttttctacactgaaatgtacattgactcaattactctgttttaagagatctatctaaagccaatttatatactaaactgtgctatatggtgttatttttaactggagtaaaatttatacagaagtatactaaattatactattctactaaaaagttacaattaaataaataatggtatatccctttttaatactgtgacagccaccacttaaaatcatgttttaaaattagaacatgctcatgatatattaaattataaaaagaataccgtctttgtattatatgcccctagtttgtgtgtatatatgtgtgtgtgtgtgtatgtatgtatgtgtgtgtgtatgcacagaaaacggtcaacaatgttaataatggtatgtatctcttgagtaagcaagaaatcatttttttccagaattctgtgtgcacatgttttgacaatgatgaaatattaataaaaggcagattgtagaaaaagagaagttggggagacgttgacaaaagttttaaattttctgtaacggcttctcatagtgacaacactacagggcaaggtactttataccttcacatagaaggtttgaaatatttgctatccacccaaagagctgctggaaatttaatacaatgggctggcataatcaaaaaagttcttagctatagaagatattttttcaggtataaaatcaactgagtacttaatttaatgcctataagtaggagaaacctacatagagatataaggtaaccctgggaatagcaattaaaaaatctgtttagaatggtaaagaaatgtgtaaaggagaaaataagtttgagctagaaatggaacccgtgaaacaagcagaagacctagagaattaattttcttaggaatgtgagtaagtgttgtatttgatatactggttatgaggactgataaaagatttaaaagaaatgcttcacatatgactcagtattaagaattagatatatcaaaactttgtggacatagctaagaagtacctagaagaaacttggtagaattaaatgtttatattagaaaaaaacgtgaaagtctaaaatgaatgatatatgattctagttcaaaaaaatagcaaactcaaccctggtttgattattgcagtcacataaaaataaaaatttaaaggtatgcagatttgaaaggaagaagtaaaactgtccctgttcatagttgacatgatcatctatgtagatcgtaaggaaggcatctacaaaaagctacaagaactagtaagtttagcaaggtcataggctacatggtcattatacatgaattaattaggtataaatacatgacatagtataaaacgcattagaaacaaaaagaaattttcatttttaaaagtactgtttataacaattattttaaaataaaatactgaaggataaatctaacaaaataggtacagtatttatacactgaaaactataaaacatttctgagtaaaattaaagatactctgtttaaatggagagatatcatatgctcatggtttaaaagacaccacattgctaaggtatcagttctcccctaaaagaccttacatatttaacacaatctcatgcaaaaatcttaccaggcatttttatggaaattgtaaactgcatgtaaattttgtatggaaaaatcaaaggatataaaatagccagaacaatttttaaaaagaacaaaattgcaagaatcagactacctgatttcaagacttactataaagtagattaacccaaacaatttgaaattgatatatggatagacaaatagatcaataggaaagagggaagtattcagatacagacatgaacacatatgaccaattgattttcaataaagagtccaaggcagctcaacaagggaaaatatgcaggtaatcttttcaacaaatggtgttagaacaattggatatctgttaaaaagagaagaattataaacccttaactcacaccatatacaacaattgactgaaaatatagttctaaatggaagagctaagacaataaatctacttgaagaaaacatagaaaatcctcctaatgtcaggccaagatttcttaggatataaaaagcaagagctttcaagggaaaatattgataattaagtattttgggaaagcaggaaaaaagccaagctacaggctgggagaaagtatatttttaaatgtatatctgataaaagacttgtagccaaaatacataagggactcctaaaactcacattaaaaacaaaagcaacctaactgacaaattaccccaaatcgccaaaataacccaattaaaaaatggccaaaagaccggaatggatatttgtcaaaataggataagcatatgaaaaatgcccaatatcactaatcagggaaatgcaaatcaaactacaatgaaatactacttcatttagaatggctattaacaacaagataactgttagcgaggatgtggagagaagagaacctttacatactttcagtgggaatgtaaattagtacagccattatggaaaatagtatagaagttccttgaaaaattaaaaatataactaccatgtgatccagcaatctcactactaggcatttatccaaagggaataaaatcagtatgtcagagggatatcttcactcctgtttattgcagcactatttgcaatagccaagatatgcaatcaacctaagtgtccatcaaaggataaatggataagaaaatgttgtgtataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattaaccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaagaaaatgttgtgtatatgcacagtagaatactattcagtcagaaaaacataatgaaatcctgaggttgggcatagtggctcatgcctgtaatcccagtactttgggaggctgagacaggaggatcacttaagcctaagagtttgagacaagctgggcaaaatagtgagaccccatctctacaaaaaacatacaccaaaattagctgggcatagtagtgcgcacctgtagccctagctactcaggaggctgaaatgggagaattgcttgagtctgggaggtcgaggatgcagtgagccgtgatggtgccactgtactgcagcctgagtgacagagcaagaacctgtctcaaaaaataaaaaaagaaatcctgatcctgtcagttgcaacaacatggataaatctgaggacattatattaagtgaaataagccaggcacagaaagatgtaaccacaagatctcactcaaatggaatctaaaaatgttaatctcatagaagttgagagtagaataggggttaccagaggctgagaaggggacacggggtgaggggaaatggggaaaagatgggtcaatgggtacaatattacagttagacagaaggaataagttctgttctattgcacagtaggatgactatagttaacagtaatgtattgcatatttcaaaatagctagaagggaggattttgaatgttcttactacaaagaaatgataaatgtttaaggcgatggatatactacatatcctaatttgatcattatacaatatagacatgtatcaaaacatcacattttacctataaatatgtacaattcttttgtatcaatcataaaataaaacctaaaaagtgaaatttctgtgttacaaagggggagaacacagtctgtattacaatttttttaactcaaaaggtacaaaatatttgaacagatgcttcaaaaaatatcaaatagttgtatagaattacataagtttgtttttatttttattatatataaatatgaatgaaataagtacatgaaaagatgttaaacattattaatcatcagaggaatgttaatttaaaccacaatgagatctgcatacataccagaatgacatcaattaaaataacagctgacaataccaaatgctgacaaggatatgaagtcctcatatattgcaagtgacaatgtaaaatggcacaaccactttgtaaaactatttgggagtttgttagtaagcatacacttacccagcaatcatattcctaggtattcaagaaaaatggaaatgtacatcctcacaaaaatttgtacatgaacgttcataatagttttatacacaatagaaaaaaatggaaataattggtgagttgacaaataatgaagtgctattcaaaaatacaatggaatgctgatacgtgcaaaaaccacagataaatctcaaaagccttatcacataagattatatactatatttttccatttacataaaattctggaaaggtaaaactagtggaggaaacaggtacatgattgttgaggccaggagctagggaggggatgaactgcaaagaagcaaaagataattggaacaggaatggaaatattctatatcttgattgtagtagtagttgcacaacggtgtacatttgtcaagccatcagcttttgcacttaaaaactggtatactttgcggaaaagtataccacataaaacaaaacccccatacaaaaaagaataaattaggccttagaatgaaaagaatctcaagtcaatgttgaggagcaatttagacgtgaattttttaaattccacagagaaagaaagatagtaaaataagccatgtgtgttcaaatttacaatttctgctgacttgaatcatcagggtattttaaaatcttgctgtaaatcagattcccatgttccaatcttgcagaagccgggaaaattggagatgatggtgctattttgtaagggatacggaagtgggcaagtctaaggacttgtttatacacatagaccagggagactgaacttagtactgggtaaaaaaaataaaggtcatcatggaacagatttgcaaacaatgaagtaaacagaatagcagagatttggctttgtaaaaagaaaaaaaagcgattgtgccagaccacttcagcgcctctagttgctgaattgcaggactggtagttgaaccaaaagcaataaacataatgcatcttggctgtggtcagatattttgatttagtcaaatatgaagccctcaccactaaaattggaaaatatggtttgcagtacagatacagtactagctgaaaagtgatatctgaattgtcctggcatgacgtggagagcagaggaaaaagagaagtgtaccacactgggaatatcacttttgttgttgtagttgttgttgcttgcttgttgcttttaatttttttaggtttcagattcagtaggtacatgttcagtattgttacatgaatatattgtataatggtgaggtttgggtttctagtgtacctgtcacccaaacagtgaacattgtacccaataggtattttttaacccgcatcccctcctaccttcctcatttttggagtcctcagtgtccattatttccatctttatgtccatgtgtatccttttggggtttttgtggttttttttcgtatttttagtagagactggatttctccatgttggccaggcatgtcttgagctcctgcctgcctcggcctcccaaagtgctgggattacaggcatgagccactgtgcccgaccacatgtgtcttcactacttatctcccacatataagtgaggacacatgatacttgattttctttttctgagttgtttcacttaggataatggccttcagctcaatccatgttgctgcaaaggacatgatttcagggaatagcattttgaattttgggtgatgatcctatggtgtgtttgaagcattaaaacgtttgtatgggtagaacatggggtgagaaatgtgtgtgggtgggggtggaggggtagggggaattagagatagataaggccataatacagagggcctcataaagtcctcaataaaccatgttaaagagcaagactgtatccttgaattcccagaagcagctggtgtaatcgtccaggctgtcttccacctagcccaaagttttttcaactctatcacttgctgcctctccctaccattaaatgagtaagcaatatactgagaaattaataaaactatgttaaatagaccacttttgagctccattttaatgcttggagaagagtcggtaagcattgtaattgattcagaaaagaaccacaatgttggaaactagaaaaaggtaaacatttgcatggctgagttaagagaacagagacataagaaactgttattacaggactaggatagactcatataccagttactaagcaggttcttgggcaagtcctttctgtacatttattttcttatttataaaatagggatgataattcaagtcaattatctgttatctacaattctgaagttccaagagctctgaaaatcagaagttggttcagttttattttgatttcttaagtttgtggcacactcatttgatggtgaaacccaggtttcgtagtcatttatcagttagtgtgaatatttatgaattctgcagaaataatgtttgatcttatggtgctaccctaaattctgctggatacatttatatgttatgcaaactactatttttctaaaatctaaacaattctggattctgaaaattctggcccctgtggtttcagataagagacagtatgcttgtaataccttcctcttagggttgtatcaggataaaatttcttaaggcagaactcagtaaacgatgaagctattattatttatcattaattaagcttaaaaattagattcccacccccatccccgagaatgaacaagaattagcacttgacgatccttaattttattcttaatgcttttatactgtactctctcgagcttgatttatagtatatcagttattaaaatggaatgttttccttaagaaacttctacgctgaacacttaaccttcatttctgcaatctttacatacttggaaggataccttatttgcctttaggtattagttgacagacttatttttcagtcatctttcctaagggtcatcttacgaaattcatggttagattatgcgttatatacctcctaacgaaaacacgaatggatatgcttattttcttcaagttctcaataaaaggaagttcttaacatgtcataaaacaagttctgtgtaagtctttagttaaaagcactagagcaaaaatacccatctagatttcattcagtgtttcccaagtagaattttatttttgtggttgaagtttggcatgtttcctatttcttcaagctatataaaacccttttgctgcgtctaatccatggcctgcggacatggaggactgattttgcaatacttttctagcattgggaaacttctaactaaaaattttgtgtgctggaatacttggaagaaaaggaaaggtcatttaaacaaatactatattttaaaatgaagaaataaagcaacattttaaatgtgtgatttttgttaagatacttgccattagtgagagttagggtgggacatatcagtaacgaatccgattgccactatggctctgcccccccaccatctttcctctgggaggatgttggggccaacttacgattgcaacctgtgtgtgtgtttatcctttgtttggatacatgttactaggtgccccactcttggccagcaattccagtgcctgggtggtttgcctgagcaaagtgcctgagtggctaggaatgtagagatagggctttgacccagagcacagggatgataaggtttactatagtgtaaggattagaatgaaggttctcttctgcttcagaagtgggaagaggaagcaacacaggatgggatctctatctggttctaggtctcaggctttctccagcccgttttgccaacttacaagcaactaaccaccactaaacttcctctccctggagaaggaaaaatttcactcacttgtgagtgagaagatctgcatccagatcctttctgtgccatgattagctgtgctacatcaggcccggtgttttcaggagtttaggaccaaacagcccctttcagctcttgcattctcctagtctttgacatcagaaggaaagtgcaggcgttcaagggagttcttgttttacagtttcaagcgatctgacgtcaggcgaaatctcttcactctctaacagatattccatcttaaaaaaaatcccatgaaccctaattcctgtgagtgtctctaaagtatattaaagactggattaattgtaatctaggcagaaatctgtctttgtggttgttgtttaatatcactcagtacatgccaatactcttctttcacttagcttctggtaatctatgaagctactcgtggtttcattcatttaaacccctctgagcctcagcttcttcatgctaaaggaaaataacaggaaataatggcataaatgtgttttgataaacataaaaccttttgtaaacatggggttttatttatgatagcacaaaatattaatataacttcctctaataacattgacatacgtcacatctatagtagccagtagtaaacaggcagcatgcagctctaaaaagtggacagattttcattgttctgatttggaatgtaacaatatctcctgttggttctctccttcctttctccactggccccaactctaagcagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggtaagcagaatttgaatctctaactgttcaacctccttgaaggtcaagattctgtgggcatttttgtttgagacccacctacctgattcagacttctgcactccgatggcagatcagtctgccttttttttttttttttttttttttggctgacagtatctaagaataatgataaataaattcatggctttcacagtggttgaactatttaatattagtaattactagatgacctgaactactggttatctttactccttcctgcttccttctttttatttttcttgcctttaaaataaaataagaggctgggtacggtggctcatgcccgtaatcccagcactttgcgaggccgaggtgggcagatcatgaggtcaggagatcgagaccatcctggctaacacagtgaaactccatctctactaaaaatacaaaaaaattagctgggcatggtggcgggcacctgtagtcccagctactcgggaggctgaggcaggagaatggtgtgaacccaggaggccaagcttgcagtgaaccaagatggcaccactgcactccagtctgggcgacagagcgagactccatctcaaaaataaaaaataaatgaaaaaaaaataagagggtgccaggagactacatggtagctattctacttggcccaggctacagtttcttcagatttagtgttttcccagaaagattctcaagtctagaccagttgagacctggaagggtaagagaaaggagcaccaaatgaaagaaataatgaaaaaaccagaagaagaaaaaggaaaaaaagatgagaaggcaagtaatgggtaaggggaataaatagaaggcctagagcatactgtggccaatcaaataaaggactgggagtggagggatgaggtatcatgaaggccacctttagacgctatatccatgaataagtcatgcctcatattctacatctcagatcctacaacaatttagcagaaaaggtcagcaatgccaagagttcccttagatctgatattatagttccatgaagggagactaaacagagagtgctgaaaagtggaaggtaagagcaggataaagcataagcaatcctcaaagagtattgagggtgccaaaggtgttgggggttaggatactttatagaaaaaatattaaaatataaggattgataaatatagagagtataattgtagagaaaatcaatggaagaagaaagagaatggatcggaatttaaaagaagaaaataaagtcaaaattctctttaaaaaactattttttacacattaatttcaagtccttgcccacatggccacattatccgtacatttatctcttgcttttcacttaacaatctgccataaagaatattgcaatatagatagacttcattatcagcctccctaacttggtatttcaccaagataacatactatttgtaagcgttttcccattttttaaacataaaaattgtttttagttttaaccataatagatgatgcagcagagaacattttgatatgcttcactttttacttttattgaatggtttttgtagactgggactataggacctaagagctgttaaaaacagctttacgggtcccagttcttggagcatcttcttttttttggagctctgctaaatatcacaattttatgaaactttactcagtctcttttttaaaattgcatcccttttcttacacccaacttgggactccttcaacacacaaacaccagaacgtttcttatctttataatcaacacaatgtttaaaagttgaggaggaggaaagaagaagaagtggaagtcatatccttgctatcttctgcttctcagtgtatttgctggtcagacttttgggcagcattttctcagttaaactgatttttttttaaattaatttgcttatttccctttcattttccaggaagctggcaaaatttcctccacgatgaggtcagagatgtagttatagagttccataaagcttgaatcattaatcttaaactccaaattataggactgttcccttaactgtagatgtgcattccagccctttctgttgctataaaggttatgacaccttcatgtatttgatatctggctatgggatctgttcgtttcttcaaggatgcacattttctttattatacagactatttcttttgccaccaacatcctgttcatgcaatttcattttattttctttatttttaaggtaaagaactaactcttttattgttttctgctctgcaggacagattgcccctcctagtcatttgattcgagtagaggggaacagccatgcccagtatgtagaagatcccatcacaggaagacagagtgtgctggtaccttatgagccaccccaggtaaaaagcaaaaaaccaaaccaaaaaacaacacctctatggactgagtagacttgagagaacatctgtttcagcaacagggatgtttctagcatctatcactgtcttagttcttgttatcaaatatataatatttttgtatttttttctacctgttctccacatgctttcccttcagaatacctaaatatgcactgaatcaacttggtaacatggctctgtgtccatattcccatcttaagggcagataacaattgaactggcaattgggtgtatacatgagattgttttatccaactggcaattggacgggtagtggataagcaatagtagtggatgcaagtgttaccataagtgggaaagcctaagagggatctcttagctgaagtttgaatgaacagatgatagatttgtaaatctgttgcatgaagcagagtagtgtggttgaaagtacactggtgtaacaggacccaagttctttggtttgctggcttgctgtgtggaccttcggcaactctctctctctaggcttcagttgccttacccgtacgtatgtactttggactagattatgtttaattctgagaacattttgagctctaagatgttattaatggaagtgtatattcaaatctatattgtactgttttatccacacagggaaaatattcttggagcattgctactgtttttggcaattatccccagttttcccttttcagtgatattcatgaaggtggtatagcctatttgaattacatgatgtggatcagcttacaaacgaacaggatcaaagatcacaaaatgttaaagcctgtctcacctaaggtagtgttcagtgttgcaaacattagctttaagcttccccgcaggcaagatgaagaaaaatctacaacagggttcagagtttgcccttttaggaggaagcgtatcacttcatcagaagtggaattccttaaatagagggaagaactgagaaggaacaacgtcagtttaaacccttgttaacacagattatttaccccttgttttcaggttggcactgaattcacgacagtcttgtacaatttcatgtgtaacagcagttgtgttggagggatgaaccgccgtccaattttaatcattgttactctggaaaccagagagtaagtggcgtatgtaaaattgtcattctacacaaaaaatcacgagcagagggcaaagtgaaatcgtggctgctttatcattaattttgcatgtgcagcggagagcttgtcctttgtgctctaaatccttgctacaaacggttacataaaagatctaagaaagtggagacaaaggaaggtgggtaaagttagaaggaaaaaaagagctagaaaagtgtgcaagtcacttcatacctgaattcttgacatttgactggaattgttctgattagaccatggtcctcaaggcatttcacagttttttttaagtctgcgctgccttaggggattttatccttgagacatccactggcttaactcaagtttccttcaaaatatgtagctaaatacagctgttcagctaatagctcagaggttctttggagaacaaatggaatgttatttactaatattacttgtggcatgttagcacttttgtgttctgccaagtgcttttgggtccattctcaaagccgccatggctaagctggtagtacgttggcgatggcccatatgggaagtggaagtggtagatcttcaggggactttcaaaatgctttgaatttaactctttcttcccctttattctaattcctagtgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgccgtaagtagatgtagtggccaaatggggtagggttgaatcttctccagatgttggagaatggggtgatattggagaagctgcatgataagacctgtgaccttcagcagcaagtgggacgtcagccctcagagccagtgagaataggtatagcattgaagtggactccaggcatgtactacagctttacaaaaacaagtagtcattgtgacaatttctcagtccagggattctcaaaatgtgacttccacaccagtagcataaacatcatctattcacagacacacaccagcaagatacgggctttcctgcaacattacttaagccaaaggctatttcccagcatactgaatttcttttatgtattcttccctaccatccttccacctccttattgctaggatcacaatcaatgtaaaaacaattgtccccagttaaatggacgcttagggctagagcctctaatcttacatgtgttgctggtactactgtctttttaatatgtatattaaatctgattaacattaatatttaattattaagtatatttaatatgcattagtgctttagaagtgttcccaggatgaaacttgcatttttcctccaccagcgtttcgtcagaacacacatggtatccagatgacatccatcaagaaacgaagatccccagatgatgaactgttatacttaccagtaggtcttccttgggtgttcatggttgcttcattttaaccttctttgaatgggcttttacagtatgatcatcatctcattatctgtgacaatgggaaaggaggtgtcttagtcagttgaagctgctacaacaaactaccgtagactagatggcttataaacaacagaagtttattttctagagtctggaagtctgagatcaaggtgcccctatggtcgggttctggtgagagttctcttctgagttgcaaactgccattttctccttgtattctcatatagtggagagggctagagagctctctagggtgttttttttttttttataagggcaaaatcccatttatgaaggctccactctcattacctaaattacttcccaaaggactcaccttctaatgtcatcacaatggggttaaaatttccatctgtgaactttggaaggacagaaaccttcagtccataatggggaagaggggagacggttgagagctggtgatacaaaggagagaaaatatgtgttttttaaaattagaatattattctttctctccacagttttggactgtattactagcatgagcttctctacttacctacccacccaactaaagctaaactcctaacagaatttttcttaccctaatatttaaaattaatttgtccttcattatttgagaatgataagattatcctaggcagcatggccatagaaatttaggccgaaaatgttgtcagaaaaagttcacaaaattgataatgcagcaatgatagccttgactttgatgtcttttaggcagcactataaagaaagccaagcaaggcagaagcctgaattacagtcagccctccctctctgcctgttccatatctgcagattcaaccaatcacagatcaaaaatagttggaaaaaaacaataaaaaaatacaccaatcaaaataatacaaatataacaacaatatagtataacaactaattgcatggcatttacattatattagatattataagtaatctagaggtaattttaaactatacagaggatatgcataggttacgtgcaaatactacaccattttatataagggacttgagcaacctaggattttagtatccatgggggccagatgggggtgggtagtcctggaatcaatgctctgctgatatcaaaagacaactgtgtatgtaaatggccagaagtcttagcccaattattatgtaagaacctcattaattcctacaagggacattacttctcttgcaatcactaatgagatcactttattagattatggttgcagttagttagttgaattcttattgcattaggtctttgccatgtagggtggcaatgacgttttggtggctggcatagcccttgatgccatctaaagcgatgacatgagacacagccaagcagggccaggagatttgaccatgaactactaccctgggattgaactaacgaaagtcaacggatttaggtgtgctgcactttcttcctcatcttctttgggtcctgactctcaggggaataaattgccagtagaccaatcagacggtgagttagctgagattcccagtgtcttgtttctcaaggtatatatggaaactgacttgtgatgttaaagtaaaacattaccctgatacactaaatattccaaaagtcttaatatgttttcagctgataaaacaggaactgcttgaaaaattattttaaaatttcagtttgtactaagaaggaggtatccttcttagtgtcatgtctcaagttgagagaagacttagcctaaataatttatgggtgaggaaaaactccattaatttaatatatattttgttggtgtttggtgagtggcaaatatgctagaccttgagcatttagagttcagtaggatacaattcttactttcaactaccttgccttctattgaggacacaaacagttataatgtaataaataaatgtaatgtaataaaataaatattcctagatcaaggcctagtgctgtgtgagtacccaagaagctccaaagatgcaaaaactataaataagagtaagatcaagaaaagcttctcagagaaggggtcccacagctgggatgagtaagagttaattcaacaaaaggtggagaacatttttcatttctgaattctgactaattctgcctttcctactgggtgcagcaactggggtaaggcagttaaagtgcctagggtgcaaaatttaaatagtcactcacacccaaggcaatgcagttgtgctaagtgcctctcttgcctcactctagtcctggcccggctcatccgtttttttggtttttgtttgttttgaaacaggatctcactttgttgcccaggttggagtgtagtggcaggatcatggttcactgcagcctcagactcccagactccagcaatcctcccacctcacctccccaggtagctgggaccacaggtgtgggccaccacgcccactaatttttgcacattttgtagagaaggagtttttttcccagggtggtcttgaactactgagctcaagcaatctgttccctcccaaattgccgggattgtaggtgtgagccaccatgtctggcccctgctcataattgtaaaagcctttaagagcttttatttaaagattttaagggactctcttaaagagagaaacatattttatcccacatggaaacttttatcctatcaaacatagttacaatctattcttattttttgtagtagtttagttttatgaaggtgttgcaaaaatggtattggtggatatgaatcatctcatcgctcctaagagaaatataggattgggttcctatgcacctctggtcacatacatttcacaacagaataatatatcacttcgtttgttgtgtgtttctgttaagagacattttatttaatatataccgttgactcattaacatcagactcgtggccaattagccttataactcatgcctgaataaagtttctctaacacacacacacacacacacacacacacacacatattttctccataaggcatggaacgaccttctctcacttagggacactagatagcacttccgcactgcccttgagggtcttttaaataacaaaatcaccaatgaaaagcacaaaaatgtaaaacacgtggcgctaaatagaccatgaaaagaacgtgggtttacggtataagagctacaagatgacagagcatctccttgttcgaaccagctgggaatgcacacaggtgactcaaatttttcatcactctgcccgggtctgaaagaccacaaaagggccaagagtgttgattttcatgttacaaataaacgttagcaaataaacaaattgcaattacggaatcctcaaataatgaggattgaccacacttctaacagttctacagcttttcatgtttccttctttccttctgctcacttccataggtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagtgagtgtatcaacgtgtcattttaggaggcatgagtgagggtgactttatttggatcagcaatagggtgattgatgagcaatgtggaacataatgggagatagcagattgtcatagattcagatgacctggtatggcaaccctctttcagttgcaaccttttttacgtgtcttattataaccttcccttcagaattccacttatgttctgaaattaaatacaaaccatttctggtgaattacaaagaaactcacactaacagttctcgtctctatatgcctggtccatacacactaacagtaagtacacactctatttggtagtgatgtgtatatttgaaaacatgaaatcttttctcatcccaatggattgtcttataaatctcctgggatgcacactatccacttttgggaataacactgtagaccagggatagcaaataggctttactataatataaagtgacttgtttgaatgctgtaatgagaagaattctgagacctagtgcatgataattggggaaatatctgggtgcagaaggataaggtagcatcatgttgccgtattttagaatctctgctctagattgtcttccagcagtacatttttggcataaatcaagccagatttttcaagtatattaccatatacatataacctatttatatgttaagctttgccttgaatcttggatctttcctaaagtgattttatgactgactagaatagaatagctcttatgaaaggatgagaggttgaccaatcaggaccttgtttatatttacctttctgtggttaaaaataatcacttgttagtttaattaaaatatgatatgtgtcctggaagtattgtcagagactctgtagataagtgtaaaatatatacattatgagtccacttgagtaatgtagactttcaacttcatactttaggcaaaaaagaagtcaaaaactatcttccagaggcaaagattatattttacaatagaaatgcaaatgaacaataaaaatggttattttctatgttattagctgttgtagggagtcagctgtggaaagtgtaataaagagggcttatgattattattattattattgagtctcgctctgtcacccaggtaggagtgcagtggcactttcttggctcactgcaacctctgcctagcgggttcaagtgattctcctgcctcagcctcccgagtagctgggattagaggcacctgccaccatgcctggcagattttttgtattttttagtagagatggggtttcaccatgttagccaggctggtcgcgaactcctgaactcaggtgatccacccacctcggcttcccagagtgctgggattacaggtgtgggccaccgtgccggccttgttattatgttttaatcaatatgaatgtatctctgatagtgaagaaacactttctgagcacctgttatctacagagtggagtagacggcagggagaaaagaggcacattctctgttcaaaggactctaagctatttgagcatccaagatcctttttggcccgaagggatctcaccatttacttttagcataaaagttttgcaaattttaatggtatggttttatttgtaagcctgagcagaaagtttaatcacacagtgtattctgaaggagaattagaactcagagttgcagacacaatttccattgctaatcatatggatgttttgggatatcagatggaaatatatactaacatatttaagtggaaaatgatttagttcttataaaaccatacaaccaggatcaaagaaacagagacctgtaacatcatttatagacccaggagggatatctacctttcctaagatatgtgtgtcatggtattaagaaataccctcaaatttcctcctgttcactctgaaagtttgactataccaaaatgacctccaaaacatcactaagtaatatatcatgctgaactagttgctcttcagtactctttcctgtctttttttttttttttttttcagttaataagaaaaggtctcatatgtagtacaggaattggcaagctgctttttgtaaagtcctggtagtaaatatttagattttctgggtctatattgtcttttgcaactactcagctctgtggttgtagcacagaaacagccgaagataatgcataaaggaaagagagtggctgttccataaatggaactttatggaccctaaaatttgaatttcatataattttcacatgccgtgaaatattattctccttttgattgttcctccccctattaaaaactgtaggccgggcacggtggctcacgcctgtaatcccagcactttggtaggccaaggtgggtggatcacgaggtcaggagctcgagacgagcctggtcaatatggtgaaaccccgtcgctactaaaaatacaaaaattagctgggcaaggtggcacgcacctgtagtcccagctacttgggaggctgaggcagaagaatcgcttgaacctgggaggcagaggttgcagtgagccaagattgtgccactgcactccagcctgggcaacagagagagacttcatctcaaaaagaaaaagaaaaaaaaatacatacatatatatatatatatatatatatatatatatatatatatatataaactattcttagcttgctgtagtttgatagtctgtcttatagataaatgcgtggatctcctttcattgcttcttgaggctccaattttgtttgataggtgtacttggaagttaatatgtatattccaagctagaaagttattaaaagattttaggaaatcctaaagtggtttttcaggtggcatttcagtatctaataaaaagcaacaccagccttgaacagatatcttttttgtctgagaaagtgaggcatgcccatccagatataaaatgtagttaacgacacaacctcattgtcagatgaggctggaatagttgacttgattcacgtcacatattcttattgaagatgtgctatgtgaaagcattaaggatagaggtgagaaagatgtagctcctgccttcccatggtctacaatttaatggtgaatttctaaccttaacactctgagtttgaagaaagctctggaaatttatcctcagcattgtgcaagttaataggacaattttaaacagtttccatggatcatatgagaaaaagaatagtttcatgtcattgttttagaaacttgacaagccaggaggattgacatcattcagttcaggggcatatgctaaatgtatttgtttttatggcatacatgaaaatacataaccctctttttctatacgatgagtatccagtgcttattgtctgaccggctcacattgctctaaagggaattttttattcatatttcataaaataatctgtgtccccagagaagaaaacacatgttaatattgtgttatttttaaaagcacacaagattttagggacatatttacacttttttgcatgtgtggccacagatagatagtaaagaactagtagcttcatagttccctggtgtgttcatttaactgtattatatgcatgcttttgagttggtatctcacagctgtgataacttgtgcatggaaatctaacagactgcaaaattaaatctttgcaaaatatagacatttggtctaattatgtctttgtaacattatatatacatgggtctccagtgattgatatgcatctatataaatccttcagttgaattcttcagctgagtttttttagctcttattttcatgcaaatctccaagaaagagcatgaatgactaaacaaagaaaaacaaaaatctaatttcctggcaatcatttgaaaagaataaatcagcttggaaaatacctataatagcctgtgattttctttccaaaaagatagtaccaattttatgctggtaaggaatcaattttgtatttttctttatagtagagggaaaattagtgggaagagaacgtactttctgtaaggtggcactacaatatttttactttaattacttctattaggttcccactatgtgttttcttctgcctgcttttcatttgtgcatggtttttctttttaaaaaaatttcttcgcgtttaccttcatgatcataggctttatcgaagatagactttacagagctgctgtgaatcaaattgttatagatacaagtaggctttatattacgaagaaatgtgattttagttgatttgcttacattggaataaatatagagagttatgtttctagatgccagaatctaatagaaagacaaatcggaccctatctttagacttcttgccatcctattatcaagggacatcaacgcttaagacagctttgcagaagcctcttgagacctatttagcaacgttttgacttctgtacttcagatcagtactatttcttttttcatttgttagttgttttcccttattcttggcttccaacataaaagcgaggctgacatcactttgttacagtctcgcttaggctagctcttactttcctctggaaatttatttttgagcttctacaggatgaattttatttaaatgataaaacagatctgtgacatcctgatgagcccttagtgtttccttctcttttatgattacttgacaattgtggctcattagtaacacaagtcagagattattagaacaaagcaggatctccaagtccatggttccagcccctcacaccatagccggataaactgaggctctgtgaatttatagccagtttataataaagctaagactagaatcagatttagaacatagagctctttgtaatgttgtgttctgctacattggcagttaagtaagtagttaattataaaatttaaacatctatttccatttttctgtctcttttttgtaggattgttttagagatggggtctagctattttgcccaggctggacttggacttctgggctcaagcgatcccctgcctcagcctcccgagtagctgtggaccacaggcacaccccactgtgcctggcacgtttttctgactctgttgttagttacttggtatttattcttgtaggttcactttaaagtcctgtatctttaaacttgtttggcgatggttatcatcaagaatattgatatttttttctcagattcatgtatctgagggagaagcaggcagtattttcagtattatcaatgtagaaaagagaaaggtacacggtctccaaactgatagaaaatgtcaacaccgtatttctaggttagacagagaaatcctccacgtttccagaatatctgaaattgccagctttataggttaaaaagagatgaatattgataatttcatatgattcacccttatagttattatggaactacacaagcttttacagtttcctttttttttttttttttttttgagacagagtcttgctctgtcacccaggctagagtgcagtggcatgatctcggctcactgaaacatttgcctcctgggttcgaacaactctcctgcctcagcctcctgcgtagctgggattacagatgcctgccaccatgcccggctaatttttgtattttgatatatatatataattttttttttctttttttttttttttagtagagacgggatttcaccatgttggccaggctggtctcaaacccctgacgttgtgatccccccgaccttggcctcccacagtgctgggattacaggtgtgagccaccgcgcccagcctacagtttacttttgaatttcatagttatgaagttttcagggcagagatttattatctctgaattggtaatgaagaaaaaccatagagacggggtttcaccatgttggccaggctggtctcaaacccctgaccttgtgatccccccgaccttggcctcccacagtgctgggattacaggtgtgagccaccgcgcccagcctacagtttacttttgaatttcatagttatgaagttttcagggcagagatttattatctctgaattggtaatgaagaaaaaactcaatgattaattaaactcagatagattaaattacttttgtaacttctctcacctcattgcagaatcaggctcagtcctaggtcttagaggtctttagttagctgtacattgcttccccatccatttttattcgggcatattctgttaagatgatatcaattcttgccggtgacatggtttactgaatcctagcattaagcaaataaaaatgactttgttcctttgaaaggcatagccaaatgtgattcaagaagccaatctgggaaacaatttccaaacagttcatgagattgcccaactttcagcaaaataaaagggtttatttctggcatcctcgtggtgtaaataatttcttaattatgcaaaaaattgctttcttgggtttgatatatgcatttataggccgagttttttactcaaaggattaaggtatttatccatctcaatctgggaatatccaaaatactcattaaacagttctttgtaaatgcctgatgccacaggccccattctgataatatcatatttctctatacctcacacttaggctagacaagaactgtaatgagggataataattgaccagatgacattttacaaaagattcaagtttcttcttcttcattccttttttttaattgagtccagtaaaccgtatgcgaagcactgtgttaaataccttgatctaccttatctcagtggtcctcgactgaatcgccttgtgtaacttattaaaaatatgttttcctggatgccagcttgtgttggaagggagccaggaaaatgcatttttataagtttcacaagtgattctgatgtttatttctggttaactactatagccttatcccatttcttcctcataaaaatcttgagaagtctcagtaattgtaaaagaagataaattggaagaacaaaaatagcttttcaggcactctattctgtctatactatgatcatgaaggtataaggagtgtgtttctgaattcaattgatttgaatagatgaagtcctaggccttcattttttcttttctctggttcctctctgcagtctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttatcttgcagtttttttgtttctgtctctctcactttttttccactaaatactagaatattctcatgtaagtgcttgaagtagcatgtgtaggtctaaggaacaagaataataatagaatcatcactttgttcctacgtacatttcttctgtcagtatttggtatttttatttaagatactctgtatcaaggtcatcaatcgtaacaaggaactaaaatgcctaaactaacttaaaaaaatactttagctctatgagttttaaagtttgtcctaggaagccagacaccatagaatcatttattgacattcctgacaaacctctagttgtatgttaattcgccaaatttactaaagtgaatttcaatcaaatccaaatgttttaaataacatggcttctgtggcatagacattagcaaatatttggccagaaatcaacagtggaacctattgtccaatttttttttttacttatgttttgagccctgaataattgcttttaaaagcttcataagaagttctaaccaaaaaaaaaaaaattagtattttagataaatatttcagaaaaaaaaatctttatatttgagataaaagtatattagtaaaaccagatgctcctgttatatttgcaaggtgtttttcaattggtctaataactttgattcacaaagcccttaaaggattggtgagtatgtttcgttttttgatatttgcttttctttcagaagggtttttcttttctttcagccttttttaagtaagtttttaatgtgtttatagtgacttgtatataaatgcacatatttgaaatgatggaaaatattagaaaattacagttttcccatctagagaataaatgctgcactgtctttagtagccggataacccggctagagagaaaggtcacaggtaggcagtactgggtaaaattgagagaagatatgattctttttctgatggtccatgttttcccttttttttttttttttcctgacctttctcataacaaggatgctctgctccgccctcagtatccctttctgctcccaaattctttactgcagaaatggtttgttgaaatagatttggcctaagctatcaccaaatcctactagagggttgctttttaatgagcagtggaagattttagccaaaagaaggaatctagtggaattctagacatctaggaggtagatagtgtaacttgtgtctgcgcaggaattttgatattctaccacatagatagtcactagggttggaaccagaaaacctgatttgaagtcctatatgtcctaaaaccacttctcgcttttcaattttgaattttattcttcggaaactgtgcagaagcttatattgttaaagttaagaactgggacttggctccaccaggatttttcttcaaagctggaaatacgtgaaatatgattttctacatctctgttacactgaattcttagaaaaatctagtgaggctctagagaaaacaacctgaggtatacaccttacgatttttttctgcagacagctggattcttacttttttgggttttggataggagaggagagtgtaggcaagaaaaccagaatggtacaggtcctgttattcttctgaacacattttccttctctttagtttctccagaaatttttggaatatttcacttaagaactattgtattaaatttgtaattttttttaaaaaaggttgttcttcaaggctttcaaattggctgagtttattcagccttgcttcctttttcaccgtatgtagttttcagaatgcttcttctagttcagtcattttgaaattaataatagacagactaccttgcttcccttccgtgtggctttaaaactcactttcatattaaagggaaggcattccgaatttctgacctttcctgactgttaaccccattcaactgttcaccctcatttctgggtatgttcaattaagaatccaactcacctctggccacttcctcctattaattcttacata

SEQ ID NO: 17190 - DNA, 141455 bp, Human
  misc_feature (1)...(141455): n = A,T,C or G
aatattttattctgtgcgtagacagcgttggttaactaatcattttcatttccaaccatttatattgtgttcaaactacaatatactatgaatatttgtctatatgattattcatcttaatgttatcttccttaagctatgagtagcccttcaatgtccgggaatatacatctggttcaattctgaattactagcatctgtttggcttctaggtagtacatgagactgagtagcggctgagagcatgaacgtcgagtgtctctagtctcattttgtattctccacttgtaggcctgtagccttggtcaagttatttaaattccctttatctcctttatgaactggagataataatagcaccctccaggttgtattgagggttacctgaattaatatacacaaagtccttatgattgcacctttttattttgtaagcactgtgtaaatgcttcagtgtactatatatatataaaagtctgtgcccagaatatatttaaggaatgaataataaatcagaaaatgttttattgttgcttcatacaggtaacattttaaattcttttggattattttctctttggttcagtgacaatgttgtgagcaggtgctgggtcccaggtatcctgagataaataaaaattttgagcaattaattttcataagtgatgtcaagaagtaaagtatcatgaacatttctatggctccaattacactgatatttcaccttaggaactgaagctccgccagggcaggggcagcctctgagtttcgtactgctgtgcacctttagcagcacgggcacctgctggtttcatttccttcccactcacctgggcccttttcttatttcacatcttttttctccttttccttaaatgctttctctgaatcttgattcttgaaaataaattagtaggattcagttaggtaggaggaggagaaaagaagatgtgatgagcaagaagatgtgcgaagactcgtcagtctggtaggtggctttggttagggggtttcagaaatggggacaggtcatgaagggccttgccagtcaggaaaaatcatgaggcactagcagtaggaacacagcagaaggtgcctgaacaagagagatgacttaatgaaagcctttataacgcttcccgggatatattacagactaccatctacagtggcagagggcagctgaaggaaggctcttgcaaaaacttggggaaatggaaatgaatgaaggcaaatatttgttttgagattatttccttctatgtaacctattagttcttttattcgttccccatacatgtattgagtgcctactttgtgccaggcactgtgctaggcaatgggtatattaccagtggacaatacagatttagtcttgctgtcatgtcctgttgcttgctcatatgaatgtcagttcaagacagcaagagctcaggactgcggagatcgcatctacatcctgccgcgctctgtgccggcacagggtggttgcgaaaatcgtgcagtctgaattgattcaaggccttgcagcatgattgctaaatacgtcgagacaggaagaaagggcagggtggcaccgatctcaactgcgagagcacgatcttgcaatgagcgcatgtgtgcgcctcggtgtgtagtgaggggcgtagcttcccacagcgcctggcagcgtgccgagctgcgctgcaggactaaccctctcctttccccgcgcgctcaagcccgcacaggcggtggcagggagccgaaggggccgagcgcagccttgcatccgtccgcaggcgggcccggcgccgcgcctcctggcggcgggcgggaccgtccaggacgccgccccgcggccgcagctcctggaagcccagagcgccggtggatcgcgagccaaggcggcgggtggagcctgagccgtgaggccgtggccaatcgcgccgctccgggggaggagccccaaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggtgagtctcgcgccgccgtgagggctcagaagtcaccaagccgcagaatctcagggtagacggattcttagagatcctatcgttaaaccctcctactttacagaagaggaaactgaggcacagaacgaggcagcggctgggataggtcatactgctagttaggactggagcccggattcgaacccaaacgttcagagacccatctttgctttgcagggatttaagtaacgcggttgtgggacgtctgctcgttgccgcccccatcctcagccctttgaggggtctacccttgttttcctcctcaccgccccctccccgctaccaccccccgcccccatctcctccttggtttctccagaccgctgctggaagcgccgaggacagaaggaagcggtgtgtcccagcacgcccactcggtatcacgtcgctctcagcgcagagctgtgacagcctgggaaaatgctgcttgcagcctcactccctcttcccctgacctgctttctcagaaagatgccccttcagagggtgtcggaccagcttctggaggagcgcggggagagaggagcgaggcccgggcgccagtgacctcctatggtactgtttcttcccagccccggaggaagcggagctagtggccctgtggggcacagggtgcccctcacttgggaagagctgacttcatggaaccatagagccccttccctcttctaaatactgagagggagcaaggaagctgagttaaagagaaaatcacaaacataaaagcaaacttcggctgtttcctttaagagctagcccacagcctgtcttccctccaccttctggttgtgaaattgtgaaccagggcgccacgcgaagcattctgctgctctgctgtacagatccctggtttagctactggatgagaaagaggacttgagttttgactccagctcttccatgtattagcagtgtgaacttgggcaagttatctcacctttccgatactgggtttttcttttctttctttcttccttttttttttttccagccaaaaaatggagatttataatggtcacaatgagccctttgggtagttggaaggatgaaatgggatcattcaagtagcatgtttagcacagtgcctggcctggcatctggttggttcaaaaccaatggcaactattgtaaatattgttacatagtaaccttgcagacagtgggttttcagaaaggtgatttcataccatcttacagaggcattttaaaaaaatctgtaaatgtggtgtctttcttcttttgaatttgagcaactcttttataataagaattttctgaatgttgtccatatgtgatgtggatcatggatgcttagctcgaaatgtaaaattgatgtttctcggtgatatgaatttcctactagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacaaaattctcatatatttcttttggattgtacagagatgctgctaaatgcaaacctttctggacacaaacttgccttatttaaacacgaacacacagacattcacatgcccacactagtcttcctgtattattggtattttaaagttaaatggattccctcccacacccttaacccttctcatgacaattgattttattctgatgaacttcatgcaataatttactactatctactggctttgccatgcgtccttaaattgagtgtccagcatttgtagttggctgcctccttcacaggccatagcatttgtatgcagtattggtaagtgcttgagaacagagtgtgatacatcttgatggaagataagagcccagtggtgcccacttaagtacctcccgcaccaagcattagtaaaggatgggatcacctgcttctatcagcttgttccatgtacatgcattgtggtgagctggctgggatatgactgaatgtgtgcctgagagacaggggccttgtgggggaaaaggaaaatgttcaaaataaggtcagatcatgaggatggaagggagattaaaagctaattcctttggttctgattcttcaaagaaaggttggtcaattatacccatatcttcatacagattattacttgttaccaaaaccatatatatgtatagaactttaaaatttccaaagtgcattctgtatatatgatactccttgttactcacaatagccctgggaggacatggcaagaatattaatagaggaaggagcccaggttttgtggtcagacctacttgatttcaaattccagctctcatgcctgagtagttgggtgatattgagcagtttatttaatcatttgaagtttctgttttatccagttctaaaatggaaaaaaaaaatgcttactttaaaaatctgtataacgaataaattcaatagaataatgtcaagtacatgtagtgaataggtgctcattaaatgatatctcttcttagctagtctcaatttatttagaacataactggaatgagactcagagaaatgaaaagttgctagaggtcatgtgttagtatgtttcaactctgggaatacagttcacaccttttcatgtctagtttagggcatttcccatcacactctgtttcctcgccaatgagatatttaacaatttacttcagttataaagttgaccttatttgtctggttatttcaggatatcctttttgttgaaaagcaggtattttcttgcaaagagaacaatccttaagcacagttctgtagagtttagtggagccaactgtcataagagggtatttaaagcaatggtctctaagacaaccttcctactctcctgtgttggatgtaatacacctttgattcctaagagaaagggtactaactaagaagacataaagtacagaattatatcactcttttcttcctgttgtgagtggtttcttccctctgccatcctcatgctagttcaaaggctgggaagaagattgaacaacaaatgttatgagtgtccatggcattattcaacttttttttttgacaattttgtgggtactgagtagagtagacagaataatgtgcaaaggtggcatttgcagaaagagaccactgcttcctggtggtgctgattacttgtctggagtttcactcctccttgtggaaagtgatggctggaggctcatgttggaagatgaagggatctgtttctggcccaggcagtggggctgttcatctgctgagacttctcataggccattagatttctcttctttgtagcaagcacacaggcttgcaaacgcagatgtagaaggaacattttgctccttgcttttggcattttggagcatatgtttgctcctataggtaagcagttagcatcatcttacctggcacggttaggaaagcagaatgtggcttgaggaaatcagaggacgtagaaaaaaacaaagattatctccagcctatacacagcttcatttgttgctcaacttcatcaggcttttgctggtgacacagatgtaggatctggtgagtcactgttgccttgcccatgaaatattaaagagagccacctactgtgctctttgcccattttggaaattgttctgcatggaaaaaaaagaagaagaaaagaaaaaagaaacaccaaagaataggaaggttacagaacatttggtaagtgatatttcggtggataaattcaggttagccattcatttgctgccttttttttttttttaaatgataatgcatggtttacactgatagggttgttaggagacatccctttggtctgactttattctaactctctgtagcagctgtggtagtgtggattttgagagtctggctgaaatctgaggcaagttattctatagagatgatcttttggctctgcagctaggaaatagggacactgatgcctgcttagaagcttaagtccctatttatttcaacatcttattcatagaaaacatttaataaacactgattctgtcctctgctaacaactccttcaatgtattagtctgttaaattacgatcatcataatttaacaggtactctttacttgtctccatcattatttgtgctgagtatcttaaatatatcatctcattcaatcctcacaataatcctgtatatttttttaggaaaccgaggctcatagagttacgtagcatggcctatgtattagtctgtgttcatgctgctgataaagacagacccaagactgggcagtttgcaaaagaaagaggttcattggacttatagttccacatggctggggaggcctgacaatcatggcggaagtcaaggaggagcaagtcacatcttacgtggatggcagcaggccaaaaaagagaacttgtgcagagaaactctcattttgaaaactatctgatcttgtgagacccattcactatcacgagaatagcatgggacagacctaccccacatgattcaatcatctcccactgggtccctcccacaacatgtgggaattatgggagctacaagatgagatttgggtggggacacagagccaaaccatatcagcctgtgtaacagcacaaagcaagacatgatgctgagactcatctacgcattttattctagagttaggaagaacttccaattgtcccacctctggactagaactgaggacttagactaagaccaatgacctacccaatcatcatcctacatcctcatcccggtactaccttgcctgtgactgagaaatatctttacctttggacctaaaatgtgggagagctgaactagatgatctctaaatttcttctgctataacgcattgtgtatctttaagattcctttcaactttgagattctgtaatcacatctatttgcaaaagttaaagctaaaatggagaaaggggagtaaaaagaaaatactcttattgttttattccctggagatgtatttttctgaacaaacaaagatgagcaagagaaatcagcatttcatcggcacatgtacttttgtcatttcatttaaacataaaaataactctcagatatatattattatttgccttttacaaatgaaagaactgaggctcagagagacttatagacttgcccaaggtttcctaattagtaaagattggaacctgcgtgtgcctgagtgcaaagccttttggtccactacagcatatttactagataccacaccatgaaatttggaaactcatataaccagattcgtaaatgccccatctctgtatcctcacatcacactacctcagcttctgtcttctcctcttcttctactctttcctttccaaacatactgctccaatcctttcttgattctctccagctcacaaaaccccttttaaatgcatataacatcttctatctctattgttattattattattttttttactgtggtcctggaatttgtaatttgtgcttttgtttttgttcatccccattgggcacaggacagaataagctatgccatcagctgagagacttacaaatgtctctatctaatctgtgtgtcaatcatctttctatctagctctatttattagtgaaattaaagaaagatagagcatattaagcccctggctcttaatagttggcacctagaagggacttggtaaatattcattccttcctcatcattcagcactgctgtttacccaaatcattactcatttaatgaatctcagatggagagggggagtatattgagtagatgccccagctggtctaagagaatgtgccacagtttggcaagcaattgggatggtaaaggataggaaatgaatgtgatatttaccttaaaatatctgctgaggatatggtttattctgccctgtgcctagcacagtgactcatacataagaagggcaaaattgaacggatgatgggttcatattatgtcagtgggcccaaaattgactttctggatttctcgtgctttatcaatagtattagttgtgtcaaagtttgcctctacagactaataaagtagttttaatttcctttaattttgtggtcacaaaatcagacaatgataaggagtcataggctccaagaaagttagacattactagctcaatgatgggaaaacccatttctgtcctaataataaagggcattttgcagaaaacacggtgaaggatgatgctgaagtgcccgtttgcatatattgacagcaagaccagtgtcaagtatcataaataaattgccagagagaaagtaggaagtttccattgaagtgggcagctgcaatgagcttcgatctcaagatttctaaaagcattgaagaatttacatcacttcaactattattttctgttgaacatgagaacaggtaaccttttatgtctagtttatatccagcagatgcttgtgatttctacctttctggcacaaaagtcctcatgattacacggcttcctcctctgccaatcaatgctaatggcaagagaaatgagaagcagtcattttataagcattatgtctggaaatgttcctttcgttgatagcagtttcttaacgccagtatggttagatgctatggcaacttaaaattgtgtttccataatatagtggacattgatgtcaaactgatctgcctgggtttgactttggccgaattatttggtctatctttgccttatttttatgatctgtaaaatggggataataaaacccatcttgtcaggcctttggtaagtgtcaatcatatgccatgacatttgtcaagaggcttatgcatagggattttaacctctattacaattaacaacagcaatgagaattgttccattgcatgcccagatggatactaaattagaaaaagaaagatccaggttgaaataataacagcttttttttaatatagaactttaagtcgtcaaaatgcttgttattgtatatgcaaatgtatacacatgtaacattttttttttgcaataattctgaggtaatcagggcaggtgttgctaatgttttacatcatgagtctcaaaggggctacatatttactacagccaagcagctaataaatagtagaactgggacttggaccctagttttctaactccaagattatgtcattttttttttttttcctcagtcaatcagccctggtcctggttagttgcgtttccttctccagactccttgctttcaccccgaaaatgagcaatttggaaaatattatgtctaaggtagagtgttttataaatctgtgactgtagaacaatgtcttaggaggtatctcattggcctcggtgagaattacaaccgggtactgcacggagagtcagatccataaagaaccctttatgtccttaaggatgtgattctgccacattactctgacctacagatcattccccatctgccccatccccttcaggacccaggtttggggatgggaagaaaaagtagatgactcggttaggcacatggacatttaatatttgggaaatgataatagagcctttcttaaaaaaaaagcaagttctgtatcaccgttaatctccatagttttctacaacaaaataaaggagaaaatattttgctttagtttggattctagcgttgagtacacattttctgctttcttcttttgagctcttagtgcccacagaagaggcttgactctcattaaaatgtgagttctttctgtttatagaaatgatggagacttgagaatggtaatacacactaagtagcacttttctggaagattatacttcagtttcccaattacagagtgagacagtggtgggggcagcagattgaatgaatagagtagatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttccttcctccctccctcccttcgttcctcttccttccttcctattatctatgtatctttctatgtatctatctatgtatctatgtatctatctatctatccatctatctatctatctatctatctctatttattaataaggttcaagtaagaaaaaatatattaagcctctagcttttaatagctggcacctagaaggcactcagtaaatattcattccttcctcttcattcagtgctgctgtttacccaaagcctctctcatttgatgaatctcagatggagagggggagtatatcaagtagatgccccagctggtctaagagaatgtgccacaatttggcaaacaattgggatggcaaaggataggaaatgaatgtaatatttaccttaaaatatctcagaatctttcatgtgtaggaggaattagaccagtgataaattgcagtgcatggatctttcacaacagaatcatgtggataccttctgaaatgagcagatatctaggatatctgcactgaaatctaagaatcactggattagaattttcagtactcagaggcaggatattgtaggggtttgaatttggattcaaattctgctccctcagtgtaaacctaaggaagttatttaacttttctatgttactcattgggttgtggggagaagtaagtaatttgatacatatgaagtgcctaaaacacagttttacttactgtataagccagtctttgaaataccttgcatgactttgtttaacttacattttatttcctctctaactaaatgtcctagataactacttggctaactctttcatttgcttaaagtctttttcaatatctcctcagggaagcctacttggattgcttgaatttgcatgggttggggtaggggaagcaggaatagggctgcttgctctctgaaatcctgatctcccttaccctactcttatttttcctttattctgtggcatttggtaccttataagcttacacatactattttattattttatttagtctatttttaaaatttaacttttattttaaattcaggggtacatgtgcaggtttgttacataggtaaccttgtgtcgtggggatttgttatacagattatttcattgcccaggtattaagcctagcacccattagtaatttttcctgattctctccctcctcccacctatcaccctccaatgggccccagtgtgtgttgttttcctttatgtgttcatgtgttctcatttagctcccaattctaagtgagaacatgcaggattaggttttctgttcctctcttagtttgctaaggataatggtccccagctctatccatgtttcggtaaaggacataatctcattcctttttatggctgcatagtattccacggtgtatatgtaccatattttctttatccagtgtaccaatgacgggcatttaggttgatttcatgtctttgctattgtgaatagtgctcagtgaacatacacatgcatatgtctttataatagaataatttatattcctttgggtgtatacccagtaatgagattgctgggttgagtggtatttctttttgtaggtctttgaggaattgccacactgtcttccacaatggttgaactgatttgtactcccagcaacagtgtatagtgttcctttttctctgcaaccttgccagcatctgttattttctgactttttaatagtagccattctgactggtgtgagatggtatctcgttgtagttttgatttgaatttctctaatgattagtgatgttttattcatatgcttgctggtttcatgtatgtctttggaaagggtctgttcatgtcctttgctcattttttctaaataggttgttttttcttgtaaatttgtttaggttccttctagatgctggatattagacctttgtcagaagcatagtttgcaaaatttttctcccattctgtaggttttctctttgctctgttgatcatttcttttgttgtgcacaagctctttaattagatcctatttgtcaatatttgcttttgttgcaactgcttttcgtgtcttcattatgaaaaatctttgcccattcctatgtccagaatggcactgcctaggttgtcttccagggttttaagtctttaatccatcctgagttaatttttacgtatgatgtaaggaaggggttcaatttcaatcttcttcatatggctagccagttaccccagcattatttattgaataggaaatcctttcctcatttcttattttttatttcacctccagtagattataaagtccacaaggacagggacacttgatttgcttattgctgtatcccaagtgcctagaatagtttctagcaaatagcaaatggccaataaggaggcaatgatacataaataagtatatggatagatgttagtgtgattatttgtccccaagaagtagaaagagatagaaccggataagacagtaaattatacatgtaatattcaaataaaatttgacatacatatatgcgcatatacacacatatatatacacatttacacacatacatatacatatgtatatataagtgtatgtgtgtatttttggagtgttgagtatatatttaaatattgaagtaataatttatgtctatgtacatatatatgtgtgtacatgtatatatgtgtatgtaaaaataagtgtctatttatctatatatttaggagtttttcaaagctacctgaggaaacagaggtgttgaagtgtttacttgttaggttgctatagtgataggaagaaagatgaaaatatgtacatatgagtcaagagacaacagacaaacagaagaaatagaagtgatttcaggacaagaaatgaaaggctaagattaaaacagcaaccaacattggagggacatagaagagggacagtttttaagtagactagtcagagaagtgatctccgagaaactgacatttgaactaagacaaaagcctgagaaggacccacgataggcctgaggtcgtcactgaggtggtgggccaagtaagagacagtgaagagctggaaataaggttctaagataggcaaggcctaggtcagactggtcttgcaggctatggtgaggagtttggattttacgcaaagtgtagcaggaagtcactgaacagacagaagcaggatgatgagcaggtcaaaggtgtttagagccttgaacagagagtgaaggaaaatggaagaacttatttataagatgagaagaccaactgctctgatttcatcatgtaggctgttatgaacagatgagaaagacaatttggtttcattgatgtttcattcataggctctcgttcccattagaacatttcaaaagggaaaacaaaaacccagctaaaatagggaaaacctatatattctagatgtggctttgctttttctcaaatgataccattcttatttccaaatgcattaagtaatggatggaaatgtatgcactattgctcaattcaattcagctggaaattttacagttcttgtgtaggtgttttatgtaatcaattccccaaaacactgaacctagagctatttccttaggaaactttagctaccagtttctgaaatctgtcgtagtgaagagtaagcatgtgaaaggcaaattaaattccatacaagatcaatttcttctttctgactctacaaatttaaatggtacctaactcttgaagaagtagcttacaggtcatctcttccgtgatgtgtttactgggcccgtgcacatataatctcatacatgcctcttcataatatgagtttaaaatagcttgataacatatgccagactccatttcaaattttctataaataatttctttttgaagtctcggaataaccgtatgtggcaggtgaagttataatcaccattttacacaagacaaaactgagacccggaatcacagagttgatcagtggtagtgtcaatattggaaattgagcaagcttaatcattatactattctgctctttgattgtaaaaagtaaacctgcacatttattcacctctatttgtcccacttactttgtggtgccttatatgaaggaatagttcaataagcgtattgaatcagtgaattaatctgtgacctattctttcaagttgtatcatttcattagcaaatagtgataaaaacgtgggttttagactgaggcaacctaggtagcagaaggtactcactacctctgtgatatggtaaaattactaacatctctaaacctctttcttcatctatgttgttggcacaaatgtagggccattgtgaggattacatgaagtgtgcatgtaaagcacttagcacagttcctggaacataattagagctgagtctatctgaactgtttttattattttttgaactaaaataacctcctcaaacatgattacaattatgtaccaggcagttttttagttgtgcttgttttattaactttcttttaaaaatcaaagccaaagattcaatcatataatcagtgatgttaattttgttccagggctcatcctggcatcctgccctcagcagggcatgcagtgtggattctgaaaggccctcttataggaaggaaggccagttctggagaacagcatgagagcaaaaggtgctgtgtgaccacgcttttttcctccatacatctgacatagctaaaggcagcacttccaaccttgcctgtctatctccctagcctggatctaccttgctggaaagttactttgtattccagcgatgatcccagagcattttgggtgacaaggaaaaaacagcagaagactaaagttttgccccagataacacttaatgaggttaatttacagaacttgctggaggtttaggacctaatattgatcctgtgcctcttgtgtaccaggagctgtgctgaatgtcttagtttcattatctcattcaatccttactgcagccatgtacaaattttagtcgtaaaccaaatttacaactaaaaaataaaaataaaaagtgacatgcttgacatgcttgcctctacgtgtgttttgcagggctgtggtgataaaatcaaatatttcttgtgttttgccacatttttctttgaaagcaaattttgcagcgttgcaacacctctggagtctccagggacctcccctgcagtgaagacacatttggcagagaaatgaggcaaaggttgcatgtggaaggcaggaagtttcattccagttgacagtttactttgacctggaagaagctggtaccaatgagctgagttctattttgtggattacatttgtttgcttctttgtagggaaccaatatggtgcttgtttacatttttttttttttttttttgcttttggtcttgttatgggatgtttaaaaggtgtaacttttatccttctacattttccaagtaaagttcagatgtttcgatattcctgacactatttgataaattattttaaggaaaggtctacacacacacacacacacacacacacacacacacacacacacacacgagaatggtgcctgattcataattggcactcactatatatttgctgaatgaatacataagaaaataaatgcatttcctttttcatctttctctctctgagaatgggaactgctgcaggatttttttaaatggcaagtttcaatatatacctttcttcttaaatgtttgctttaagaataatttcagaaggagattattctaaaatatggagcattacttaatcttagttatgcagcacagctaattggagtggactgtaattcctttggaatttattgaggtgagatcatttacttgtatactaaatggtcccagactgatatactgttaaatttgtgtagtctgattttcataaatttgctggcctttctctctcttattgtctgctaattctcattgcttttggcatgtctggctctccattccccatacaattaacagtttctactttactgcagactaggaagctgggtaatgaatttgttggaccgggcatataataagaatacatagctttgaatgtggactagagagactcttttccaaggtaaggaagttaaaagttatggctgctatagaaacagtcttcatataaggtgataccacacatagtaacactgggtttcagttgcctgcgttaataaaaagggaggcttggtagggataattcatttactcttttggacaataagcattttctgagaaacttctgtaggcaagacactggtgagatatagagaattaaaaaagcaaatacacaaacacaactgaaagataaaacatacacaggggtttataatacaatttatacagtatttcaaatagcatgagaatacataatgtactttgaaaagatatataaggtaataaaacatttttgtatttcagaggaaagacaattgtgtaactcaggaagggctttataaggaagttgtatttaaagtgagtcttgaagtgatggacaggttggacagagagagattggtaaggagaagtggtaaatgaattatggtctgaccggggtgagtgaatgatatggattgtgcgatttatcagagagagctacaattgtgggagagactgggcaactgaaggcctagggcaggatatttgggagatgagagaacagttaagaaatcctgagaaggcactggttaggaagtctgttgagggctgttgcctctgcctgtggcaggcagacagtcagaaatgaaatctggatgtgacgtggaaaaggacagattggagcccctgagtctctagtttgatgatataggtgttctgcagaagagattggtgctcttagccacggaatttcacatctgcctggcttcagacggaggagtttaaagggaagatctggcaggaattgaaagagcagtgggcagccaggcgcagtggctcagcctgtaatccccgcactttgggagggccgaggcaggtggatcatgaagtcaggagttcgagaccagcctggtcaagagaccagcctggccaacgtggtgaaaccccttctctactaaaaatacaaaaatggccgggcgtggtggctcatgcctgtaatcccagcactttgggaggccgaggcgggcagatcacgaggtcaagagatcaagaccatctggccaacatggtgaaaccccatctctactaaaaatacaaaaattagctgggtgtggtgacgcacgcctgtactcccagctccttgggaggctgaggcaggagaatcacttgaacccgggaggcggaggttgcagtgagccgagatcgcgccactgcactccagcctggcgacagagctagactgtctcaaaagaaaaaaaaaaaaaaaaatttagccgggcgtggtggcagtcacctgtaatcccagctactcgggaggctgaggcaggagaattgcttgaatccgggaggcggaggttgcagtgagccgaagatcacagcgccactgcactccagagtgggcaacagagcgagactctgactcaaaaaaaaaaaaaaaaagaaaagaaaaagaaagagcagtgggcctggctgctgccccatctaggaggtgagccagtgatcagcaacaacgtatgtgagttgcagtactacctagaggcctagacagaccctctgaataaagttctctatgggcagccctaacttggaaccataaagagtaaggaattctaggaaacatcattccagtttaactatttttgcacagttaggaaacagaagtgacttttatcttagagaaagggaagataatgaaaacataaagtgaaggagggaaacaggaacctgccctggagagagcccagtctgaccgggagataatatgtgaatacatcatcattgaatgcaaggaggcactattttttggggaccttaaatgctctgttaagaaattcatacttaatcctataagacatggagacacaatgaatattctcgagtaagggaggggcattatcagatctgtattttagatctggcttagagagggaataagtggggcaattaatgaggattctattataataatcaaggtggaaaatttgcattcccagaactttcttctgttctcactaaaggaggtgacccagagtcatcataagatgttctggaccattctgggaattaaaaatgctagtgtacattacaagccaaagtgatttcacctatggctgctattgtcaactccgatgcccttatggtatgcctagataactcttcttaaaaactccctgataagtttgcttctagtaggtgaagaacaaggagaagtgtatacacaattagaacatcggcttaaatgaaattggcttatgcaatcatgtcagtatcattttgagaggagagatcctataaaaacaaatacttattacgtagtaaattaagactttggggctttactgagtggtaacaacagtattctcttatgtgtatccaagtgcccaacaagttacagaccacttacatgttcattatctcatttgatttgataacagctctgcaaggtcagttttatctgaattattacaagtgaaaaaactgaagctcagaggttgtgatgaccatcaagtggccacttagccccgatgattcaagagctcattggtgttctatatattcaaagggcaccattctattgctcaactttccatttcgctctatgcaccactgcctgataatcttgggacatatctttgttcatgctgtgtccttgttctaaatccattcatcgctgggccctgttgctcacacctgcgatcttagcactttggggaactgaggtgggagggtcccttgagcctggaagtttgaggttacagtgagtctggactgtgccaccgtactctagcctgagcaacagagcaagaacctgtctgtaacaataataataataattaaaaaaaatccacccatagttcttggacattctcactttaaagatctctttccacccaaagaacaggctttttgtaacccaggtgttacaatttcagctgttctgtttcctcactttcctgaagtatttttactgcctttcctcaaagcacaggacaccaaacacagggtaaagaggaaagggttctttacaaaagcatacctgagtggataccttaacaccctcaggaaatctacacatctttgaattagggcattccataagtcttccctgtcagcacttcccggcacatactcctgaatgtttaaaaaccaaccatatctcttggcttcctacttgtcaagacacagctgaacttactcacttgtcttgacttatgtaaaacacacacttacagtcagtgctgtatcacctaagacttcaacagccagcagcaagtgaattaagaaaccgtaatatatcctccattcaatgcacccttgcagggttttgcacccctaaagagatccctagggcacatgaaatcgggtgactaccccagcttcttgctgtggggaatctagggtttttgtagttaatgatattgagacatggacttaggggaacaggaggaggcatatagaaatcaagctttcgcagcagccattaaatggaatacgtgtaatcgttctcaaagaatactagattgctggggccaaagaggctaaacctctggctttgcagaaaggcctcagaggaatatgttgtgtttataaagtcagccaaacctacctgtaactggctttctagttctggcatagtgcactttctggtatcatgctgcttctcttgtcttggttctcacacatgagttttggcctaattgctctagtttgagagagtcaaaggcaagtcttctagtaatgaggggaaaaaaggataatagctaacaagttgaagtgcttactgtgtgccaggtgctttacaaaattacctcatataatcatctttctttttttttttttttttttgagatggagccttgctctgtcgcccaggctggagtgcagtggcaccatctcggctcactgcaagcttcgcctcctgggttcacgccattctcctgcctcagcctcccgagtagctgggactacaggtgcccgccaccacgccctgctaattttttgtatttttagtagagacggggtttcaccgtgttagccaggatgttctcgatctcctgacctcgtgatctgcccgcctcggcctcccaaagtgctgggataatcatcttgtctaattccatgtgaggtgctttactgaccctgtccaccaataaggaaattgagagtcaatgtggttaagtagcttgtacagctgtggagaaggacctgaacccaggtctatatggctgtaaagctcatgatgaaaccccgtgctttgcctccctgtgctgaggcgtgccgtgcatcccatggcccctatccagtttgcttgcacgtacagctgaacatcttataacaggcgtttagttagtactctgatgtgtctgacagttccctagaagctcagcttggactgagccagcccatttgcgtttctggcctcttcttgcttccttttctcctttttcaatttcctttttcggctcaggcagcatgggagatgccttaatcaattgatgatagttccttctgttttaatgacattctcatttcctcagtatgtttttctcactttgagggttggagaggggagtaagggaacaaatactttcaaaaacccctagtctcctagttttgaaagtaagttccatgacgttatggaaatgctgctttgaaatactggaactgctgtattgaatgcccataggtgtctgtgaaagagggaaccgtaggcccaacatggctcgaaagacttcatccaggataagtaggttgacatgacaagggatttgggtccagctcaacataaagagacatttattacaattagggccatatgaaaactacattagtaatgagttcaccatcactagagatattaaaagagggcctagacatctagttggcaaggatgtcacagggagatttgaatattggaaaaaggagtttgaatcaaaatgacatttaaaggcctttccggccttgagattctgtcttgaattcacttagaaactttatattgggaataaaggtttccccttgttataattaacaccaactagtgatgtctcctcctccctcccccctgtgcttcccctgtctgaacaactactcgatttaagaaggggacttaggatgaggaaggatgtggttccttcccacttggcagcactccgtgtcagaatggaagacttgtgtctgggcctggcacggttccgtcaggccctcttaccagcccagtcgtgtctgtgaccagagcacgtgggaggtgcacatccgtgtagaaaaacctcccactggctgccagctctggatttttgaaataattcctaatgaatgcagtcttgcccaggccaaacctcttacaggaatgatgacacaccctgaaacaagtccgagtcaggccagacaagcatcccctgaaaaatactccctttgcggttggcagcatatgagaaagtatctttgagagccgtttcttcttgccgtttcaaaggaaagctgcttgcaggccaggaggtcaggagtgaaaaactcctttttttttttcttctattttttcttttcttttaattggcttactactcatctgaaagctctgctagtcaaatatgataatcctttgatttaatgtcaggattgagacagttctctggttcttgaaggaaagagtgttgcaatgctaggaagtctccagcagctgattaacagctttgatttgaaagaataaaaagaaagatacaaaaactggcagtgggtcctaccgatcggtgctgcaactaagaatggacagtatttaaataagatgatctttcccctcaggatttacagagacttccataatctccagcccacttcattttttttttttaatgtaatgttacagctcggtatgctttgctcaaatctatcatgtttggatatttcaaactaggaagtttcattccttgtagaaaagcttcagaaactcaccagatattttaagtcaggtcagtccagctcttcccaggaaataaagatgttaagaacttcatagctgtagggactccttagagatccgatccagtgctgcctataggaccttgggccgagatttcccatgtacaccataaatcttcacaaagtcgtgggaaaagaacagcaacttcagctccttttgcagcctgatcattgcttctgggcccgagtagctgtcttcttttgatataggaccattgcctgttcagacatgactctttttcctggatacaaatggtatgttatttttagggggcagttatatttcttaatagttttcagagttggtagacaggcctgaactgggaatcaaaagccatcttctcacatttccactagtgagttattgacctcatgaaagtcacctctcctccctgggcctttacttcccaaatagtgttccaaataacattagtgacttctgaggtcctgtctaattttctagatgtcatccggataagaagataaagtgtaagagaattaaaaaaaaaaaaaaaaagaaagaaaaccagcaaagtgaagtgtggggcttaggaaaatgagagtcctctgtttaaaatatgtctcagagagccttggtagcaacaaaggtcccaaatataggaatcttagtctgtactgtgtattgcagggtatatggatttcctgtatttgcctaagttctatttgctaagagctgactagaaacatgaatagtagtcctgaggaagcttaaagatgctatcacattcagtttactcatttgacatatcaaccctgcggcctttgttctggaggtacactgaaacttgaactcaagtctcctgcctgcttgtgcaatgtgctttcaagtacactgcctattcagtttatttagcagtgatgaacgcttacagaaaccatcaagctatgttttgaaagttagttgattcaaaacaatagagtttagtggtcagccaaacagaagcaaggagatttgctagttttgcatatgtgtgtgacttagtttccctattatccacgtgttaaacataagttctttgtacagctctattcctggccaacaattagtgctattttttttctctcgggttttagaagatctacctcctccaaacaacagcaattaactacgacttataactcactctcagctccccaccagggccacttacattcacatttctgatcacaatatttcttaaggtaaatcttcagttctctgagaatgctgaacaatgagtgtcttctagctcaagttacagtttgtaatgaccaattttgtaattgtggaacagccacaaacacggtggcataagattcatgtatcctggcttaatagctcagattatttccaaaaacccactgacgttggatcaatcatgctacctttgtccttttgtttttctgtctattaagtgctgtgtttggcccagtcttcctcaggtctcctatggtcaaggatcgtgttttaactgttttgataggttgtctttctcaggtgtattccatgctacactgctatcatatagcaaagatcctgagaaattatactttcatgaacaattcagggctgtgattttgaacatgaattatttttcactgtgcataatgatgttcccagaacctattgaaatacgtaagactctaacgtgaaatggccccagacccccatattaccagtttttgcttgttgggtttcttttcttgttgggtgttagtagctcaactttcacacctgccatcaacatgcctccttataaaagccatttgtccttcatgcaagtttgtgacttcttctctgcctaggcataaggactcagataaccaagttgttatctgaagatctgtactataaataaagttgattctttttttaatttttttttaagttgatgcatcttagttaccgtttgcagctctggtttgtctagctgttggctactggtatttacttgataattgacactgtctagtaattgagttaccagctgttgaggtatgactgcatgcctctgattctgtgggtctcacttttctcttctttggatgttttcactggccaatagattcgttttgtatttttactgtgatcttctgggtagatgctagggaccctaatgatttttaagtaatcctgaagaaaattaccgtaagcctaaaggtggttgaaaatgacagttttttgcaaataatcaaaatgccatccatagggacatggttaaatacactatcataagctagacaatgtaatcatatttagccattaaaaatgatgtataatagatcataatgctacataagtgtgaattagggtgacaaccatggtctatgctttgcctaataaagtataatttaaaaaacaaacagacaaaaagaaatgtaattacataagctaatctggaaaaaatgtgaaagacacattactaaataaaataagcatcttttatatacacatatgattcaatttttgtaaaaagaaaaacagttatatgtgaaaaaatgaaagagtctgagtctagtagttatatatggttatattaagagagagactggatgaatgccaaagggagaggagaaggggccacagtgtttacacttcctacctaatatagatattttttttaacttttagacatttacttatttaaaaaattaacttggaacctcttactaagtgagactcgtagcctatctcaaagagcgataatgtgatatttaaagattttgctgatttggacagaaacagaaacaagaagtgatagagaatttattagatgctttactttagatacattttctcttctttttttttattattaataatgttggcagggaggcagtgaacttgcccattagagtttggcaacctgcttgagtttcctaggcatcccatgagtcctctctgtttcttgccacacagcattgactcagatctattcctttacatgcaggcagctgtacgaaaacctatgcactcttatagcctcatctggtttcctttgtcaagatattacattatgaaacattttgggaaattagcagcttttgacagtaaatacgaatgatttgtgattccactaagccactgcttaattttaggctgctgaatggtgaacactttaaggagcgtgggaacaggccatattttgttttgatcttacacagtctcatttgaaggaaggttatccatttgaagatgggctataatttacagaaaggcaattatattgaagactaataatgagcatttagtaatacatatcaaaatgtagaatatgaataacttcagaatttcaagatcttttattctacataattaatttttacagctgaaatgtgcctatctttttggcgatcagataccccctgccctccaaaatacagggttaaatctacataagacgtatacgatttctccatggcatatcattctaggcctgttttctgtaattccttgcctactcacctgcaggttatattctagtcttactagatttcttgttttcctctaaatatctcatgtacttttctgttttgagaactttactcagattatttttgctttttggaataccttctcttttcttcccttcttttctctttgctctccactgtctctgtgattctttctggtccctaagtacccacacagaagcacacacctctgttcctcttcctgtttagatgcaagatcttccccatgaaccctccctaccactattagctagcaagaatcactgctcacttggcatccacagccctttatttacactttatgccttacactgttgcttctcaatgtatggtctaaggagcagcagcaatagcagcctctgggggttgactagaaatgcagaatcttgagtcttgtcctagacttatggaatgtgtgaatctccattttacccagttttccagattctccttatgcatgctaccatttgagaagcactgtcttagagcagatatccaactttgccttcacttggttgcttttgtgtgagtgggttctgatagaatctggcttgtgatcacagactgtatcttcagcattcatctgcaaggcaggatggagtgctttgcacacagcaggagctcttaactgtgtgttgttgaataaaagcttgcattttcaatgaagaggggtgtttgagggaaaaaacaaatacagggtatttccatgattcttgtcggcacgatgtctttcagattgtctggtttccatcattgctgtggttgggttttatagaccctagtacaaagggactgatatggtttggctgtatcccacctaaatttcatcttgtagttcccataatccctatgtgtcatgggagggacccagtggcaggtaattgaatcatggggacggttacccccatgatgcctttcttgtgatagcaagtgagttctcacgagatctgatggctttataaggggctctcccctgttttgctcagtacttattcctaccaccatgtgaagaaggacgtgtttgctttcccttcctccatgattgtaagtttcctgaagcctccccagccatgctgatttgtgagtcaattaaacatctttcctttaaaaattacccagttttggatatgtctttgttagcagtgtaagaatagactaatacagagacttaccaccttatcaaatctctttcctcctctcacctctttgagaaagagttacagtggtgtggaggattacagctttcagaaagaagctcaggtgagttcattgtccaggggattgtatttaaagcatagggaaatactttgtattaatattttatgaataggactatatctgtgtatctgtgatgattgtatatttgtccaagaattggaagcctgatcacaaggtcagagtaagatccagaatcagaatttggtgcctctgaacttaggaaaataacattgttttagtttattatatttccttttgcaaaatttgacaaggaaaagcttcataatttcaaaaatgcttttctatcttgtgatacagattgtaacagacttatattcagatttgttctccaagtatctccatcttccccacttcccctggtattgctgtttttcttagtgtcacttttgccttctcctctcatctgtacatatttcttttgcggttttcttagttattctactcgtattccaatacttaaaacatctgtatcatataactctggtgatattcctgatccttcacaaaatgttgtgtataattaataaaattacagtgtgtataaatatgtaaaaataaataaggataaattaaaaataaaaataaaatgaaatatataattataaataaaataaaatgaagataaaatgtaaaaaataacctaacaggtgatttttttgacatagataagaacaaccctagtagggacttgccatttttatttctgttattaaagcagatcttgaatatgtaatgcccgttacatccatttcttttagattattaagattaagacattgtttaaatacttctttctacttttattggctattttttttaaaaaatatattttatggttccgtgctctccctctggcatttgaatgatacaaaaatgaattataggaaccaaaacataatgctacttgtttcatcttaaaaccttaagttgcttacaatgaaatgaaggaggtaagatgttaccacataaagagaaaacactgtcatagagtttttgtttagagagatctaggacatcttggatatgcaaaaatgacaaggttggtagaacattgagggacagattagatgaattctcgttacttgtttttcccattcacatatccctctctctcttctctcttccgtcctctctgccttcctccctccttcccaaggtgtcttattacctttccctccctttgtccttctgtttttttctttggtggatgaatgtttgtaagatgtccattttgaagctgaaagcctcaaaggctcaaaggcagataattctctttttggaagtcattttacaaaatcctttttatgaacctgtctatagggaaatttcttcctgtcctggctgtgcaatgaaccatttatttgttctcatggataccaatacttattcattattttaaactttgtattttcttttttttttcctcctaagaagttcattttgctctttcttctgattttcctacctgtttgtaataacaggaattagtctttccatgtgtctgtgttgatttttttaatattactttagtgaaaattatagaggttacaggtttaggagctgttggggaaataaaatttaaaaccaaagtctcccaactgagaaattctctctataaaagtaagagagaaagaaaacaaatctattttttattcttgaacaagcattaaatcagaatgtgatgtacatcacaggtaatccactaagagatggcaaagacagaaagaactctcactcttttatgaagccaaacagcccattacatacgtgttttcaagataaacaataacttgtcctcaagtaagcttgacagcaccatttgtcacacatagctcatcctaactttacctggtaattgaggtgaccatccatgttagctgattggttttggccagaggaaaaacaaacttcacatatctttatgacaggaggtagttttttaacttggtgcaagttgcctaccaaagttagggtccaactctcccatagaaactgggagataggggtgctatctaccaaagttagggcccaactctcccatagaaactgggagataggggtgctatctcctgtgatgttcacttttcaaagagatggcctccaggtcttcctagtaaaaggcatttctaggtcacaaagctgacaaaaggccttgcttagccttcaaaaggatttatatacatttcaaagagtacaaaaagtactcagtaattgcaagttggccaaagtaaatgctctgagaaaaagaaagaaggtgaagaatcttttcccttattttcaacaagaattatgcttcttagttttaatttgtacttaatctgacagaagataggtcctatttcattatgtttaactaagcagttcagaattaaagttttactttttctgagtttgacattcagctgacttttgtctttggccttgtggtaacaaattatacgcctccaagttggaatctgatttgacaattcattagcatttctttaatttgtatttttattgtaataaaattgaccattttaaccatttttaagtctactgttttgtggagttaagtacattttcattgtgcaactattgccaccattcatccccagaatttttcacattttgtactcaaactgtagcctttaaacattaacttctgagtctgtcctcccctcagcccctggcaacaaccatcattatcactttaaccaacctattcgaaatgcccatgaaatttcaatatcctgtctctggatgagaagtggagaattgtgtttgcccaggattttaaagataaagatgttttcttgggaaactgactgagaaaaacaactttaaaaccttgaatgtggtgcacccatttatacaagtgatgccacactaattataaataacttaagtctgtgcagttccccagaaatgtctcattcgtgccacttcattactttcaaactgataataaaataccctcctagtgaaatatttttttgcatgtaactcagggattttactattgtagatttggcatttttcacaacccttgctccagtgaatttttatctttcttaattgatcttttggacacagcaaacgaaatattgaacacttcatatattttgttttataaactgtcatggatatgaaggagaatgatgtgaaagaatcagggcagacaatctgttgcagtcagagaaccttaattaaaatgaagctttgctatttgattgtcgtgatagcttgagttagacacttcacctttttgcacctaatttcatcatctgtaagacaggaaaattatattcctttttgagtaagttgtgtgaatatgaagtaaaataagacatgaaaagaagcactgtgtatagtgtcaaagcatgaattatttcaactgagtaatgtacttaacatatggcagaaatttggaaaatacttgttgagtgaatgaacagatgttattctcaaggttaatttttctagggttctctcttctacacacatactcctgtctttgcttaaaacctaccctctcttggctttcctctgattcctgattgtatcttcttctccttacccaaattatgcttccagtttaaaaactccagatctcagagtttgggtagtgatttgaaagggctcaaggaatttctgttatattatttcatagaaaactcttcctttctaaatggaactgcttcctgaaagcttttgggggttagaaatggccattcgagttatccactgtaacatacacaaagattaagggaatttttttttttttttttttggctagcatcaacaggctcaggggagttcaccctagccaaaaaaaaatgatgagctgcaataatgttaaatcagacatgtgaatccaaattaaacagaattcttggtgtaattccaggctgttccctcgatggtcattgggtgggggctcactaagcaactctgttgttcagtgtcaccatacacatgataaatgcaaatgtatgtattataaagcagcataaccaaggcttacactgacaaaggcagatgacaatccaaaggtattctgttgaacatgccttgcctgacatgttttagtggaaaaatcacccccacccatgatgatctgagaaagaaatgagtgttgagagactgaaggagcagaaaacacataaaggaattatagtattttcctggattgagaaacagcctgtagaatcactctgtttagaagaatgtaatcattcactcaataatccagagcgttttctatatgccaggcttcaatgctagaccctgggagtcaaaaatgaatcagaagtggaccctgtctgcaaacgtcttaagagagaagacatacacacttatttaatagtacaagataaaaaagcacattactgagactatatgggaagcatagctaacgttttaggaagaaggtagaaattacatctggcagagggaagcagggaggtttcatgaaagaagtggtttcggaaatatgtcctgaaggacaggtggtatgtgtacacttggagagggtaatgaagggcatcccaggcagaagagatgagtaaaggggaaggaaggcacggggtgatctgtagcaatatctctatttgtacctgtggtgggagtgcttgatatgtgagaagtagtggtacagcaaagggttggaaagagagcttgctgccagatcgtgggaggattcagaatgtcagtgacggacatcagggaagtagcactaggatatgatgtgtgagcaaattgctttggtctttgtcatcagtcggcctttacaggtgttcccatggcacccaacccttacctgaggcttttacagccttcttgtttgcagtgtggtaaatatctcttcctttggatttagagaaggagatttcaggctgttttttatatattagagaatggaaagaacatttgcatgcaaaaactctcagtttttaggtcaccctaatacatacatgcattttcttccctttttcagaaagagcagaacaattgaaaataatagcccttttaatttttctaacattaaggtcacacaggtgaaagggttatttgctgggtctcataggtgcttactccttttatcattggaaaaataaaggctcccctctgttttctgactttttctggatggtgtcttatgttctgatttggcaacagtctttaagaatccagaattctggaagtagtgaaattataatcaactccaattagctacactggtggagcatagcattatcatacttaaatccaccagcatgtcttacatctcattttagctagtcattatgccattgttcctccatcagcttgccacaggagtggtttagcaaattagaaaattgatttgaatttcctacttttttcccaattaaaagttcatgagccttactctaaaactacctccagtaggagtaatacacccagtgagagaattcctaggaattcctcaaagcttggtctactgtttgggggcccttacacagtcaaactccacctccaccgtgtttttctgaaagaacttcattcagcatttccaaactgtggcaaggaacctgatgattgcagatgttactaaacaagaattactaaagtcaattagatttgagaaacactgtatattattactaagtaattgagtttcacaacatgcattagcatcctgaaaggccctgaaagaagtcctgtgggaaaagataacttttgaacctctttcacctaatattaataacctaatgtttctctaaactgagggtgaattactaaagcatagcctttcaaaatcattctgtaaaagcctaagctgaacaatgtggttcaatatgtggccttcagagggtctaagataatttaagaatgaaatttaaaatatcaggagactcgaattaagtaggtacatttattaggactctgcattgtatccatcctctatttacctaccaggatttacgtgaatattttttcatagcctggagatcctttcaaaccctgtctgtgttaacagagctgctacatctgatattattttccggaatctgaagaaacaccaaagaggactgaaataataagacattaatttcagctgtagaatgccgatgttgctgaccctgcagggttattgcagagggagattaattatgcatatctgccaccctaggctttggagttgaagtaccctgctgtaattcactgccggatcattcatgtagccagcatactgatatgattattattccaccaaggtttttatctgcccctagacaattacagaagcacttaccagcatctctcattgacttcttatttaaaattcccagggccacagcaggcattcgcatccttttatcggagacagctacagatcaatgacatgaagcaacatgggattttctgtaggacatgacaaatgctgagattgttgctaagcagaagatagacattcagattccagtagaaaatagtgttgcagtggctctctaacacaaacttttaaggcaatgacaagaacatacaatggaaatattatgagatttggtgtcaaggtatttgagtttgaacactggcttcactatttggtgtccaggaagctatagttcttctgtaaaatgggattgaaattaaatgacaaactcttggcagcttgaggatctggagatctctttaggttgtgagatgaaatgtatatatgtgtgaaatccctgctagggtatgtatatatgtgtgaatccctacgaggttgtgaagttttaatgtatacatgtgtgaaaaaaaactttgtgagtgacagagtgttttaaaaatatttttgtgctaatgggaatggctttcattccccgcgtagtcataatggaacatccttttcgtggccccactgcttgggtgatgacctatcgatgcctgtagtcacctcacacagaatgtagtgactatgcatcggtatgattagcagctgcatgcagtgtacatccttgaaatgatgcacagaataaaattcctatttcctattgctgttctcagcccagggttttaagggacttcgaacctgcaagataacattcatctgatttgcatttttttcagttaagttttcctctctgttctatagatcagtggcaaaaagtatggcttgttttgttttaattttcccctaagaggctttctcccttatgcgtggctgcatcacagaacgctacctgtcttcagagaccagctgtagtgccagctccaaggaatctttccaccctcactcctcagtctaaaccccttttctctccccacaactcctactctctaccacattaaaatgcaagtaattccttccccacagcatgctggcatgttgcttggactgatttgtatacttaataatagcatgagcaaacacagctacatagctttgtagagttaaagaaataataagagcagatacacttttaggtattttatatatgttaactcatataatcccctcagcaatcctaggaagtagaaattattattctccccattttgcagatgggagaagtaagtcaccaagagattaagtaactggcccaatatttcatgggtaccatgggggcagagccaggaattggtaattaaaataataggcttttaaactatgaggttacaatgagccctatgcaaattggagatttctataggttgtgagttcctggatgtctgaggcaatgaaaatctgtgtcatctattcacatttagcgtaagggctccgcatagtaggtatccagttacacgaaatagctttgcattgagaaaatcgccccttgaaagcttaggatgtggccacaaaatgccccccttgtcctctgtcaatatgtttttagtatacgttctgcattcctgctcaatatgcttgtcagagcattttaaaacctcacataagcactgcttgagcacctctctgtgagggaggccagtgttctgtttttttgtaagtagctgtgtggtaaagataaggcatacttgttgaaattagggttacttgagtctttagtggtttatggatcagtagataatagcactataacattccagctcattcgcattctgatgaaaggggaattgcatggtgttactttattttcaataaagtcaccaaatgtcaatgcatatgaaaagaactctggccatagtcctccgccccttccccccatccagtgtgatctggtggactgaggtcacagcccagactatgggactggtgggtgcgcattgccatctgtcaggatgatcctggtgcccaaaaattagtgaaagaagccatagaattttctcaacagggacacagactcacacagacctcctcagtgttagttcataaggggattttctttaacactttagatacagaaacatgatatttctttagggcttacttttttggcttatatgagttcccaggaaaacctggaatattatctttgtgtttcagggacaaaagtggggattggagcagtgaggatgcataataggctgttttctcctatagactgagaatacctgaaggtaaaggctgcactgaagcccctgtgctttctcccaggtggcgaagtgttggcctggtgcactgtaagtctgctgtgaatgttctaatttaactcttgactttaactcttcctaataaaactagttgtggaaactgaggcatagggacaatgaaatatgtggccaatgttatagcacttgttaatgccagagtcagaactaggagagggctcgtcctgcccatctctctgtgtaatggagaatgaggagcccctgggtgttgcagggtctgatggagtaaggggggcctctccgaggcttctgggcacctgaacaggaggggaactgaggccctcttctgctggatgctttctattgagccaatcatttttctgaaagaattgggggaatgatactaggaagtgctctgtgaagggacaactgactgttttgtgaggccaaggatgccttggatccattcaagtctaatttctgaagacaggttcatttcagaggcagtggatcttgatggctgtcacagaacttacggtggcatctgtttgaaccaaccttttgagaatattccattcttaggatgacctgtggcctgactagataatgcagcgtgcctgtgaatccatatgtaaaataaaagtatcaatgtctcatatttgtatcatatttcaccatttattaagctttatcataaacatgatctattgtgatccttatatcatcctatgaggtaatccttattttattgataaggattccagggttcagaggggttaagtacattatccaaggccacacagttaaaaagtaatcaacagcaaactagaacagaggttgactgtgtcctagagaaatgttattcctactacccagaaattgccttgtatttatatgtacttattgcataacaaaattggactatacactgtggacacaaacttagattcccagtcaaaaaaggagagtagtaagaaaaaatctaaacaaaacagatcagggcagaagtttctcaggcctctaagacaggtgtaggtatctacccagaggttttagaaaaggaatagtttatttttagacaaaggcaagatgagagagactctggagaagctgcagaagggacctgagtcttgaattaggctgtgggaaagttaagacttatttcctttcagtgatagacaatttggtctcaagtggagttttaaaaatcatctgtatcttgtggattgaggattgatttgggaattatggcttgggctcccccttctgcaattagagttttcactatggcagtattttccatgagaccttaataggtatattgcataaaaagaggttcatggtcaaattgttgtgagacattctccttagggttcttttcacgtgactaggaaagattaggctcacagacacgtagaagggtgagaaaaatgggatttatttggcaaaaaggaaaaaaagggaaacagggactctcaacaaagcaagagtcctgttaggaggcttcccgcctcacagattgaacccctggttcccacccaggaacaagaggaaccaggctcctccctcttgcaaacggtgtgaacctctgtagctccaccccattctcccagtgcgcaggctggtcagaggttctctagggacccctttacacttgactgtctcattccccctgaaagaagtacatctagctgccattagaataaggataaggataaagatggagaccaatcttaactgcttcctgctgacagggggtgctgttttgggaaaaatgacagtcagagctccctcagaggcctatgtaagggtccccagcagaaggggccatcatccaaagctccggttgcaagaccatttggagtttgatggcctgaatgtgagaagagacagactgggttattagaaaacatgtatttaaatgaaacaagtcgggggtgaggacagctcaaaaatcctgaggccttttaccagtttgcacagagagaggccaaaagcctgattggtaaaacaacttttacccttttaccatcatgtcaggcttctgggttgccttctcccgagcccaatactaagtcaactggtttaaggtttgggaaattaactttcccagtttggagcctgcatccaaggggagtgttctgtagtatagagacaaaattacctatcagtgaagagagggcagaggaggagaaaggaaaaaataagctgcttttttcaaaggagttccaggggttcaggatgcatttaaaggggtacggagtgaagatggatggctactcatctagaaagaggggagcaggcatccctggttcccttctcttcctagcaaatacctggggtgcgtgagggagagaaggaagagtgtcctctttccctcttccatccttgcatctctgagtcctggcagccttggcacgtgccgcccatggttgccaaagcaggcacccatgaaacagggggcgcttagagaataggaagtatcttctctcacctatgcctctattccccctactgtcagtagccttggagttccctagacctcatttgtgccagggatactagcatgacctttatccatgaaatgggaggcttggcttaattggcaggaattagccattctcacctcaactgtgccttttaacctctgttatcatggcctctggatcccttagatccaattttctttcctagggctttgacctgaagcttgaaattgagtttgggacaataatgtgtctcatggggaattgcatggactccttatcataagccaaatgctgaggtaaagctgcggaattgagtcgtcctccaagaagggagagaaaatgatgtcttgtgacatttccagataactggtgggtatagttatgcttgctaagatttgggtgcatggcgcttggctttggttagctcccttggtcttactttcccaaaaaggaaacctccagctgatggatatactatttattcccatcacctggcagaatttgcacgataattgctcagaactagaatattgatccagatttctacattacccatcccatttgctctttctgagctgcagccagagattgctggttggttcacaggaacaagcaggattagtctaaaatgtaggcaaaaacttaaaaataactaatgaatttagaatttaatgacaaaggtgtgagaagttttcaagcatagtttctctccagtccttatttttgttaaaaagaaaaatcgtggtaggactgacttgtttgcaaaatagactttagtcttatatttggcctgattatttgcataaagtacagcaagaatatctgtttctacatacaccttttagattggttttggtggaactctattccacaaggaatttcagataagaccttttaaagctgagcctaaccatgggtttgtatcttcaaatacctatgagttgggtgatcctctcctcttaaggtcccaagataaatttggagctcttgggcctgttagaaagtgacattctctactgaccacaggtcaggaaccctgtacaaggactgtgtagacaagagtatgaagccagtttttttccccagagctttcattggctctgcaagttgagcttgactccttaaaggggagcatattcttcagtcaaacccttggtaaaacaaacagtttctgcaattgtgtcctgttgcaaaagaaaaatggatgcttattgtactgatgcaaacgactatattgccgtaagttaaaaatactcacagatagcttccaaattctagaggaaccaggcagagagaaacaaacatgcttcaaattttcttcacaggaggatacttactcaattattaaaggctgtaaatagttcaaaataagtttctttgactctgaaaaacaaaacaaagatcagcaatattccaagtaaaagttggaaagattgtttcagttttctcagttcagtctgtttagttcttgttttgcttgatatttgtgaacactacagctctttgagtcctgtacatttttcttttattccactgttacaatctccaaagttatcaaaaacctgtatttaagagcccctgtcaaagttctatagctcattataaacaatcttttgaaaaggattaaaacaagtcaacaattgtctgtgaataacaaaatgtccagggtagttacagttagaaacacaattgacaaagtttggttatctctgtggtttacaataacttaatataacaagcttgttatgattgatagcatatactcagatattagaattttagaaatcccatacaattttggaacatatattagcattattcaccaaaatatttcctaaagaagattgaacatcattttggcaatccaacgtacctaaacatgttaaataatcctgtttacctctcttttctggacactccaggggccctttgaagtatccaaaaagccaggtgtcaggaaagacaattttgtaactaaagtttgattttgggaagcctgataagtatgtaagaagtttaaaacatttgatgttctgaaatagaattccagattatgataaattattttacaaaaatgatgactcaggaacttaacaagcaaaaatccttttatagccctttacaaattttgctaaagaataaattagtgccttaacagtcccttgttgtgctttgatttcaatcctcaatttacagaaaaaccatataatacctttttgaatttagtcaatatgttcacacagggaatttttgcaagattaatttttacactccttctactgcttgtttgaagttttagctttcttatctaatttaaaataattctttaatcctgggcaagaatttacatttttctcaaagattaaagtcacgtgaactgaaaggtaccacagcttttgtcttcccttttaaaaacatttgatccaagtgcttatcttcctttaggacaattaattagagctttttttatagacatcacacacaaaacacatatacaactacacccagtccccacaagatccttcatttggcaatctcatatttggattattagcctctgagtgctttaattttgggggttccatgagaaaaacagaggtctttcccctctcatgcatgcattaaaagtggtgaggcaaaatggagaaaaataatttggttgactgaaaaaaagaaaaaagcactttttccagaaaaacaaggtccaagaaaaggaaaacataaaggccttttaaatataactataacttggatatccacttttaattaagctgagcggtccttaagaaaatccttttaactcccttaatactcgacaagtggccaatatttctggctttcagattttactaaaggctcagagcaaggaaaatccaatgcagtttgtggaggggaagggaatcaacaaatagcaaaagcaaaaaagtcatacagatatcaaaccctgaagaactcatttcctaagccaggattgaatcccggccataggtaagctaaacaaagccttgccatgtggttacatgccacgcccccgaggacgtacaacaagatggaggcccgcaaggaagtattttacagaccatacagaaagactgcaaagcacaccagactggctacaacttaagaccagcctcacaaatcctttttcataattaaaactttacagagaatataaacattgatccttatcattcctagcctagtaaaatgtcttctaaaaggaaaacacaaacaaaaaataaataaacaaccaccacgcttaaaagtcaactcctgacctgatggagaaaaggaaagaaaaaaattttttttaatgcctgggaagaacctcttattcttatgcaaatgcgttcctccaccggggagagaaacttaattgctctccaatggggttgaaccccttggccaagggaggtgaagaggccatggatgcatagcattccccagccccagccgggatgggacggggaacggggagctgccgtttgcccgtccatccggaaaaaagaaggaaaaggccaaggaaaggctgggttggactgaggccgtcttttctgacccctgagcgtgacagtggtgggggcacagtttcctctagcctcagaagtctgaggttgagaaggtttagaaatgagagggaaaggccgggcgcggtggctcacgcctgtaatcccagcactttgggaggccgaggcgggcggatcacgaggtcaggagatcgagaccatcccggctaaaaacggtgaaaccccgcctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatgagagggaaagagatttcttgttttgcatctcactcaccctttctcaaaccccatgttctgggcaccaaagatgttgtaggactttctccttaggattcttgttacacaaccaggaaagattaggctcacagacacacagaagggtgagaaaaatggaatttattgggcaaaaaggaaaaaaaaaggaaacgggctctcagcaaagtgagagagtcctgctagcaggcttcccgcctcacagattgaaaccctggttactacccaggaacaggagaggcaggctcctcccccctgcaaatggtgcaaactttcatggctccaccccgttcaaccagtgtgcagaccagccggaggttctcctggggaccctttatatttggctgtctcaaaataactttgcttaatgttgtgttaagccaagcggaccacagtattcactgggcagattactccaaacctttaaaatgccagtgtgtattgtgaatctccaagagatacgtgatatgttacttttcaaatttattttttggccatgcagtccttttgcagattgctcagcacaggacatgataattttcatctcggattttggaggaattgtatcctttttggccatttgctttcttgttgtttagtgtgtgtgtgtgtgtgtgtgtgtgtgtgtgtgtctctaactttgctccctacctgtgagatccctgattaaataaatgaacagtgtgtttatttctatatattgcacaacttctattaaagtgtataaagtaggggcttaataaatacattgatttgaatcaaatttgatgctgtagattcagaagctagggaattacaggttttgtagagaaatctatgaaaactcagccacaattttgttacttctgtcctttctaacagcttgtagaaaatgcctttctctcgagagtctcatagacaggatcgtgatcttcagaccatccttttgaattagagaggttattagtggcaatgtcgttaagtgaaatttaaggggagaaaacctcagatggctaagaaacttttctatgctgggaaaagtaattaatttcctaacctggaggtgactggatcttagtccacaggtgatatgtctgttttgggcctgtggtggtgataatttcacctaattccctacttgaacttcaaatggcgtcacattgcccaagtgatgtgctccttcctccctcctctctactccgcttccttctctactccctactctcaggtgctttgaaatgcctctgctgcagcactgttctctatactgtgtggggggaggtttggatgagaagagaaacatataatctcaaacatacagaaaaagttacagtacagcagaaagagcatttttttcctgatccataatcccaaacatgtttttatagccaaaagattcatttcacgatcaggcattgcatttagttctcttgccttgcttccttcagcctggaacagcctttccattttgcattaacttcctaccttgatacttttgaaatttacacagcagttgttttgtagaatgttcccctatgggtttgtctaatgttttttcattgttataattaaaagtatgtggtttgaatacctccaaaaattgcaagcttcatgaggaaggggatagtttctctccctcttcctccagactgtccagagcatgatacatatttgctgagtgaattaaaagtagtgtttgaccatctcatcataaattactcctccttccagccttgaagttccctgtcacattctgtgttggatttaatttgcttcctcggtttaaaattatatatatagatagatagagatctgtctatctatctatctatctatctatctatctatctatctatctatcttctatagttagttctgtatctttctgtaacctcttcctgttgtcttaaatatgctttaaccaacgaaaaagtttttccacattttttacagaagcacaacatattgacagtacataaatattgtgttcaactttttcattttgtttacataggcatcgtcatgtgatcatcacctaagaactagaacatcagcaggccctagaagcctcactcttgcccctccctttaatatctcaaaggtaattcattttctgatttaaattaagcaatttataaaacatttccttatcgactttaagttctctaccccttcagtttctttcaaatttaaacaaaaccaagcaaaaactttagcttatttcataataaacactaattgtcataatatatagcattttttatatatatatatgtatgtatacacacacacacacatatgtatgttttcacatgtcacatcctttgatcctctccatctaccctatcagatagtcagcacagggatttttactgctattttaaaaatgaggatatgaggcctagagaagggaaacctcctgagccacgattttccaatttccaatttcatcatagaggctatcacagtaatcttggcttttctgtaatttgtcaaggccagacttgacaactaaaactatcttctttgaaatattttgacaatagagcactaaacttggacctagtacacacaaagtgtagggcatggcaagttttgccaaatactcaatggtcaacttgaaccacgtaatttgggctcttttttgtaaataatattagtggtagctcacattgtctactactccatagttcctcaattatttcacatctattatctcacttaataagagttgatgataaacagcatttgctgagagcaatttgtgttcctggatggtgctaagcactttacagcaattgttaagactttcctctcaacaaatggtgaggtagttgtattagtttctatcattccccagcctcagtgtccctaagtagagaaatacttaatcatcaaattgtcctctggagagagggtacaatggaacaattccttaccttgtttagaaggatccatgaacccctagcacatcagtcttgaattaaccatcaagacagtgagctagttacagatcttcctaagaggtcagtatgaatattcctcacctcttctctcaggctctccagtatcacacagtcaaacaaactaggaactgcaagttcagtgctctttttaaattgctctttcaccttccactcactgaaaacccagttctagttctcccttgtgagggacaggacttcatgatggtatttcttacctcaccccacagagcatgttgctattcaaaatattaaagcacaaaagggaatcaatctgctcacattctattccaagcttctaaagatggcaggtggtatattatgtatatatgtcctctcagagtgctgagcactttgaagctatttcctaaaaagggagaaggcagtatctaagaggagtgtgctaatgttttcttatgaactttgactctgctgttatatcagtaaaggttagcagtactggcttggtaagctgaaagttggggcatttcattgatctctccatgtacctccactgctaggcatttctggaatattcagtgcttaatgacaaggctgtgttattttcaaagtaaatgttgaaaatagaaaccatatttaggttaaaacacctttctttaaactgtcaaaaaggctccataaatcatttgttgagtttttaaaaagaaaaatcataccacttaaaatatatttctaattaatgcactgtaacattaacttttttgggagtacagctctttgaatattaactcatgtatcgaatcaagtaaccactgtgacaaacaggatacaaaactgttctgtttctccaaacaactctcatgtgcccttcttttgcagtcatactctcccattatccctaaccccttgatctgttctcggtcactccagttctgtctttttgagagtgttatttaaatggaatcatacaataggcatcctattaaggttggtttatttaattcagcacaatgcctttgagattcatccaagttattatatcaacatatataatgctcattgcttagtattgctgagtattattctatttttttggatgccacagaatttgttgatccattcacttgtagaatgacaattgaattgtttccagctttaggcaattaataatagggcttctacaaacatgcaggtatagctttttgtatgaaagtaagttttcatttcccttggacaaatatccaagagtgagattactgggttgtatggcaagtttatgtttaactttattaagaaactgctgttttccagagagggtatatggacatttcatattccaccagtatgagagttccaattgctttgcatcctcttcatcacttggtattgtcagtatttattttttaattttagtcattctgaaaggtgtattgtggtatctccttgtggttttaatttgcatttccctgatggctaatgacattgaatgactcttcatgtgtttatttgacttttgcatatcgttttggtaaagtgtttctttatgacttaaacattttaaaattgagttgtttcttgtatgattcctccaactttattcttctttttcaaaatttttctcaatgtcttagggctttctattttcatataaatatcagaatcagtttctctatagctagaaaaaatctttctgggattttgattggaattaactaaatctttaggccatcttggagaaaattgacttctctatgttgagtttctcagttcatgaatatggtatgtctcttctattattttctagtaccattttaacaaattaccaaaaacttagttgcttaaaaagcacccatttattgttgcacagtttctgtgggtcagaaggccaagaacaatgtggcttagctggttccctgcttagggtttcgtaaggctgaaatgatggtgtcagcagtattgtgttcctttctggtgactctggagatgaatatatttctattcctttaatagttattggactattcaggtcgtctgtttcatcttagctgagctttagtagtttgtagtttttgagatgttagtccattttatctaagttgtggaatgtatgagcctggagtttgtaatattgccttattaccatttgaatatctccgtgatcactagtcatgtcccatcattcatttctatttttagtgatagtaccttttttccttacttaacgtatcacctggcttgaggtttatgttttattgttcttttcaaagaactaacttttggtttctttatttttctatatgtatatatttcctgttttgaaattatttgatttctactctataaaatttcctttattatgcttgtttcatttattcttctttctgtagtttcttaaagtggaagattagattatgggcttgctatctttcttcttttctaagataagcctttagtgctacaaattatcctctaatcactacattagctgcatcccacacacttggtatgttttattttatttttgtcaagttagaaatattttctaatttcccttacaactttcttttcaacccatatatactttattttaaggcatgtattttaattttgaagtgtttggagattttcctattatctttctgttattgatttctagtttaattctatggggagagaacatactttgaattcttttaaatttgttaaaatttgatttatgatacatgatacggtgtatctggtgaatgtcctattgaaaagaatgccttattttttacttttagaatcctcaaacagttgttccatcaaatatgcccgcgttttataactgcaaagacaggatgaagaatatttacttcattttaccccaaatcagagtcttccatgtcactttgccaaaactttcatttgctgataaatattagatttgaaatattctgcacaaggatcctattttcaaaaaaagccctgtaaactccacaaaagactgatgatgaaaataactctcatgtcttactaaatgctatcccttttgtgtagaatggaataattagtagcttttcctgttttcttcaaaggcttgttcattgtatcttaggtaaccacagaaatgccagacctactcagactttttgcagtaacttagagaaaataaaaggaaagatctgaatgggattagggcaggattgggactcaaggaagtgatttgactacagggttgaccttttatggggatggccttctggggtgtattccttggcgtgaatggccaagttttcaaaagtgcgaatggtcgtagttttcagtgggcaggtcatagaaaagggtgtcagtcaaccatggcagaatgaagcaggtttagcagtttcatggttataggaggtttatctagctgactgcaagtctttacagggacataaggtaggctcctggaagagggtgctgacgagcaccaggctgaaggcctaagtgggtgttttctgagtatagagctatatatgggatcaggaaactgagggacaaatccagtcctgtgatctggtgaagtgctgctgagcggaaggcaggcagaacaaatggtgattcatggcaaatcccacccttggcacagcaaacctagtttcagcctgtcacctgcgggctaggtgagagaattcagtggtcagagtgatgcagataaggagatgctaatgattaccaagtctagagaatgcagacgataaaaagtttcatatgcggaagtagatgttaaggtgctgagcacgtgaagacccatctttaacattgtcgtcgattacagagaactaagtacattttaaatcttcttgctaaatgatatagtcattaaagttgatatactgggaaacaataggattaaatatgagagatgtaccaaaagataagggagggagcatgaggattatcatgcagtaaattacacggataatgcaggaaaggctgggaagatattatatgtaggttagaatcatctgaagcaacagcagggtctgttaggccccattgcaataatctaaagctaagctctaatttagacactgagaatctgtgtttattacccacgtccctttgctttctgacagttcctccatctctgacccagcaccctctcactctaagacgcaacaaccaaaagtgtattactctttacgataataaaattctaaggctgaatacaagacaatgctaaatgacccagcattctctgagaggtttcagatcagccaggcgcctcccaataacattggtacctttaatctgtcaaaaccagcctgttcaatcacgtttccttttcagtctgctttattctaattcatcacagggcaggactggccctggatgtgtgttcgcagacaggttatctttagattagctttgccttggtgacctgactctttgctgccttcagcataatccagttactcttgggaatatcaattaaggccctcaatcacactaattagaatgtcttataaatgttgccttaggaattcagcagcttataaacaggcaaactgggaaaatctagaggtatgtgggggtttttaaatagctgacagcaatttgggagggcgtattgctttagcatagctgagaagtggggctgaaattacggttccctgaatgcagtgaaatctctagttgctctttgctggcaagtttaatgcagaattattaattacatttattaatgacttggatgaagatataggttgcatgctgatcaagtctgtagatgtcacaaagctaggaagatagcaattattgtgataacagattcaggagccaaaatgacttcaagacagaatttagcagccatctatctaatacgcgcctggcagtgctctataaagtacaatttgagggtcatgttgctcccctactcagaaaactttggtgactccctatttgctctttaaatcccaagcctttggcctgttatttaaggctttgccatattatgattctaccactgtctgctttccaacaaaatcttctgtagttctttttctaaaaccttgtgcttgagcaaaactcagttctttatatactattttccatttgtgttctatgctttcactacctttgagcattattctccactgaaagtttctttttctcacatgttccttctgtctcaagtctaaatatccataccagttcaaatgtcacctcttgtgtttcgtcttcttttattgtcttggctggagtgacctctttcctttgctaatcttcaataacacttatctgttcctctctatttttatcactttttacttcatattgcagggggttttttttttggtgcacattttaagtttctgttagaccctgcctagtgctagaatttctgtctggtaactctttttatctcttaagtgtctctagatgtgtgttctatacatagttgatgatactaaagtgtcttgctgggggttcatctttactgtggaaaagtgcctttagagaagaccctacattttgcccatgagaggcttcgtagctgtatcatagcaacttggaaactcaaaggataaatccttgaggggacggatattccattttccatgatgtgcttatttcacattgcttgcctgtatcaaaacatatctcgtccacacacacacacacacacacacacacacacacacacacacatctgctacataaccacacacacacacaaactaaaaaatttggaaaagaaggagaaaatgctcaatacatgttttattgaataaatgaaagactgatggagagaaaaagatttccccaaggtcataatataagagctggaaggaagaggtgctgggaagaaaacatcatttaatttatcagatgaaacaacagctcgtgatatgacgagctcacctgtgatttgtgtacaaccaggctaaaaaaggaagcatgaaccagagatttttggagaggtgtggtcaagagaggtgacgggagttggaaacttgcatagtcctttagggtggccacacctcttggattccttgtgtagtttataccttttgttataatttaatgctcttaaaattggcccattttaaatgatgttatatggtcatcttatttatcaaatacctctttgatctgtttaagctgctgcatacctgtggttgtgaaacttgtggcataggctatttgagataataatctttgtagttagcctaatgtggatataaatagcatctttgtcacttactggaaatatgagctggacaagttatcaagacctctgcaagcattcttatatggctgttaccttcgacacagaaagcagagttcttgagcatggaatttctgcatcatcttcaggtttcagtatttataacccacagaggttttaccagtggccagatatttcttgggtagtagaaaaagaaatacttcacagagctgtcaaatctccacatcttcagcattaaatatcatgcaaccaaatgtaagggtatggttcacagcagttggctgtttcagctggttattaataggaaggcgaaagatcatagaaagttgactcctccctcatcatttctgtcttccagtgagaagaggagagcacgaacagcaggaattagatttatatattttccttaatataaattcacagtatggtagattgcagacaaagtctgaatccaggatttctagactttctatgtgtctatgtgtcactaaaagggaaaagtacctggattgtaaagtattccaactagaaatagaccaagggaatgcaaagaggggtaagaaggttgaatttatctgccagaaatgtaaatcctggtcaaaaaatccagatgaatattttttaagtaggcagttatagttcagtgaaaaagagagttgtggagccagaaagctggagtttgatcatagctctaccactctctagccaaaggatcgtggtgatgttattgaaacttgtctctagccaaaggatcttagttatgttatttaaacctgtgtattaaacttctttatctgcatgtaatatgggaattgaaaaacaaacaacaaaaaaacagaaacaaaataaaacctgtcttattggttggttctgacaatgaaatttgttaatattgtaaaattcttagaacagtccctagtctatagtcagcaggcatgaatgctagttattattatttaagcccttgaaagtagtaagtgatttcccttacctttgtatttatggttacaggatgacacttctgtggtgtgtagtgagtctctacttttatggaatcctgcaaagtgatgcctcaggtaagtgaatggcttttgacaatgtattaaaatgcaagtcatgcgtagggtaataagtccactcttcctgaaaatgaatttaaataaacataatgttattcatgtccattgtcttctgcggtagcaaataatcataaagcagaataatagaattttgatgatggaaagaaccattgctgtctctagtcttcatgggatagagtacacagggggcagtgggccgctgtgtttaaacacaggtatttttcattaccttcacactcagccaactagaatattgcttttttcccttacctcaggtcctatgggggaaaaatgggagtgataatagcacaatctgtttttcaaatttgagccagtggtggaaaagttatcagtggtaataatccattgagatgttaaataaaataatgagtttttgtcatattgtttctatataggaaaaagaaaggatctgtctttagactcattctttctctggatgttgctttataagaggaaccagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaactgtaggactgaaaaaaaaaaaagaaacaaacaaacaaacaaacaaaacaaccaaaacctaatgcaatggttctctaattgtaatgaagggaacctagaggtcctcattttataaagcttttcatgtaaaattcccctgaacaccataaaccatactttacatatcgttgctttaattccttttctttgtgagagggcttctgcaatgttaagttagctaccatataaccatgacctcagtgttctgcaatatatgccttcaactgtttttcatatgacatggatttgagctctcctaccatcctgatcatcttttctgggtgcgtttcagcttttctatgccacataaaacattgtattagaaaccaaaaatagtactaaaggagtggtataagtaggacagagtacagctcagtgctgaaactagcagtaacttctagccttgttggccctttggggcttcacagaggaatggctgtagataaccggagatgttattcggctgggatgcgctaggagacagctccttggctgtttagtccagcatctgtcctgcttggttaggtgtcgcgtttgataggtgagtttcttgatgtcctgattttcaaatatgttaaatataattcttgattttagtttgttcttatttgatttagttctatgtttgaatgctatctgctcacagaggcttccttgaccatcttaactaaaaatccctaccagtcactctctctccctccatcctgttttagttttctttgtaacactcacattccctgatattatattagccttctttctcttctctcctcctcctccctcttcctcttctcttgtttcctcctccttttccttcctttttttcttcctgaactccctgtccttcctccttttctgcctcccttctttcctttctctccatctctttttcttcctccttccctccctctgtcttggattttaagctgcctgagggcaggaacttgttcaggaacttttgtttgttatccaaacactcagaataatactgacacatagacacatagcagatgctcaatacataggtgttaaatggttgaatacatgtccctttacatcctttcccctgcccccagactgtccagttttataatggaacgtgtttgggttcatgccagtaattcatcatgtggttttatgtcctccctcatcctgaaggaagagggacaggtgactgtgttaccattgctgaaggatcatggaggttccagaagctaatgagtgctggtgccttcccagcagtcctgaccatgttacttttctgaatgacctttactgtaatccatccaaggagtccccagcccccacctcaagtgctgttggtaagagagctttctatccaggaactgtgactcataattctgccaggggaagctaacttcttgaataagataagttctcataccagccacattgcgtcaccgtgggagcaggaaacatgttgtaatcccctcagcccatctggcacgtactcatttgccttccttatgaagaggtgtattgtgtctgacagtgatgccacttcctagttggagggagaggaacaaaaaggacatgttgttgacaaaaacgaaaagagcaactggctctgggctagtgggggaagaaagaaatcattgcgcatcttgagggatcaaccaacctctctgcacatgaaagtattgccttttacaaggcatctgtggatgctgacagatttgttggtctttcatgaggctctccctgtgctcaggttcccatctcaacggaaacacaggttgatgtgaggaacaaagcagaaatgttctgaaaaccctaaagcaatctacatgcgtatcatattagtaagacatttattttgttctgagtccttccatgtgggccttttaagagaatcctcaaatataaaaaagaaaccataaaagcataagaacttagcgccatgcaatgtgttttcacacgcagtgaactggccgtgaagtcatacgattctgacttccgatcatgatttttctggtagcagtactgtgatccccttatcccctcaggaatgggggagcaacattttcatcttaggtgatgataaaagcaaatgattttttaagaaagctttatttccctttaaggaattaaagcttggataattataatagcgattctataattataatgtgctagttatagtaataataataaagctccctttgcttaaaaaagcagtttgcattgtacatattcaatgtcagtctcacacccaaaccatggggtagtcagagctgttgtaactacctttgttgggtaagacaagttaggatcaaagtatttaattgtattactcgaagtcacacagctatacttagcatgcttgtgacttcaacgagtttctggattcctgacatccatattatttttacgaaatatgctccagttggggtctattagaatataaattactaagaaaaaagattaagatctaagggatcacaggtaatcattttgcaaactgttgaagaaccactctgtgataggtttctatgctttgtaggtaaggtatatccttacacgcttatcctgccccctcacagcactgaaacattttcttcaggaggaaaatgattgtaatacaaaattcaaacccaatattcctttttttgcttattatagtattaaatattttcactaataaactcgaagaagttctgtttgtaagacttcgaaatggaaacttcagctcaatacacgtctcttttgctgtgcctcattggcagtgtgtcaggaagctgaactgttaaaagctgcctttggagtagacataaattttggaacctgtgatcccaagttgaggaggtaataaaaatagcaccatatagaatatagtgaatttaaaaaatattaccatatcaaaattatttgctggacaaatcacatgaaaaagagagtacactgccaccccaaaatgcaggcacacacacggatctttgagaaagattttatttcaaagtcaacagttgactgtgtgccaggtgcagggctggatttcacacacattatcaggaacttcgcaggaaccattgtacaggggtaggggctggagactcttctacctgtttgatagtttaggaaatgaagatccagggaggtggcccaagtgctcatgatagcctggcttgcctgatagagccaggctgccttgactccagaaacagtgctcttttttatttttccatactataattgcctttctttaggactgtgctctgctactagaagtaagatcctctgattccttttccattatattttacaaaattggtagagaatggaaatcatctatccaatgattgggagtgaattatacaatgcaaaataaataaatagtaaaaaacactgtggtttcctagtaattgagagattcaagttctgttttactctgtgacttgtttgatgacagtaaaggggtcatttcatcactttttgtcattgcatccttatttataaaccaagccaaccaaccaaacaattaacaaacaatagcagcagatcccagtcaattccagtttcttgatttttatgaaggaacactatgcatcatggacacacacagggtatactcctattagctacttaaattctttctaataacaatgttaacaatgatttcactttattctaaagatcatgcgtttgaccattttagattgtagaatccagggttagtaagaggaatttcttattttaagaggaatacagtaaagtttgagagaaggaagaggaaataattaccaaatagaattccgtgagagcagagaaagttaccaatcctatcaggagatattggggaagacttaatcattgctccttcctaggaagaaacgcatctcttatttgggaatgaaatagttcagggcaactcaaaagatagtgcaaaggcatttagaagccaagctggaaaggtaggttgggaacaaattatgcaggacgggaattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagtttgttaccagccccagtggcctcattttatttgaatatccttgctttaataactccgtgctcagatatacttgtgacattgtgtcctgtcccagttgcccatggctggtcatcctgaacactcttcatttctatgtaatttagtccaaacatttggaaaatgtatgaagaatactgtttcattttattcttagtcctaaaggtcattggaattacagaatttcaccctgttgtcatttaaatgatgcctctcggaagcagatctcttcacttttttttttttctttagctgtgtttatagcttgaagcacacttatattttagttacttatatttcccaagggtggatttactgtagcctgattgaaaagaaatttaagtaccacataattggcttgatactgagtttgcaaatacacagcttcttgtatcacagtgataattctaagtttagaaaaatgacctggttctttttcacatggctgtgttagttaaaggaaaccagtatttttgtaggaactcctgcataccgttgtaggaaaaaatgtttgttttacaagaatttattctaccctttgaattacctttgtttttgctatcctttccctcactcccccaaccctgaatattcatttctaccatattttagggaccagattgccaccttagcagtgactcactaccaagaccagtttctacccacttttctttcaccacttaaaaagtttcttttctgtttaactgattaactttttagaaaataaaatatatacccacccaggataacaacacaatgattgctttatttttaaatccactgagtgctgccatctctcatttatttttgaggaacagtgagaaaatggatacatttaacaaataatttgggaacctcagtcaccttcaagttacctgctatccaaacctataaaagctgatgtacaaaattttctggctttgcctttgcgtgttttagagatagtgggaataatgaaaatgcaagatgactacgacaatgagagaaaataaataaaataatcacttcctcagcaacctagaccatattctgttgtgttttatgacattcatttctccttctaccataggaaccaaaatgcttggtatagctatacattactgggaaataaatagcacttttctgcagtgtttgtagggtctgaaatagtttaaggctcttatccatcagcccatttttttttacttctgagatactttcatatttatttatttatttatttatttattttttgagacggagcttcgctcttgttgccaggctggagtgcaatggtgcgatctcagctcacctcaacctccacctcccaagttcaagtgattctcctgcctcagcctccctagtagctgggattacaggcatttgccaccatgcccaactaattctgtatttttttgtagagatggggtttctccatgttggtcgggttggtctggaactcctgacctcaggtgatctgcctgcctcagcctcccaaagtgctggaatggcaggctactttcatattttttttaaagtgctctttaaggtttatagtagtgttcattttgatatgtgcaccaagatactggtgtttgcgtttcccccttcccttatgtaagaaaatgttatggtctctttgagatttggacttgccacccagtgctaccaagactgaccaatttagtctatttgccaattacgtttcctcagtggaaccttctccaggacctactgcatacgtgtagatactcaagaggaaagaaaaagaaaacaggcacatcgatcatgattttttttatgtgtgattttttctgttaactattgctttttattaatttattatggtgggttttattttttcctaattacttacccttgcataagaagtataactatgggccaggcacactggctcatgcctataatgccagtactttgggaggctgaggtggggagattgcttgaggccagaagtttgagaccagcctgcacaaaataataagaccctgactccacaaaaaaaaaattaaaaaaatagctgagtatggtgatgcacacctgtagtcccagctaatcaggaggctgaggtgggaggatcacttgagactggccggtaaaggctaaaatgagctgtgatcacgccactgcactccagcctgggcgacagaacaagaccctgtctctctctttctcaaaaaaaagtacaactatagttgaaatatagacctttattattattactagatgagagattaaattgtatttatcatatgtaaaatgacatttcgaagtatttatacattgtggaatgactaaatctagctaattaacatatgtattacctaacatagttaccatttttggagtgagaagactttagattcactgttatcactttaaagcaagcttgtccaacccgtggcccgcgggccacatgaagcccaaaacggccttgaatatggcccaacacaaattttgaaactttcttaaaacattatggactttttgtgattttcatttttagatcatcagttattgttagtgttagcttattttatgtgtggcccaagacaattcttcttcttccaaagtggcacaggagagccggaagattggacacatctgctttaaggcaaacagatatacaaattattgttcccaagtggataccaaccattattaattattatttactgtagttttgtttgccctttttttcaagggggagaaatctttaattgtttgccatagacttatctgatgaccagatgcaaaaacctactagctttaaattgatgcacctgagttaacctgaatgccctatccttctctagcgtttgggacttcagactatcccaaaattgcttaatggactgatgtttgatttttagagtgaaaacattaattttattcttatattttcaatgttttttgaatttttaaatttatctggtcatctagagaaaactgaatttcttatatgacagatattttgacattcacagcttgattctacatgtctttttgtcattttctggtgtccactcaaggtaaaggcaaataagaaaaaagagaagaaggagagaaaagaggaataatgagggagagaggaagagagagagagacctttttttgaaaaagagagatagtaggaaaaagagagagagaggcataaaatgcaaagagaaaaatagagataaaatattcctacacgggtttcctggatctgatgtaaacccggctatatacttttttcagattaccaaagaagctaaaccatttttaataccacatttaaatactcccccctttttttcctgagctttgcattgaatggtttcctttttgaacagttaatgttttctaggtttttttgtttgtttattttacattcttactctttccctccttccgagtatattaaaatggtgagagaaaatagaaaccttaaatattccagaagtttccttacatctagtgcccctacagccatgagagtggtcagcatctccagggttaatgctttgtttttttttttattttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcgtgatccgcccgcctcggcctcccaaagttctgggattacaggcgtgagaatgctttgttaatcaggatacttttattctgaaaaaaagtgtacagcagagatggtggagacttaaagctttgcatgcccctcaggataatgaaggaagaagagatggcgggcaaaagtgtaagactctggacccccttttgcaagtttatacgttctaaggcagaaacaatctgctgtttgcaattgacactgagctgtgaaatgtttttgctagtagcagtgtatttcttgaggcacagtagaaacccaaccaatctatattcaagtctaagaggagggtgtagctttacttggaggttgattgaaatcatggaaattgtgaatggagtaattagtaatcggaagtgttggaggactttctccctcccgctgcatgcagtattcttagtgaaatgctaaggggaatttcaggaagaaagtgaagacggggttggttgttttattaaggcaaacttttagctctctcacctttattactctaaatatcctgttcttaaaaaggattcttcctctcatttataatgcagtaataattgatgactacaataatagccatgaagcattttacagtattgggtttttaatcactaaaagaagaccatgttaagctaaacatggctttaaatctattttattttaattctctgtaaattgataattactatatagtggtgggtaggtatgtaataggaaggaaggtgaggaaactcacattctttgaatcaaggattatattcatataatattatattcatttctgaaaagcctcataattcagaaatacatgttttcttccatcgttacaagtgagggactccaaattcaaaaaattgaatgaacttacctaatatcactatagaagtaagtggtaaaatttgtattgctctttgactttaagatgcactgtcatttaaaatacaccatgctgccactgagttatttataattaaaacttcattttaaaacatgccaaccaaatctgtcaataattgatgatacggaacacacatatttgaaaagaaacgtttaaccagttaccaaaacagaatctagtatgtgatttttcgtgttgcaaataaaatttcaagatgatttgcttcagtcttcctgaaacatatacagtacattttaattgtgtatatttagataatatacatctttccaagtttatacaaattttctcaaaggaaagcagttctatacaggaagaagattgcagatgaatgaaggaaaggtggcttggtacaggtgcagtgggtttgagtgcagtgggaagctgttaactttagtattctgcaaggttgctttggcattattcatatggcttcccctgtggctaactcagagatactaactctaactccctagcttttgctccttttccaatgactgactgcaggctctgtccctccacttaggtgttaagggactcagtcaaggatgtttacatgtgcctcagagatttttttgggtacccagcagtgtagagttctagaaagttcttttcagtttacaaatgccagttcttttctgctagtctttggcagtgattgaatgtgaattgtgaaatttgattgtggtctcactccaagttctattttatttctggtggagctggaatgttttatctttctcggaaacgatcactttttgtgtgtatggcaacaaaacagctagaataactgtcacttgggctcagcaagtacacaaaagtatgggctgggggcattttaaccaatccatattcatacacaggtaagctattccacttactgcaaactctccagaattgaaatcccagcagatttaatacacaaagcctcttcagtcctagggaaatgagtttttttttaacagactgattattcatttcaaaacatggaatatttttgtcataaaaggatgataagtattgccctcctattttaaatatgtacctttgtgatttaatagaaactggtcaaagatctatataacctccacatttagggaggttggtccttcatgattagatgtgaaacccagttcagcatatgtctcctgggcacctgttatgtgcagacctttgtacgtagggtaggcaaagatgaagacattgtgcgtgtattcattcattcattcatctgtagtgtgtatgtgctggacactgtgcttgcctgtattggtaaccaaaacaaaaattatctttgccctcatgaaattcacagtcttggggatggcttcaagtcttttcttacttgaagaacgtaagtaaacaaatttttataagaagttctctatagttataaataaggcattatattgatggaaagtaatgggatattcctttccttatcccatagttaaggaaaatctattaaagaatatgctatttaattgagaattgagggatgagaaagagccaccttcaaaggcagtggcatgagatgtaggccttgggttgcaggagctttgagaactatggggaaagaaacatgcgacgaagaggaagccgtggtcagagtgcagcacatactgagggtgttgttacatttacttgaactgcagtaaaaggccattgaaaggatttgggcaggactgttacattatccagctaaggtattaaatgatcttgtgagctgctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatttttagaaaaaaaaaatagttaaattcctaccttgtactttacctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgcacattttaatggaaaaattggcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctcacctggaataggctttgtggaggggacctgggctatttgtttcaaagataccaccaaaatgcctccctttaatcttgtaatgaaccatacatgctatattctaagaaaatactcggagaaatgcatcaagacatgctcaaaaactatatttttcataggattgttacaatggccgggcgcggtggctcacgcctgtaatcccagcactttgggaggctgaggtgggcggatcacgaggtcaggagatcgagagcacggtgaaaccccgtctctactaaaaatacaaaaaattagccgggcgcggtggcgggcgcctgtagtcccagctactcgggaggctgaggcaggagaatggcgtgaacccgggaggcggagcttgcagggagccgagatcgcgccaccgcactcccgcctgggcgacagagcgagactccgtctcaaaaaaaaaaaaaaaaaaaaaggattgttacaataagtaacattggaaacaatataaatattcatgataaagggagcttaaatctatatatatatgtgtatatcaatacaatggaatatgatggattcatttatggtagatgtttctgtataaaaacaaataccatatagcagaactagtgtgaaacctttaccaactgtggcagttgtttgccggagctaggtggtatgggcttgtaagaaccaactattcaatttttaggaagcttttgagtcatttgtcaaattagtcatttgaagttggctttggtaagagtttttaccacatgaaaattggtaaaccgatgctagaaattagctttgtcatcatcaacccccggctgtttaccagcacgccactctggtcatgcatgtgtaagcatgtggaaaacctttctggcagaagatacatgccttttctttcccccctgcaggatcttgctctgttacctaggctagagtgctcactgcagcctcaaattcctgtgctcaagaggttctcttgcctcagccttccaagtagctgggactataggggcatgccaccaggctcagctaattttttaatttttttgtggagatggggtctcgctatgttgcccaggttggtcttgaattcctggcctcaggagatcctcctgagtgatcttcttgtgttggcctaccaaagtactgggattacaggtgtgagccaccatgtccagcctacacccaacccttaacagtgattatctttgaaaagtggaattatgtttgggtttatttctgccccttttaaaataactttattttctgttactacattaattcatttaggattatggcctccaactgcatcggtgtttctgcaaagggagctaagcattgggcacacatgggcataaacatgggaacaatagactctgcagagaactaccagagggaggtgggaggaggacacaggttgaaaaactacctatcgggtatctataccccaaacttcagcattatgcaatattcccatgttactaacctgcgtatgtacccccatatctaaaatgaaagttgaaatgaaaaataattcaaaaatgaaattacttattgtctgactgtatttcaatctaattaaatttataattggaagtaaagggtaacttaatttttagaagtaagaaagtatatagatctgagctgttgtattcctcgggatggcaagcaagaggcaattgtgacaggtatgatagtttaagccttggctctttgtttctgtctgtaaattggtatgttaataacttctctagcacagaggtaacttcaatattcatgaaatgacctcagtagaatactaaattagaaactttgtaatggaaaatagatattaccatagattttcctgcattataaccatggcttgtgtttgtgtatttgttagcatgttgtgtcaagaaaataagcattagctacccaaatacttggaatttgaaattagcaactccccactttcctccatcagtctactaatattggatactgtattagtctgttcccaagttgctaataaagacatacccaagactgggtcatttataaagcaagagaggtttaatgaactcacagctccacatggttggggaggcctcaaaatcatggaggaaggtagaaaaggaggagcaaaggcatgtcctacatggcagcaggccagagagcgtgtgcaggggaactgccctttataaaaccatcagatctcatgagactatcatgacaacagcatgggaaaaacccgcacctgtgattcaattacctcacactaggtccctcccatggtatgtggggagtatgggagctacaattcaagatgatatttgggtggggacacagccaaaccatatcagatacttagccctaaacctatctatacaccctgattcttaccaactttatctactcatttaaacatatctctttgttacaggcagctttctgttttgtttgtttttggttttgtttttaaaagctcagtactacagaacatagtaagctagttatcaacatttccgtatctgtaggcatggttatgcatgtgttaaattaatacttcttccttcaaccatcagcctttcttcatttctctatgcaataaacatatgttgtattgggcttacactgtgtgctagatacagttcacattatcattatattcactaaccattacagggatgaatgatatcatacagtatttacagtattaaaatggttatattatttgatcttagaatagcattgtaaaatatattattattgtcacttcacaaataaggaaatagaggcccggagagattaggtggtttagacgtagttttgcatataggaagtagaaccaggactcaaggttttgtcctctgttcccaagcccattattctttttcctggcagacccaagggattcctacctttttattactgaggacatcttttattttatattttttctaaagattccttttattgcaagcaataaaaccagacacattagtcgtgctgccatcacaacaatctaattttagaacatttcatcaccccaaaacgaagccctgaggattagcagccaatccacaacccattctcccccacccaagccctaggcaaccagtagtctacttcctgtctctatagatttgcctattccggatatttcatacaagtgggatgatattatatgtggcatattgtgattgatttagttttcacttaatgcaatgttttcaaggtacagctatgatatagcatgtatcactacatcattttttagtgatgaataatattcatcattgaatcataattgagaaatattattcatccctgatgcacctgtgtgtgatttccaaattttgactatcatgaataatgctactatgaacatatgtgtacaagtttttgtgtggacatatgttttcatttttcttgggtatatagctgtaagttgaattactggatcaaggtaactctatgcttaacattttgaagaactgccaactacgttccaacgtaactgtgccattgtaaatgtctttttgaagtattttgaagtatatacctatttgaggtatttgcactctcatattcaactgagaacatctcctgtgagtatctcatgttcaactgatttcagctcttgtgtatctcgtgttcaactcttatgctcaactgatttcaactccaatgaatatctaccaagaagtgggactgctggatgaaatgctactctcatttttaattatttggcaaaacttccatagtgtttttccagaatggataaagagaatgcattatatcatacaattgagtgtcagtcagccctaagaaaggaggaaatcctgccatatgcatagacctggaggacattatgctaagttaaataagccaggcacagaaggacagacactacatgatgctatttacatgaggaatctaaaatagtcaaactcatagaagctgggagtagaatggtggttgccagaggctgagaagggggagaaatggagaggtgttaatcaaagggtgcaaagtttcagttacgcaaggtaagtcctagaaatctactctacagcttagtgcctatggttaacaattctgtattgtatacttaagaactcgctaggaaattaaatgttacataaagtgttcttatcactaaaataattaatacataaatgaatacataaatagggcaggaggaaacttttagaggttatgtgtatgtttatggcatagattgtgatgatggtttcttgcccgtgtatatatctccaaactcctcactttaggcacatcaaatatatacagctttctgtatgtcaatcatacctcagtaaagtggtttttaaaaaagaaacagcagaagaggtcattgtgaattcagaggtcttcagaggactcagccctttaatctctgattcagtaaagtggcattcgagtgtttccttttttgttagtgtaacaaatataaatctcagtgctatgggagctcagaaagtgttctggatcagaacatgccctgggtaattcacagtgtataaggcagagaagaaaaacctggactcaagtcaaatcctggtttccgtatgactctcagtgtccttatctataaaatgaagctgatagtatcagccctgcataccccacagagctgttttggagatccagtgagagaatgaatctaaagttttctgtaaccagtaaaagcaaatcaggaagcagaagctcagtcaaatgagcctagaaaccacacacttggcaggtaggtaagcaccagttggtgctctgtattatgagattaggactgagaccttttacattcgaagctgggtgcttgccgacaagaatccgtatttccaaatgtgagcaaacccttgcccagcagagttttcacaaaatccagatgttgagttttgtgtcaattgtttaagaattcaaaagcagatagtagcatatttttcaaaatcagttgcttgacaaccagtttatggtcctatgattctctgccaccttccctggttttgacgactctaaatcagttgaaacttgtattatttttctattgtatttttcaatatatttgccaaagaatatgggaaaagaaactttattcattcaacagccattgtttgaggtatttccatgagccaggtatttgataggcattaggatatggtgaagaacaaatagtccctgttcctttcttcatgctcgtttgtgtctcatatgtctaactgtttcagggtccctgctattcaccgtgactcacagatggcaccaatactgtgttttaaaaatgaaaagcaaagtggaggtcaaagttaggttctaaaaaaaataaaaatgaggaataacataaggaggataaaagatgttgaggctgcagttcagttctgttgctaatttactgggtgatttgggcaagctacttaacctctcagaatctgtttccacatctgttaatttgcttagttcttgactctaacaagctagcattctgtagtttgagatttaagagcctctgaaacaagtttcctttctatttctttacatttttgatcaatccatctttgctcattttccatgtggctcttatctgctcctctccatcttaagtattatcctagtccaagccacatcatctcattcttgaacttttcttttcttttttttttttttcatttgagatggagtttcactgtttttgcccaggctggagttcagtggcacgatctcggctcactgcaacctccacctcccgggatcaagtaagtctcctgcctcagcctcacacatggctgggattacacgcgtgcgccaccacccaggctaattttgtatttttagtagagataaggtttcaccatgttggtcaggctggtctcaaactcctgacctcaggtgatccacccgcctcggcctcccaaagtgctgggattataggctgagccaccctgcctggcacattcttaaatttttctgcagtagcctcataattagctgtttctccttcacttttactctctacagtccattcttcacacagtaaccagtgttacctatttcaaattgtaaattaaatcaggtgtctcctctgtggaaaaccctggaatatgtcccattattcttagaattaaatttaagttccttacagcggcctatatgctcttatatgttcaaattcctacctgttgcttcagcttcttcatattccactgttttccttgcccctggcagtgaagttttctgagattcttcaggaacttcacatgtactattccctttctcacctaagttcttccttcacacactctcctctcaactttgtccctcacatcttcattctatttcactcagctcaaaagtccatttctcagggaacatcccatctcctgccctaatcagcgacctctcaggctaagtaagatccctgttaatatatccactttatacgctgtacgtctttttcatgataatcactccaatagcaattgttgttaattgggtaattatttatttaactacttaattaatgtctgtgaccttctctagaatgaaagctccatgacaacaggcagatttatttgcctctgtatgttttatgtgtagcaaagcctttgcagttagtaggtgctcagtaaatactcagcgaatgaatgaaaggatataataaataggtaacacttaattctttaaatcagctatgagattattttgtatgagataacaaggtatatatgccagagagttctgaagaagcatagacgtttctttctatgtagttactgatctctgtttttactgtgagtgcaaacaatactcatgccaccccattagaaacaaatatccaccaaactctgtgtgctgggcactaagctggatgagcaggactaaagctctctctttgagctcacaatctagcagcaaattagcctcaaataacagttacgcaaggtacgaagtggttagtatcataagagaggttcagagaaacagctatggtggtttcaaactgagagaaattgcttcaaactgagagcagccatctatatatccagaggtgtagtgttcaatttaggccttaaaaaatttgtgtgatgtgactacttggagataggtgagaaatggcaatgaagaatggagctatgattaaataattgcctctgcccggttgttacaagtaaagccaagtctctaaacaagaggcaggaacttaaccttttaaaatttatttttatttttattcactcttatttacatatggtcaaattgagttttttggtgtaagaagtctgtgaattttgacaaatgcatacaaccatgtaaaaaccaccacagtttaggtacagaaagtcccattatcctcccaaatttctctcatgctgccactgtgccgtccccccacacccagtcactagcaaccactgatcgttttctgctcctataattctgccttttccagaatatcagatagatagaattgtactggtctggcttccttcacttagcataacacatttgaggtacatccatattatcatatgtttgagaagtccattccttgttaccaagtaacattccattgtatggatataccactgttgtttattcattcattagttgtaggatatgtgattgcttcaagtttttggctattatgattaaggctgctgtaaacgtctatatacaggctttgtctcaacacaagtttttgttacctaggactgatattgctaggtcatatggtaaggtcattaggtatgtttaacctaataagaggctgccaaactcttttccaaagtagctatactcaattctgtattcccgtcttcaatgaatgagagtccagctgctgcacatttcatgaacacttgctattttccattttttaaaatgctaaccattctaatagttttacagtagtatcttgtgtgatttttaatttacatttatataatgactaataatttggaccattttgtcatatgtatatctcctttggtgaagtgtctgttaaaatattttgtccctttttaattaagttcctgatatttttctttgacttttgagagttctctatatattctgaaaatgagttcttcattgaatagctgatttgtggcttgtctttgctaacctttaattttcttgttattttaaaaatcttgctcccaggcccatcactggatctcctatagtctcttaggtctactcagtatgtttatagaacttctaggttttttcagacacagtggggatctaggaagatgaaaatgaccattgccctgttaacaaggagcttttgagtagctggaaagagaattcaggtatccaaatatttataacccacgaaataatgtcccgagtgccatagggatgtatagatggtgtgctatactgcagagtgttgtcactcattgaggtttctggttactaaaatactttgaggccccgaagagagaaacaataaagactgtggatgattacatcctacaaactgtaacaaagtggcttccctctttacagcctcatgtattatctttgatgatgatgggcattaggggatgaaaaaggggccgtgccaggcaatgcagtctttctcaacttgatcagtcacagtgcccactctaaccattgtcaagcaaaaggaccacatcagaagccattagcctcactgcatctccccaccccctcagcccgtttgctgtaattgtcccatttgacttcgtttaataacaaatgggtaaagaaattccatgcttgacacatgtggagttgcatgtgtgtgtgacccatcagacagcttcagggcacaagtatactgcccagcctatcttttgcttctgctcatactaatcattaacatgtgtcactttaggctgggcatggtggctcacgcctgcaatcctaacactttgggaggccgaggcgggtggattgcctgacctcaggagtttgagaccagcctgggcaacagggtgaaaccctgtctctactaaaatacaaaaaattagccgggcatggtggtgtgtgcctgcagtcccagctacttgggagggtgaggtaggagaattgcttgaacccgggaggctgaggttgcagtgagccaagattgcatcactgcactccagcctgggtgacagagtgagactccaactccaaaaaaaaagaaaaaaagaaaaaaaagtcactttattcattaagtaccattagtgactctcagttgctacaaggataaagtttgttcttaccctgattgaccctagtctcattgaccctttaccattctcatgctttgtgaaatcatcccacaccctgtgatctaaccccggctgactcatggactaactcatcatggctcacatcagcctggactcctccccttggaggaggagtcagtgcacattctatgcattttttccagacttaaatcagatgccatctcttctgtgaaggcaccgatgagtgtcacccatcttgaagtccgaattaaaagtgccttctgccctcctatgacacgttgcatctttattttttccttttagcatttgcttcattttgctttgtgttgtggttgtttgcctgactctccacccagtcttgacagtgagatctttgagagcacagtctatatcttccttgtatctttatccctcgttggagcctaacataaactgttgcatgtggtaagttttcactgagggtttattgattgaaggacatgccataacccacagttcaccttgctttgtgacccagacagaagaggtgtctcagtggctgatagttgtaactggaggtgacagggggctctgatgtgttctaagcaaagacagccctgtttccctattggccgtgattatgccctcctatctagaataggaaaagggtgatttgattttgagcaataagcaacctgactctaattgtctaccttaaatgccttccattgttctgcttaaggtgattttctaccagcatgaaatgttctccttcccagacagttgatggaggagctgagtcatgcctgactatacttaataagacagaggcagctaatgccccagggagctgccttcgaggacagcttgacatttctgactcctctgctttttaaaagtgggtgttgtgagggaaagttaagcatgaaggtagcttcggagtctccactggaaacaggactatatagtgacactctctaatttagacagatgtgatctaccccgctgcctcttggctgtgatatgtgccttccgatgctgggaggtgctaatcaaggatgtcatgtttttcatgaaagagtctcacttgcttactcactttgttctactttctattaatgagtgcccacccacttccgttcttttctctgaaaaactggcttgatttatatttttcagagtcaggctagaaaatactcttgaagttagcatggattataaacccatcatattatagagatggacagggttacagatcatctggttttaccttcttatacgtgataaaactgaatcccaaagcaggaaagtgacttggtcacagtcagcattaaatttcagactctagagagtgacagatctgcgttagaatccccgtctcctactgacttgctgtgtaattgtgtgggtatcttttaacttatctatgcttcatgctcgtcatttgttaaatgagggccataataaagctatctgaaagaggcattatgaagagtgaaaatgataataaatgtaaaacacttaatacctggcgtatagaaaacactcacaattaagtgaatggtactggtagttcctatggtggtggcagttttataatggtggtcacactggcagaattaggacaagaaaccaggtcttctgaccctatgtctttgttctccatagggtatactacaagatgtatctcaggaactatatttagctatgaggaagtttaaagtgatctgtctgaagatgaattcctatattcaaagaaaggatcagtagcgagtttgctgtagcacagaaggaaaagaaaacatggtttgagatgtttgtcaacatgaagaatcaaattgggcggagtgtttgagggaagaaattatatgtaaaatctccaaaataaaaaccaaggggctgagtaagacctgagaacctgaggtcagtggatagaggactgactctggaatcagaaaaactgctgcccaatagctctgtgagcttcccaattcactctctgaacctctctttcaaaccccaaaatggggcaatatcctctatatctgggatcaaaggatataatatgtctaaaacttccatctaaactatacattactatggattatgtcaacaatgttggatttgcagtctttggtgggatgtggtggaagaaataaggcaatgatttctaagtgatgcatttgaaacattttcctacctcaaagcatacggagataaaaaggtctcttacatctttttttctttctttctttttttgagatggcatctcactctgttgccaggctggagtgcagtggtgcaatctcagctcactgcaacctctgcctcctgggttcaagcgattctcctgcctcagcctcctgagtagctgggactacaggcatgcgccaccacgcccagctaatttttgtatttttagtagagatggagtttcaccatgttggccaggttggtcttgatctcttgacctcgtgatccgcccgcctgggcctcccaaagtgctgggattacaggcgtgagccaccatgcccggcctacatctttctaagcaaccatcttcattattcattttccactaggcagggaatcacatgcagcattgggagtccaaaagtcctcagggatgagtgtcttggacttgacagtgttgtcctggaatatatacctggacacacatgcacacacacacaagatgtttgtgtgtgtagttgtagttgtaccatgcagttcctaaaagccctcttcaaatgactgtgagttattttcctggtctttcatctatttttctaaatttgatttttctagaatgtttgttttcttcacatatgaaaagtacattctcttgttttgcttcctttgttctagattttagagaagttggtttgtagttttctctttcccaataaacgtatgaggcaaatgttctcaaccttagcactatagtaagtcaataagctcaacataaaagtacgtataaaaatttaacccctgacataccaagagaaaagagaaacaaagattgatataagtccagtataaactcttatttttgcagttggttttatatgcagaagtaatgttcatgatatggttatcagagagacttttatcctgcctctgctactaacccagtctttcacctcaggcattccctagcccctctggtgtcagagcctgatctgtataatgtgtcatggggctggatgatttttgaatccaccttccagctctaacatgcagtggttttctaagatgcacggtggattataggggacttcagtgttcagaaacttagaccaggattttatcttagcatttactcttcccaagaccctgcttctttccttgggaggagatactgttctctaggtgagtgaccactaaaaacctagccactcagcacccccacctcttgaattcttcctgtcaccccatcatattcactgccagacatttctccaaaccccatttctcatgctctcagcttttgttgcttgcttcacccaattttctctcagaatcttttgttttctgcttgtcactaccagccatcaagaaaaatctacacgcttgacacattattaagatagaatgagactgcaccggcgtttcgcaggtgatgcctctgttaaacacagtggcaggattgtcgcctgtgtctcttcctctggcaggtgatgaagatcataaatgttcttttactccaggcagtttcctgagaattgctggggaggttgctgacaaggtttgctagatgcactttcctttgactttgtaattttgcgtggaatattggctgcacatcttgaggcggggaagttagaaagctcctaattgaaagttgaaggccccgatgtacttttatggaatgagtctctctgagcccccaactgggaagtgtaagacatggtgttgaaaggtacagagacccattaaatacatgatgggctttaaattccaatcatgctgttgagtggaaaggtgttcactgacgtatccttggtaattaagaagagagttcatgctcagactgccttctgcattttaccactcaaatccaagctttgagtttcctgcccttggctctggtaaaaggcaataaaaactcaaaatcaaacacacataataattcctttctctgctgattctctttccagatctcaattttctcatctgtaataatccacatcatgatagctaaaacatattcatattaagttcttactgtgtcagagtccatgtggcattttcgtgtatcatcttatttaccgctaacaacagctctatgggattggcactgattaacttcatattttgtgacatatatttgtgacatgtactgttacctatgtggcaactgtggacaggattcttcttcttctttttttttttttggtgagacggagtcttgctctgttgcccaggctggagcgcagtggcaccatcttggctcactgcaacctctacctcccgggttcaagcaattctcctgcctcaccctcccaagtagctgggactacaggtgcccaccacattcccggctaattttttgtattttagtagagatggggtttcaccatattgcccaagccggtcgcgaactcctgagctctggcaatctgcccgcctcggcctcccaaaatgctgggattacaaggtgtgagccaccgtgcctggccaggattcttctttccaggtgccacacttatgggcagcgatgccatttagcttgttttcagcctcaaggacaaacccacatatcagctttttcacttgtaaaatgggaagggtgaaaatagtaattttatgacttgaccatatagaacacatgcagcgttatcttttttggctcagtattaacgttgtctgttccagtcttcctgggtttgattcttagcctgcttcatcctctgttttgaagaggagtgtactgttgtactatttacattcaaagtgccaagtgggaatgtctgtgcagatatttatttggaatatatatttcactgggacaatgtagtagaacacagaatttggattggagaggaatgattttatacttgctacaagtaaactcttgtgttactcaagttatctttctgggtatagtttgtaaaatcttctcatttgcagaatgagaagaattttttaaaatgttgtaaaatctcccttgtcgtccaacactctcagacactttgtcacaggtgaatctccagagcttaaacatcaacaacatttgttgagcacaattcagtttgaaatgggctatactcagtttgaaagtgaaaaagagagaaatataatcataacaacagcaaagattatgtgaccagctctccgctaaacacattaccagtgttgcctcatttaatcttcaaaccagtttttgtttacacatgggaatatttaatttatttgcacatagtcacgtggataggaagtggcagaacgaggtttagaacggggttgttggagacttaccattgcatactccctagggaaagcagttgttttgggacattagagccctggtttggcccctccccaccactatcatatattgtttacccatctctcagacgtgttttttgtcctctctcgactgcattcacttcatgtatggaatgggggtattttcagctatcttactggaattcagggctgcaactagacctgaggcctgtattttctgggactctaatgataacatgtgaaataactttatttcatgcgctgtcagtcttgaatggaaatttcaacacagagactgtatattttctagatattcttcatagcccctagcactcacaggatcctgaataaatattatctaataataagaataaagagagcaaaagctgtttgattattatattaaaataatcattgaatttttacatcttaatcatggattagaaaagatagcttggagggaaaaaaacccccacaaaaacaagctaatgactgcttagcgtttctccagtgtactgtgtcacacttgacacagcctgtttatttattgtcacaacagccctgcaaaaaaaatcattcccttcagcagcatgaggttgctcattacagtaattttttttaaagaaaaccatgaaccatggtacagaagaagcatactcagaattcgttcttttggtttgtttgtttgttttgagatggaatctcgctctgtctcccaggctggagtgcagtggtgcgatctcggctcactgaaacatctgcctcccggggtcaagtgattctcttacctcagcttcccaagtagctggaattacaggcacgcgccaccacacccagctaatgtttctatttttagtagagacagggtttcgccatgttggccagactggtctcgaactcgacctcaggtgatctgtcctgccttggcccagaattcattatgtgggcttctatcccctggtgccactttgatgagagaagcagagcttgttacaggtggctattagatgatgttactgtattaccttccttattctgcacaacagcaggaagggtggctgctggaaccttctgggacataaacacatgataattcagggtctttttgctggtaatccaaaacccagttatgaaatgatttgagatatggaaacagcctggagaccttcagcagcttcgttagaccaggaagctttaaaattatctagaaaacccagggtttttattcaggtgctctcccacaaggaaaactttgtagaaagtgacgcttgtatttacaaactaagagtgaaactccagcatggcagatactgactgcaaactgctcggaggtgctaaaatattcatcctttaataatgctagactctgaaagaccccagctcttttagatttgattttataactctaagtattgcctattataattctgaatttaaacttcgtaggattggttgttttcatccgtcagggttcactttcctttcttacctctttcttttcttcttttttcctttgttcaggtttactttgtaatgatttgtccatactttttattttttaactggatggaactgccacttcaaattgatatgaaatgacagtctttagggcagtgtaaatacctggtgccataaacaggagtagtacactattcggaataaaaattattctaggagcaaactctaatgaaactgaaaccgtggcttgtggatttctccctcaccaaaccctttttttttttgaatttggcattctttcctaatctgacaaatgttatcatcccttgtatctgtcagagctattttccatttttttttcaaattattcaatcaagaaaacttccttttgttggtgggagtaaggtatgtctaattatctggtcctggaaagcagccatctgcccagtgatgaacacgggtttgtatgcagtgccagcaacatgaggatgcgtgatggatgctcacagacactccagctctccctcctccactcctgacttcttgctctcctcttgatgacttagtcagtgaatgtgaattttcagaaacattttctagactttgtttgggtagctctaccctgaataaacatatctaagttttaatattgtgttagttttctctcatactgctaataaagacataactgagactgggcaatttataaaggaaagaggtttagttgactccagttccacatggctagggagccctcacaatcatggcagaaggcaaatgaggagcaaagtcacgtcttacatgtcagcaggcaagagagactgtgtgcaggggtactctcctttataaaaccgtcagatctcgtgagacgtattcatattatgagaacagcacaggaaagacccacccccatgattcaattacctcccaccatgtccctcccacgacatttgggaattatgggagctacaattcaagatgagatttgggtggggacacagtcaaaccatatcaaatatcttccactataatataaattatactctaggtgaatggtgtttgcagatatttttggaaaccagtggtatattataggatactgctagaaaaatgtctagatatttaaaataatttgtcattgaggaacaaaaagaatataagtcaaagagacatagactcataaggtggttaaaatctcaggaattgttcatctagccacttatttgaacagaggaaataaaaccattgttatcagtgaagacaatgatcagccataagtagacatgtaaaataacagctgtttaaactaattcctttccaagtttagtgagcatagggattacctggggattgttaaaatgcagatcgtgattcaatacatcaggatgggttctgaaaatctgcagttctgacaaggtggcaaggaatactgatgatgctggtgggttgaggaccagactccaagtaatgaggatataaaaagcttatttatcacataaaatgtagaggtggaaagttcagggctggtaaggcaactccgcaagttattcaaggtcccacctcctttcactttcagatttcaccatctttagggtgtggtcctcattcttaccgttcattatgtagcgccagctatcatatctatctatgtcccacgcagcaggacagaagaaatgggatggtaggaggagcatgggaaccataggaacatgccagtgtctctcaaggaagatttctgggatctaccatatgacaaatttcaaaccttttctattagccagaacctagtcacctgaccacatccaggtgagaggcaagctgggaaatgttacttttaaactgagtggctatgtgcctaactgaaagtccccacactctattgggaaggggcgtgtgaggcatggaaatggggcatgtctagcagtccatgccacagatgcggatgtctgacacaagaagtggtttgccaaagatcacagaaaaattacagttcatagattaattataaccagtacatgtatggacattctcagtttatgtgtggtgctgttttatgtcataggcttatttcattttcataactattttacactattatgagcttcttttttggttgtggaaactgaggttcaaaatggttgagggacttcattgatcataaagcctacccttactactctctttataattgcatattcctgtctctcccttctctctccctccttcattcctgattcctcttaccagattctatattgttctttgttcccttcactcatcacctttcaacattctatatatttttcttatttagcatgtcaattgcttattgtcagtctccttgtgttagaaggtgagctccgtgagacctttgttttgtttgccagtgcatcccaagcacccatttagtatttggcacatgacggaatgctcagtacatagttttttaaatgaaggaataatgccactaggtatcaaagtccgccttggaattatgtctgttatcttcaaccctaatgctatacgccttctccatcagggcttctgctaatgttttagactctggaactcctgtgtttgcctcagaaatgtgctcacacttaaacatattgatttcctccttgtcttcgtgacattcatttaatgttgctagccaacttaaccagtttgctcttaccttcagttctctctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatgggacagtttctaagtggcctgatccgcattggtttctagtttggaatgtaaaaggggactggttctggtctcagccaaatctcaagactctcacctccaccctccgccctgtttacagtaatagaattaatataaaatgtagcacaatataatataatagcatttaatattattatgcttctgtttagaaacctgttatgacaattggttgatttcattcagttaactctatttctatgtctttcttttgtgaagattgttaattttctgatgggaattttctgatacaggttcagctaatacgtactgagctcgttttgcatgctaggacttttaactctcacacagcactgtaagataggcagggtgtacatgcagagactagtttaagagaagcattttgtccaaggccatatggcaactaagtggcacatggaaaataattaactatggaaagtaattccactttaggtctcctaaaattcaaatctttgctctttcttttctatacctgagtttcctgattttttatacttatatgtctgtctaccccagcacctagcatagtgctttgcgcatagcaggttctcaataaatatttaatgaatacaaatatatgaagagcttttctgtggaaaatattctgctttgaatgtgtgaggatacatttgggacaaacatcctagctctatagtcaggcagctttttttttttgtgctaccactcaggcaaaagtaagtcaattaatctctctgtctccgtttcctggcatgtaatgtgggaatgggcatgaaagccctagagtgtgttgtgagattaattagttaaaacgtataccctgctatataaatgctaattgctgtcaggagcgtgggttggatcttccagtgacttggctttgcaaagctttgcacatttccattagtcctctgtgccaccaagtctcagccttaagaaacccttttggctgagaggaatgatgactttgtggttctcccatgttgagaggccaatttagagaggacttccactgtggagtaaactgaataagaagggacattataaacaaaaaaggaattcttgtgctagtaatttgctaaattccctttgctgttattagagacaaatgtatttgcataacagccttttcctgtcttttctgaggctggtgcctgcagtgaatcatataattaatttggtattacatgacactccagcctgttgccatagattttatttttatttgttcattgaataatataaaaagctctgacaaaatgcgctcaggtggctgtctagagaacttaaaaactcacagaactaatttcaaatgggcaaatatcccaaagaaaaagctcaataataataatgtttatgaatgctaatacatatattttcaggctctgtggtacaggaggctgactcactttacacacatattcatttggtccatgaaacatcatgtaagggagatacatggcaggtataattatttcctttccctttaaaaatgtattgaatttaattgaagacatattaagccgatggattgggccagaaatcttggtgattgacttgtattcaaattttagtatgtaaggaacaaatgcttttttaaaaagtgtctggtcttgatttattaacttatgttatgaaaggaaaattctaccttcctttttttgttaatcaagataggcagtactagttgctatcacaaatctcagtgacttaagacaatagagatttatttttcactcatgtcacagccgcttgaaagtcaagtggcattcctgaacagctctgctctgagcagtggcaggaatccagattcctcccatcctgtgatgctaccttttcaacagtttctggacttcagggcctccatttcagggaaagagagcatcagagattatgctggggatttcaggctctacagcatttctgcccacatttcactggccagaggaaattcacatggccccaacccaattaccaaagagaagtagttttcacatgagtcaaggagaacagaattaatgagcatatagacagtctctaccatagtctgttctcgtgatcactaaaaatccattttataattcctcctaaattggtctgagtatatgcttgccgttaaaatgttatgttagctctccttttttatttcctctttcccaatcggcattctcctactttacaaaagaaaaatctacatgtcgctcatcatctatcttactattaattattgcccagggctataaagattttcagggtctaacatgacacttattttattggtgtcagaatgtctccttaataagggcactgttaaaccccagcaggccttcctttttctctccaatttaccaatgtttctattaagagtgaatcatgacatcagaatatgatctgtggcccaagttggagtgatctgaattgatacacattgtagagtgggttataggaaagatactaatttccatttaatagtctttcgtctaccatcatctaattgcagtccaaaaagtgcagtcttcagggagatgcttttgcaaaacacgtgaagaatatctgtaggaaataccaatggcagtgacatcttattttatctagacaacaaacagtataatgaaattgcagactccatttgctatccaactgttttcttcctctttttttttctatatactttatcattcaaagtgaaatgactgtcaagccaatacataacaacacaatttttggaaataaaatataaaatcaaaaatttttctaacagaaagtagttatgataaggatggtttgacatagaatgggtttgccaactgtattacctagtggatattttcttccttctttcctttcttccttttattctaattattattttaattaatttgaaagcaaattatgcacagatttttaaggtcaatatattaaaaaaaatcaaaataattatatactttctgccttaactatcctcacttttactaattacccttctcagagacaacaacttggatgtcttatttatctcttctaatatttcccatctatattttgctaacctatttgtatacattgttatcttttgtgtagtcaacccaaggcattatcttttcacttttttcattatagtaaatgaggataatctcactgaaactgctatcccttctacccattcttctctatatttcatatttggtcgagtcaataatcatttcattaatatgttttcacatatttatgaactataattctattacgtctcttagtttttgaagttattaactgcattgcttttcatatgcttattttaatttgtatgtttttgtaaccatttttatagctttcaattgcctttcagcataatttttcacatttttcacactgttaatgacatcagataatctgtcagttgtgattattttttcccttattggaggtttccaatccctactacctatactggttcgttaccaagccctggtgcataaattttatccttgggtctcgttcactgtcattctgaggatccctttcctctcttgaattagaatccctattcccaatcctaggttttctctattattgttttattctctcatttttgtggcacacatcccccgaagctccctgataaggaggacatggtaaataaattgtggagtctttacgtgtctgcatttgtcaccttcacacttgattgttttattatgtttaggttctaggttggaaatacttttccttcagatgcatcgcttcattatcttctagtttccagtcttgtgtttgggagttcccaaaccattctcattcctaatatttcgtaaagtgactttttttttttcctttcctttcttactccttggcagtttgcagaatcctctctttctctgcaattgttttgaaatatttatgtggtgtgagtctatttctatccattattctggggcaattgataggtccttagaaggttgtatacttcagttctcagattttgttttttttctgtgaattatttaattgagaactttcttggtattttgggtttttttttttttttgaaaggtgtggtgcagagagttctcttattgagtgattgagattcctgaagtgggcttctaactttcttatctattttctatttctttttctttctactctgctttttaggaaatctttaaatttaacatctaaaaaaaaatctattaaagttttttgttttagtgggcttttgttctctgaatattgcttggttatagcatttgttcctgcttcatggatgaaacaggttccttatcgctctgagaatgttgatagtattttttacatgtttacttttccttgaataatttgattttctccaagttccttttacttttttttttctgacattacattttgtggtagaggtttttctcagatgatctgctcagatttaagaagaagtgattaagaagctgattggaaattctaaatgtgagtgtgaagccgtgatgctcgttaaacttgagcttttctgttggatgatgtggctgcacaattttctaaagagcttctgatagtaagattgtcatatatttcttcttaaactggccagattttccacggaagattctttccttctcttctgtggagagtaaatgtctgactgccctcatccttggagctgagtgaagaaaactgttcagtgctagaagagtgggcttggaacaaagcatgtaacttttttatatagctgtcattctgtcttctttcttttaccattcttcccatatcttcggttttgagatacctgactgcatgtgccaggatagattattgatattggtaataagcaaatccaaatcatctctgccttcaaagaacaaagttgtgtggtatgccatccatcaaagtacccaacctaagggagcctctgtctctgtgctttcatatttgccaaggcagaagaaaagggaattttgtaaaatataccccatccaaaacatccacaagtaggactgactacatcttcttggtcaaagtaagtcacatggccgctccttacttcagaggtgtggaaatgtacaatcttatactcggaggagaacccataaatagtgggtgaacagcactaatgactctttatcttgatgctgataattcctgggtcttttcagcaccctgaactacagattggtttgttctccagttctctgctgctggtttaggatttgtctttttaggtgtgttaagtctgttaccacttgtccatgttggtatcactattgtcttttctcctactcttgcagttacttgggattatgtattaaacattattttaattttcttttcttttctttttttgaaacagagtcttgctctctcacccaggctggagtgcagtggcacgatctcagctcactgcaacctctgcctcccgggttcaagcaagtctcctgcctcagctttccgagcagctggaattacaggcctctgccaccatgcctggctaatttttgtatttttagtagagatggagtttcgccatgttggccaggctggtctcgaactcctgacctcaggtgatccgccccctcggcctcctaaagtgttggaattacaggcgtgagccaccatgcccagccaaaactttggttatacttttatataaactgaataagcgaactctgcaactttgcaaatattttcaaagaatgtgatactttataaaatacattgtgttacaagtgtgcattgatgtgaacaacactgatttttccaattatttctctgtatgttttttaaaagttgcttctaactaaaaacatagcaacaaatagtcatttgttgagtcttggaaaaactagttgttaaatttccccgagctttattacttacctgacaaatccttttgcaagtcagaaagcttcagattcttcacttttatcaaaattagaataatgacaagtgagttgttttgccagttatccactgctgcaaaaacggtgccttgcaaagaagcacaaatttaaatgaccaaacttcattttatttatttcacttgtatttttgcttctgagtctgtatcttgtgcggctcagctcgtccaggccggacttgctcttgtacctttggtcagttgtggaaagccagatagccatacttctggaggtgggccagctgccagctggggtgtctcagctgtcctctctgtggtctcttatttattaatatgcttttgtggacttgttctcatagtgacaacagagttccaagagaaaaagcaaaatcttttaactcttaagtttagatcgtcacacaccacacaatcacttttgctgcattttgtttgccagtagaactcacaaggacagcccagatttgatggctggtgagatagactcttgattggaaaacttacagtttcaaattgcagaggatgtggagataggggaaagggaaaactagggctgtttttgctgactctgtattccagagttttcaaatgatcgttaaaaataatgtttgatgataaaaatataaaatgggtatacagctcagaaagaatttaaagaattgagtgaccttgtggaactaagctcctttagttccttactgtaaacaaattttcccagttctcacgtgtaagcaaacaattttcaactagtacctaaaaactctcattcaaaaatagcccttctatattactaagaaatgatttccaatgcaagctttacattttataatcattaattacttataaaatgaaaacatattatttaaatttataagacatttcaaaaatcttttaacacttagcactttacatattacacaaaagaataaaatgatgaaaaataaagcataaactatcaaacataagaatatattccattaaagtaaatttgcatgtggagatagtggaattaatgtaagttcaaggaaaaaaagaaactatggaatttataatggttaaagaaagcttttttacatgtttttaggttggatattggtgtatggcaaatcactattccattggatgtaattaaaagaatgatgtaactcttttctttcaaaatggcattacttatgacactaaatatatcctttccaattatacttggcatgagaagttttagatgtcaatggaaacgtagggaagattacagagttaaaaaaatacatacataagcatgtgtatgtgcatatgttagggacatgaggaaaaaactactttaaggtgatggttttgtggtccgcaggactccatcaccctgacctctgttcactcttcatctggtgacttctagagccctccattcagatatcactctaaagaaaataaatattttcttgttttcttaaaataaagaaaaaattctttaaaagaagtttgtttttttttctgagtagatgagtgattacttttcattataaagaataaattatagaagccattacgcacaaggacagtgcagattggaggggtggtaagatagactcttgattggaaaactcacagtttcaaattgcagaggatgtggatacaggggaaagagaaaactagggctgtttttgcagactgtattccagacttttcaagtgatcgttaaaaataatgtttgatgataaaaatataaaatgggtatgcagctcagaaggaatttaaagaattgagtgaccttgtagaactaagctccttttttatttgactctgtcattgaaactgtagcacctttagttctgaatgagtattccaccaaggagtattactgagatctcttgatttcttgaggtctactgtcctgctgtccaataaagtagacagtagacatatgtggctagtccagattgagatgtaagtgaaaaatacattgaattttgaagatgtaccacagaaaaagaatgtaaatgtaaaatagctcatttttttatattttggatatattgggtttaacaaaatattaaaattaatttcgtctgctttgttttacttttttagtgtggtaactgaaatgtctaaaatcacgtatgtgtgttgcattataatttctattggacattgcagatctagcccatgaatcagaagatctagagcaaactgggagtcctttctcccatttgcccaaggattgtctttttcagttacaatttcctccttaaaccattctctgttccacaaagtgaaaaaacacttgatgtctttcttaggtgaaactttctcccataccttgcagggcttaacagggtcaagctatcagatcaaatcattattcaagagatactcagaaaataataaataatggggaacagcagtttcttcacaccaaaggtgcctactgtatgcaattattagagggaggctggaagatgaccagagaaagaggttctggaaaagaccgggtgaactgaggagaaggtgtgttcttttgaggcctttgttgtaaaatgactcatctgcccctttctttcttttttgattattccagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggtagcctgattcttggcagtggctttctcttttccctttagtttctgggctcttttccggatgatccgtgtgctaggaagctggggagaagtcggaagcatttagatagagtttagtgaggtaattgtctgcagcttagctgaaggggtctgaaggaggtatgcagagaaattggttgtggcccttagaatgttctccagaggtagttccttcccagaccctgagacatatcaaagttgtccgaaagtggagccttgttattaatcccctctcaccacaccggttcctgcctgcctttatgccccacctggagacatccatttctccagacattgaacagggcagagaatagagcccatttgtatctgtttttcttggcatctttcaaagtacttggcacagaagagaaactcaggtgcattgtgtgatgcacaatgcctcccaaatatgtgtgatgtgatgcctcccaaatattattttactttttgagtgtggcaactgaaatgtcgaaaattacatatgtggttcgcattatcatttctgtcagacactgcacatctagcccccaaatcagaagacctagaacgaactgggagtcctctctcccatttgtccaaggtttgccttttcagttacaatttcctccttagaattttgtctgtcataatattctcccaaatattattttgggaggcatgacatatatgtatgacaatgctttttaaacttctaccaactttcccctaagaagcaagagaataccatatctctggcaatctaaggatataatccaaacaatttaccatgactgtaaaatttcttttcaatccacttttttttcccttgaaagttttgtagattttatattttactcttcagtattcctcttttttttttctgcattaatgttgtttttggggaaaaaaacaaaaaaacaaaacaaaacaaaacaaacaacttctaaaaactgaggcctctccacagaatagcccttttcagggttaattatttggttactttttactcacagtcactttttagctgccaggcttgcctttgttttctaaactcccatccgggttatttttttttcttttaacgacttcctgctatttaaccggtgtgtggctttgctagggctgcaatgacaaaataccacagtgtgggtgactttaacaaacaaaattaccttctcacagttctggaggctggaagtccaagatcagggtgttggcagggttgatttcattcttgatgcctctctccttggcttgtatatggccatcttctctccttgtctttacatggtcttcctctgtgtgtttgtgtcttaatctcgtcttctgataaggatgctagtcatatgggattaaagaccccctttatgacctcatttgagctcagttatgtctttaaatgttctgttttcaaataaagtcacattctaatgtactgtgaattaggaccttagcatataaattggggttgggtgacacaactcagtccataacaataaataatcacaaatgttttttctctcatggagagtaactactccctgatggaaaactatgactatgctttggtaaatgtaagctatgttatgattatgtgaaaaaagatctcttttctatcacagaaaagcctttggatcactgtgttcttgggggttgcaggtaagggggatccctgtagcctctgaaggtccttctgaggctttcattggacacttgaattttaatggagtggactttagactggtatatgggtttctgaggatcctgaaatactcatgttgtcattatttatgttctaatacaacttggtagaagttaaagcagattatagtggaaagagcattaggagaagacagagaaaccaggccatcacttccactctgccactacttagctggtgaccttaggcaagtcctgtccatgtctgagagctgtggtatctacgtccacataggaagagagttggcatacatgcttgatgagctcctttttttctttgataactgttcatctgttaacatttcccaacgggaagaagtcatcaggagctttctgtttaactatggtctccactgtgtatcttagtgcttcaatatcagttttactttttccttaattacttactacttgcctgtagatcttccacaaacttttctaatcttcttttacattataggagtagagctgcatgactattaagacctgcatatacctttaatgttatttatcaactttcagattgtcacctcttcagtttacttctctatcttccatgttcctaaagcaaatctagaattgaaattgtctggtaggagcactactaggtttcctgttttactgaggaaatgtcgaatctgagaatgaccttaaactgaaacatgtagaaccataggcctgaatgtctttaaggccataaagttagtttcgtctttcagtattttatttatattcttgccccaatactgttcaactttgggagctaaaaaaaagtcggttgaaccactgttcttcatattttttaaaatcagaaaatatatccttaaacttaaatttactttctataacttccacctatagaatctgtcttccacgtggcagatgttttgttatttgtaggtaggggtcatgcctaccactcccccttgccaccttctgagcgttgtcacaagtcatctttaacacccctccctccctctttgagagtgcataccccaccccttccactatatttagtctttattcataagtcattttggtaccagataagccaaataggtgttatgtgatgcctcccaaatgttatttagacaaaaatcacagaaatggctacacatagactccttatcccatcactgtaaaaaattagttgtttttattattgtatgttctttttcatgttttcctatatttagacacaagttttacatccattccatttatttaataacaaatatttatttagcagttactgaaagttaagacactgtactagatgcaatttatgtaataaaaaacataaatagcgttgtgggacttatattttacagaggataagcgtacgtatctataacataacaatctaattttgagctataacaaatttaataaaggaaatgtccaaggtgctcaataaatgacagatcaaatttagatatgaggtgggaaaagataacagagaaggcctgcatgtgaaatggagggggtgggggaagtaagccctccaggcagacggaacaacgtgtgtgaacattatagcaccaatgtaattccccagtcatcctaaggaattgttatgtgtttgtttttttccttcatgcctgattgtttgtatacattctcacaacaacttggaatgattgtaccacaggtttcttgataatattccatttgtcacattttcttctattgattttaatgttttccttgccgatatggctctggatgggccattttgactatttgctgtctctattcctccttttctatcgttctatcatgtgacaaaatatccagacataggattgctagggcaaaaacaaaggcgttttatgatcctgaaaacatagtttttcccaaaggttgcttataccattattgactctgcataaatatgccattcatgcctctgccttaccagcactgagcattattgagaatgttttaggtgttacatatatacacagttatattttgctgtgttgaacagcagaacaggggatatgttctgagaaatatttgttagctgatttttgtcattgtatgaccatcatagagtatagttacatgaacttggatggtagagcctactacacacctaggctatatggtatagtctgttactcctaggctaccaacctgtatagcaggttgtggtactgaatactgtaggcaattatcacacagtggtaaggatttgtgtacctaatctgtctaaatatagaaaagacacagttaacatacaatataaaagatgataaaaacggtacacctatgtagggcacttatcatggatagagcttgtaggactggaagttgttctgggagagtaggtgagtgagcagtgaatgaatgtgaaagcccaggacattactatacacttttatttgtctgacggtgcataggtttgtttataccagcatcaccaaaaacgtgaataatatgttgccctatgacattacaatgacgattacatcaataaacaatagaaattcttgagctctattaaaattttatgaaaccaccatcacatatgtaatccatcattaactgaaatgtcatcgtgtgacacatgactatttatatacactgacaaacacacacaggatcacatctgaaaatatactttagtacattaatagtagttaattaattgtgcctgtttttttattctgtgatgtcaattcgtgtaggaaatgcctccactaccattttatctcttacatgaacttacatgtataaatgatgtctccgtatgtagcctggcttcacttagttcatttgaatgtggttgctctatgaaatcaaatgcaaatactacccattcattgtatatttcttttttcaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatggtaaggaaaattagactacattttattctctctaatggcttataaaatgataatgcttatttgctgagttatatttataagcaaaggtgtttctcttcagattatctgatctattccgtaatagctttatggaagtatttcagcacgtcctcattttgtaccattttaaaggaagtggtgcacagtactttgtctcaggccactatttctgaaattattctaactagaataccaaaactaccttatttctgttaacttcatgtgaaatacattttaagaaatgctgcccacttctagttcctgcttagtgaagtcataagctgttaattcttgtggtgaatttcaattccttgattaatcagtactgcattttattatttatgtgtgtttttttctttgccctcatttgtgagcactgtccatctatggtcttttccacatccaagggatttggaaaatgtttcatcaaaatataaaagtgttggaaggtagcgcttgtagcagcagcatagcttttgtatcacttcaagtctccacatacaccaaagccgaaaccccacggccagaatttgcaacataactcagtgactagttatccataggaaccacctttgataaagttaactgagacaagccaccaacagcctaagcccatatgggatcagtgtttgtggggaaggaagcagatggaagtaacgtggtgtctgtcagacttgacaacaggagaacgccaaaagagccaacaggtactcactggaaagtgtgatgagccaacgtgagaccaggagctgaaattgggagaggttttgctctctaataaggggtagtgcaagagacctataagaagaagctctgaaggggtgggaaaagttgtagttcctcacaactctgaaatatgaccagccacgttgaggagaagctactgtgagtagaatcaaaagtaaactggatgaggacaatatataggaaggaaagagaaggactggtgaaaaatggatcaggagaacaaagccaggacgtcttaagaccaagacaccattgttttcaaaagatatcttggtgaagttagaaaatccttttctattttaaaattcagaaaaaactactatttcctaagtgagctaaatgacattttaaaatgatacaagctgtgaaagaataataagaattagaaatatccaaaaattatatatattatataactccatacaaacttagaagaaaataaatcattttagaaatgaagataatctaagaggaagatcacagaataaaaaacacaatagataataccttaagattagtagaaggtgaaagggagaaaaaattaaaattaaaaaaatgacaaatacaataagaaaattagaatggctgtaagaatatcagataaagtagacagtgaggattaccagagataaagatgacctttcataataataaaaggatcactttatcagcgaaacataaaaataacaaaagcttgtgtgcttaataacaatgcttcaaaaacatgcagcaaaatttggcagaactcccgagagaaataaaaaattccacaaacacaatttgttgtaaatttcaaaagctgaacattttaaattctgtctctgcttaagttgttaatgatacaatttgggagtcaacttgaagagtcttctgttggccaaagatgaacaatttgaaccgaaataatttgaacctaattgcaatggtttaaatcctatgaagtcagtttaaatttataagtttataatgacatttcacaaaatttaatgggttacatttggatgatgataggaaatcagtttattatcttgaaaactggtaaaggagaataatcaagtattcattctggttttcctagaagacatgtaacattgggtaatgaagtgttgtagagaagtgtgttttgtaaagtgtttctaatagtaaatgaaaatttaatgatccaattagaattatcatcaccttgcaactctcaatagattaataaatctaggcatctaagcatcaatgactgctaacatcacaagaggaaaaaccatcagacatgtttcttctgataaaagaagaaaatattacatattgattcatattaccaaattaattaaacctgagtcggattaagcctttggatcccactgtcattttgcaggagatatataaataacatagaaatacattgaactgcagcatgaatatgtcatccataaaatccagactatgtgaaactctatgggccagatgtgctgggtttttcaaaagataaattgtaagaaaaggaatgtcatgaagagggactgtatagattaaaagaaacatataagacatttaaaaagtagatagcactgtagcatctaagcatgcatatataggtgaaaagtatataaataaaaacaaggaagtgattttactataaaagtatagatagtgcctactttggagggtagtaaaggaggtgtgattgacatgggccgtgacgaaggccttcaggagggactggcaaagttcctggacctgactgatggttacaaaggcctttgctttataataactcattaactcttagatgtgttttgcatggtttttttgtatgtgctttattttacaataaaatgactaagagggatggagggagagagagaagaaaggtagaaaaggagtgaggaagagaaagagatgcagagactgatttaagagatttaaccaccaattgcaatgaatcaactttagttggatctttttcatttgaaaaaaactataaagcaaattatgaaaagatcagggaatttggaacatacaatactaatgttactaataaattattactttttaaacttgataatggtactgtagttatgcttgcagaaggagttttcttttttggagatactcaaatattgtttaaaataaaattatatgatgtctgtgatttgcctcaaaataatcttggggtgcagtgagtagctgtgcatgaaataagacatagtctcaattaatacttgttgaggctagtaaagatacaggagctcgttgtcctctctctgattataatttttcatggtaaaaaacctaaaagatggttaaaaaataatattaacagttttacatcaataagtgtaatataccttccagttaaaaaaaaaagtttatttaccgtgcaatctaggttttaatctcgaaccttatttgattttttagttttgttcccatacacatcctgccgttttctcatctccttttttcctcatgcatttcctctgcctagaatgtcctccctttagaacagaccaaattgtaccacctttattaattgttccttgttccctccagctggaaatcatatttctctcatgtattcctgtttatttatacctgtttcaatattatttttcacttctttatttttttagtcattcattcatgactacagatagtcctcgatttactatggtttgacttaagatttttcaacttgatcatgggtttattgggataaaacctcatggtatgtcaagtagcttcttatgatttatgatggggctatggtttctactgaatttttatcactttcacattatcataaagtggaaaaatcataaataaaaccgtcataagttggggaccgtctgctgtgttgtgagaattaaatgcatttttgacttaaccatatttttgacttatgataggtttgttggtatgtaactttcatcataagttaaggaatatctgtatactagctgaagattaactgtgatcagtgcaatatgccagggggttgagggaacaccataatgaataaaatatatgcccagagctgtgtagtcccaaatgacctcataatttaatacaaataactttgtaaatacaaagaatttctactcttatcaaaatgtaaacttctaagtttcataagagtgacaaggagaaaatactgttggttttaaggagagagagatatgtatcctagaagacagcatatttcttgagggcaaagctatgtaatgtcttactctgcatctccagatttctggttttcacgaaaggatgacatggtgctattaaccaaggtatgaagtaacagaggagaagcaggtttagggagtaagtaatgggttaggtaatgccatattaagttagttgctgatgtctgtgagacatctagctggcgggtggcagtgactagcaggtagtggttacgtgattatgagtctggagcttaggagaaaaatcagagctaaagacagaaaattgggtgcattcatgtgatagttgaagcacttaagaagactaaataaagtgagaagagaactgagctaatgccatactctggagatactattcatgggtaaatggagacataaattctgagaaggagacagaaaaagtcacagctgtaaaacaattaccatggccaatatccaaccatgcacaggtgactaaaaaaggcaaacaacatggccaatatggtgaaacccccatctctactaaaaatacaaaaactagccgggcatggtggcgcacacctgtagtcccagctactccggaggctgaggcaggagaatagcttgaacctacaaggtggaggttgcagtgagctgagatcgtgccactgcactccagcctgggcaatggagggagactccatttcaaaaaaaaaaagacaacaaccagtcatgttttctcttatttgattaagaagattgctaataatttctgatatattgcttcctgttcctctacctttgggtaatcaactgacacctttaatcctaagacttctgccatcttggaaacaaaacaaaggttcttggtcactgcatcctcctgtctctgtacagcagtgctaactttgccttctattttctgccttttacaatcatccccaagcatctacccggatgtcttggtccttcttcagcaattcttttttagttgttaccaacagaggttcctacatctgttggttcctacctctatggatctatcttttaatcctcatagacttatttgcattactaaaagagacatggtaaagatgttctcttttagtaatgcaactaagtctatgaggattaaaagatagatccataataataagtttcaggaaatttgctttcccgttatctgaaagatgaaagctgctaatcttaagaaagaaagaggaaactaatatttcttacatttcagtaatcacacggcagcgtgctgtgtgctttatgttcatatgtaacaccagctctgcaagggagataccatattttgacagattaggaaatggcgattcagagagataaacaataacagctaacatttactgaacacacgtattgttccaaacgcttgattttacttaattctgtcaacatccttatgaaataggctgtcatgttttccccatgttatcgttgaggaaccaaggtatagcgtggttgagaaatatttccaaggccacagaactaggagctaagattctaacctatgtaatgtaatgtgtcaggaaaccacacttttacactttcatatataatttactcaaaacaatgcagctactgatgggagagtctgggatttcaggccagttctgtgtgattacaaaaactctactctctagaactgatgtaaggagggtggtccagcctttacttttggagcttaggacattttggaagggcagggtgatctttgaacacatactggggtgtggactggaccgtgggacgtaggtgaacctgtggatagagggccctgagaaatcggaggcatctcagacaaactgagattacaggaaacagaaaaccaaatgtttacatttcagaattgctgaagaaatgggataggattggattgtcctcctccacatgccttctctttctcctctttttttttttctgcatggcggaaaaaaattctgccatgaattcacaattctctaattcaacattaggtattctagtttaactcctgtgagttaaactgatgttcagcaaatatttgttgaataagccaggttttgtaactagtctggaaagcaaaccatagtttgtaagtgatttacagaatttcaaacagctggcttataaaacaaattctgaaatataccatgtgtataaatgggagactgccttgtttattcacataggaacctccaaacatatagaagtaaagacacaggtaatgcagtccttttgttgttgcttttgttactgatgagattaatttagagtctttggcaggccatcctaactttcatattactgtattaattctcttccttatagtttgatatttaaaactttatcttttagagatgcttataaaagcatagacaattttctcaccgaggatcaaaagaaccattttattgggtgttttgtagattacatttatgacagctgctgaactactctcacctgctatttatcagaatagataatgacttttctattatctttgtggttgtaactttccacaaagctagttttccttgtagccacagtgattactaaaattgatatattacctccacttttcatttttattgtggtcaagcattttttataactatctcttagaaaataggaaaatatttgctcttccagactaagtgctattaggaaagaacatttctgaaaacgtgcctggcttggccttcttgttggcatagagatattgttgagaagttagttcaaggtctgtgtagtaagccttattttttaaatgcctgcttctatttgatttgacaacatagattggttctttaactcttttctttacctacacttcctatatagtgattggattttcaacctttagtgtgagagagtatgtaccatattttctttcagagctatacacatataattctatatgtgtacatatatgcatatacagataacatttgacgtaaggtttagggcctctgaggactcaagattcatgacttaaacacaaagccaaattcaaatagctatgaagtcttgaagccacttcaggccatataaatcacctactctgtacttcgatagcacttcattcatatcttgtctttattattctagagattttctcttttttctgtagtaagtagtgaccactcttttcctgtctctttctctttcccttcaataccaagcacacagcataaaactgagctaactatattgtacttagaaattgattaaataattgaatgaattagcctgccctgtaaaattccagagaataagcaccatttgtggtttttttttttctggcaattgtatagccagctcctaacccagtgcctggcccataggagggactttgtaaatatttgttgtgtaatcattgcatgacttaattctgttaattggaagtgactagtttatctaactcttctaagacttcatagcaaagtatgtgttttataccaactttatcttgaatgcaaaaacttcagtagatactactaacagttcaaaccttgtatctcaattaaactctttgtatctttacatctactttccctttccatcctacaacccaccatccaatgtcttatattccaaatactcatcagcacttatacactcgatgagccctcagctccatgccttttgggtcttggcttctctcattcatacctttgatcaggcaacactaacgtgtcgagcatttaccaagcaccaagtattgagcaagtttccgaccacgcagatatggaacttaaaaaccccactgtccctcatacaagttaattttccaaaggaggaactctgcatgaaaacagagcattataataatgtagtttaagtactaacagtcagggaaaaaaattaagacaatacaggtgagttcttcacgctttttcctgtgcctgaagtgtctacttcccatgtctaccttcttcctcaacagatgttaatattcttatcatttaagaaccagcccaaatctttcttcattaagtttttctaagttgttttgtttttatttcatactcccttgaccctaaatgccttttattgtgtttgttgcaatccttcattagaccatgaataactataagttagaattgtatcatttccattttggtgccttcacacagttctttacacattgttggtttcttgaatggaaacacttgttcttacttcatcatgacattcctccactgcacccttcccctccccacatgattcgtttcagttgaaagatcccaaagtcatttcttgtgttgttctttacctatatgttgtggtcggttgccacagcaaccatagcatggttgaaaaatcgctcttctatttaacttctctcttttgaattcagaatgaggaactaatgggtcaactaggattgtttgtcttctagtcagacaagtgtttgctttattgtggaaattcacttactgttcactcatttcttatattttaaagcaagtttcctattcttggagaatctaaatctttttttatgtttgttttcttctggattccaaataaatggttttgaaatcattataacattttcaggttttatttttatcaacagtttattatgtttaaaattatcctatgtgtctcaggtacatgtgttgtgaagggtctagagacagagttgctgataagaaagagagagctaaccagacacacagcaggttaatgttcatagacatttgtagtgtaacaatgccctgaattaccctcacacacgtattagaatgtaaaatattccctttatttctaaaatgttttaggcctaatagctttgaaacagctataaaaagtttctttcatcacattcttaaggaaatactgttgacaagttcagtaaaaataattgacttctcatcctcaaaagtgtgcttcctcagtttaccactgattgcaggaattagcctgttttaagtgatagagccacatcacgcttttcactcaggctggctccagggatggcacaggttcagggctgctatatggaatgaagagacactatcaggtgaaattaaaagcaaggactttgaaacaagtagatctgaattcaaattccagctttaacactgtctggtggtatgacattgacagttacttaacgtttctaggccttgttcattcatctataaaacggaggtaaaagcattacaaactttacatgtttggaataaggatcagacgagacagagtatatgttaagtgcatgtctcagtataattttttatagcctcaactcactgctgaggagaggtattcattcttagttaagaagctgatgaaagaccgttattcggctttctggaaaactgaatttcagctctctactgtgttatctagaatatctctgtctcattttttccgtctataaaattacagcgtatttagtctgatctgtctacttcacaggagtttcagaatagctaagctaacaaatgagggggaaatacctttgaactgtttaaatgaaaagtaccacaaaaataaaatagttctattgatactgtaaactcaattcaaaccaaatctgacataaacttataagaatacaggcctttgagaccttatcctttgtgatatcctaaggatattgaaatcgtttgctgacctgacaagtgtctacaagtattgcttatcttacaggagaagctgcgttgaaaaaaatacgttacccaagcttatagtagcttcctcttgatgatcttttccatgaaatggaagttcaatgctgttcttaaaatacacatttcctgtgacaaagcattacaaaatgtgcctcaatgtaactgtcatatttcaaagtacatgctccaggaattgaagaaaaccttaatcatacaaacattaaagatgaaatatgtgaataaaaaaaattgaagttacaagctagtagtagactcccagaaatttaaagatgtaaaaagccttagagataacctaatctttttgtcataggtgacttattgatatttaaaagaaaaacaaaagcttttctaaaagtaaatgttcaacatatatttttgtcacagatagtgtattgattttttttctcaaaaacagcaaaaagtaataatttagccaaatagtgagactgagaatttgaaacaggattctagatatgttgaatgagatagttgtggactgagatagttcaatttctcaattttaaatgtcaacagttatatgcaaatgtgaattaggagcagaaatacattcctagatcttgatcaggcccatgaagatattttatttttagtttctgaaatctgtgatactcagttataaaaatgggataaagttggtggctcatgcctgtaatgctaacactttgggaggcccaggcaggcggatcacgaggtcaggagttcaagaccagcctggacaggatggtgtaaccccatctgtaccaaaattacaaaaattagccaggcatggtggcgcgcacctgtactcccagcttctcaggagactgaggcaggagaagtgcttgaacccagaagactgaggttgcaatgagctgagatcacgccactgcactccagcctgggtcacagactgatgagaccctatctcaaaaaaaaaaaaaagtaataaaagaaaaatgcaaaacagtttggaaatatctgatacagggaaacaacagggtgattaaaaatgccaatcagacatctaaattggggcctagattatcagacggagtgactggagtcccaaattaatataatcagtgaagaaatattataaaaagaaaaagaattgctttctaaatagcaggtcttgcagttgctcaagtttccttagtcattatttcaaaactgtaactttgctttactatcaacataggatgcccagaatttgatcctgagacaggaagcctgtgtttttgaagtcacactttagtttagaattttaatttctcatgatcagaaaagataatgacaggtgtttcatttattcttcgcagaaatcttgtcaaatacttgaccaaaatagttttataaaaactgcagcatgaatatttcggtgttctgtgcaaaattagatgtgagtgtgcgtgtgtttgtatgttttctatgcatgtatctaaaaagtaaacttttttttttttttactttttctagggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggtaagcatgattagtgtccagtacacacaacaagcatgtgatcatcttgttatggtttttaatagtttattacacactagtatgtaaattgtataagaaaagtgattcatgttttttgtttacagtactgtctctagagccttcaacaattccatgcacatcgtaagcattcagtaactgttggtcaactgaatgaatatgtgaataaatgaatgaagtaaaggtagtttggggagggaaaggagcaccagacagatctgtgttcaaattctgtcactgccacttattagaaacatgacgttgaacaaggtccctgtctttatctgtactctggaactgcaattgattgagaatatttaaaaaaatattcatattgtattaatgcagtttcaggcaagcaatagagactcagtgcaacacttttgtcaaaagaatgttttacttggattaagtaaactctatttttctacatactgaaactgctgtacctattgctgaaggtatttgctggcaataatgttcaaccattattttgcactaagagaatagggggtgagaaactaggaaagtgggaaaggcaattcttagacagagttgacaaactcctagcaaacccagaaatagagaagtagtgtcaggatatatggcttttggggattacccctaaataccactgtgtccagtgtattaaaaaagatagcatctctgggtattgttttgtcataccccatcttttaatagatggaaacattaggctcactgacaagaagtaacctgtttagagacactcagtgagttacttgaagaagtaattctagatcccaggtctctgctcagggctttttctactggtctgacatgatttagtataagttagctacaaacagcctttcatatagtgcaaatagtattcaaacaatgtcgtaatcacttctgttctttttctgcttactttctaaataatgctgagttggggattaattcataagaaaaaaacagactaaattttaaaagtcaaatgaataatgtaaccttatattcatcttagcagttgtttctaatatatgtgcttaaaagtatgcattttggggaagttgggaataagcatactttgtcactctgattaacagatttaaaaattcacagacagatctgggcactgggggcttctttctcaaatttcaagcaacacaagtttgttgttttaaagctgcaaagtgttgagtatttattatatgccagtagcatatccttaatatatattccttagtttatttctcatagtgaaactgcgatatgagttttaattatcctcattttagagttatgaaaaattagcttttcaaaaattaggaaaaaccaagtaactttgcttttgcatttttatatggttaatatatggccaaatcaggattagaacttggttattaaatctttggagctcatacttttgaagacaatactaaaaactctactcaatgtattatttttaaaaaattaggagtactgaatattataaagagcagcaatctcataaacaaacattcaactggtaactagtcatcaagtagactaatgtgccggccttaacatcatgattgtgaattttccattgatttactcattaatgtaatacttatttaaccagcttccatactagacactttcggtaatgttgtgaagaaatacagagagaagaaacaactgactaaggcatgaaagcaattaggtattatgcaacataagacatctatctcatgtaagctttggaaagctttgctaagcaatccgaccttaagcatggagggtatttagtatgttttatttttttctttgtaaagcaaaaactatttttttctatgctcaaaacacttttgtcactaaatgtgtggctcttctatacaaagtaattctcaccttttctgaggacattaactgcatgtcctaaagtttaattcaatttgacaccagttatccagagttagcactgaccccacaggtgaaggactccttcctaaaagactgccccaccccctactttagattccagtcacaagcaataggttcccgcgttacccacaactctgcctgagttggctacaaacttaagattcctactacttcttcctcaggttctgtgatttggtataactgctcacaaaactcaggaaaaccttttacttacccttactttgttattatagaaaatattataaaggattcaaatgaacatccagctgaagagatacatagggggagttctggaagggtcctgagttcagagctccaccctctcagcttgtggatgtccttaccaacctagaagctctccgaacctcattgtttagggtttttatggaggttccgtcacacaggcattattgagtaaaaggactggaaatttcagccacactcccaaacttccagggatgggtgagaggctggagattgtgttaatcatctatggtctttctggctactagcgctcatccagaagctatataggaaccctagccaccaatcatttcattagcatataaaatccactcgttactccagagattccaaaggtcttagaagctgttgtgttaggaatttgggactagaacaatattaaaacaatagatgctcctattacccctgtcacacaggaaatcacaggggatttaggagcccatgtcaggaactgggagcagtcatcaaacctgtatttcctttattttatgctttgcttgttttaaatgactgaagtgcagtaattgagtatatcttggactataggccttctctaaaacaactgacaaactatgccaggaagttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagacgactgttgtagagaaacacatgaattgaaactgaaatgtcagaaaccaaagcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaagactgtgaatataatagctaacaactgataaaactagtagacattgacgcagaacactattgaatgcttactgtggctcttcggttcttcttttagtttccataatttttcattatagccaaaaatcattgataactgaccaaatacgggataacatgttactcttttgactcaaagcctcccacagttaagtgaacaggaaactatagaaaattttaacattttctatgttgtatcacttacaatacatccagtccaaacccagtgagaggtgttaacctaaataacaacaaagacaatagctctccaaaaagaaaaggatttattcaggaatgaattgcagatagcaatccaggaatatgagtgctatggcatcccatgcgggaaccatagccatacccagaaagcataggaacataacagttttgaaaggcaaagtgaggaagattacataaagttgttctgaaataattatccttggttataagaaccaataacagggtaacatccgtccaggcttgactggcatttggtggtcagacctcctcacagaaatattatttgtttaagaatcgcgctggcctttgtgcaagatagtggtgctcagagtctttgtactagtttttataataggcatgtgtgtgtgagggccctttttatatgacctcccaactgtttttctttggagtgtgacacgagtgactccattttgactctgacagctttcacagaggtataaaagagcatctgtttaaaatgtgctaaagataatagtcagttgttaatgggtgaaagcaacggagaggatgccattcaataaaaaaaaaaggtggaaaaagaggtatgtagttgttcatggaaagctgacaaacacaggaactgtcaaaatgcatcctccacttgacacacctcttgtttcaggcagtgcctgttttgtggtcagtggggagtatgtaggatatgtatcagagaatgaaaaaaattaaaaagtttatggagtgggtgcaagacacatacagccctgatgcgtatctctgggccctatctaaagggtccctgaagtcttcagctcactttccttaagccataagtacaacttgtcggacatgcacgcagttgccaggcgggtcaagtggcagtaacttgagggtgatgtttccgagggtgctccctacccacactgcagcggggtcctcgtgtgctcgcggtgcatttttgcagctggcgacttgaactgggttgtgcacaagcaccattggtttgccaataagtttaacctggatgtggaacatagatgtggacctcttcgccatccagtgtttgggtgagcaccggaggcataaagctttatagaccttaaaacactgaccattataggcaatcttagggtgcattttgtgcatccttcttattatttctatttagttcctcttgccaataagcatcagaaaaattgtatggagtcctctttggggtagggatgctaagtcttcatgcagaaaagctgcatggtttctgcagagcacaattggctagaaaggctgtaacattaaatgtttatctagaattaacatgagtaggagtaaaagtggctgtggcatcagggcgggcagcaaagcattctggagcgagggggctagggtgactggggaagaggctgatgaaaaaaataaatcaattaaaagagttcagggacttaacaaaatgagatttgacctgtgccaaaactattttgagaattttaaatatgacatttttcctggtatgaataaatttatagcaacaaacaataataaagatacaattgatcttgtatgttatgtatgttgacagagaaatttgattttgctctaaaaaagataatagtgatcaacatagatggagaacaatgccaaaaaaaatcaagataagtttgaaaatatgacttgctttgtgaaacacagagaacatggtaagaggctgaatttcctagaattaggtatggctttatatagtcatatgaatactcttcctgctgtcagggtaaacccttattaataacataaatatatttgtctacctgtcaaactatgctgacagaaggattgttgaatccgtgttccctttatctttcttagtgacatacagatagggaaaactggagggaaaagacttaaggacgttgcaatgggagggtagatagagtatggccacgcagtcaggtaagcctaagttcaaattagggtgacgatataatttatcatctaaaccaggacactttctgtgagtaaacatagccactacctattaatataggtaaccaggaaagcaggcataaaacagaactgttctgggcaaactgggatggaaggtcagtctaggtcaaatcctggcccttcacttattactgatttaacttaggaatatcatttagcatccttaagcttcaccttttacatttgggaaacatagattttaaaaaataccttatggtgcttttgtaagattaaataagaccattaataaatataaatatttagcataataacttgtacaaagttcttagtaagtatgttgctactgctgctgttactactgttttctgcctagggatctccctaacctcatgttccatctcagagggatagcatagagttttctatttttaagttatcttaaaatttattgaatgcaccctgataggtggagcatttcaaggtgggcctcctcagccagatctctctgtgatggtatttccccatctttcctggccaaggactgaagatatggagaacctgtcctcagtcacccttcttgaggaaaataacaaaggagaagagcagtctctggaggtctagggctaaaaagaatattgtcagagacctttttttttttttttttttttttggagatggagtctcactctgttgcccaggctggagtgcagtggcacagtcttggctcactgcaacctccacctcctgagttcaagcaattctcctacctcagccccccaagtagctgggattacaggcggtgccaccatgcccggctaatttttgtatttttagtagagacggggtttcaccatgttggccaggctggtcttgaactcctcacctcaagtgatccacctgcctcggcctcccaaagtgctgggattacaggtgtgagccactatgcctagccttgtcagagactttttaaacaaatatcatcattttagaatttatttagattacattaaaaatggtcactctggtaattttatacaaagttgatggccttctttatttggtttcgcttgtttgttttggaatgaagtatggtgcattaccttatgggagtcgactagagaattactcataagcagggtttcaggtacacataactcgtagcttctgattagccagagagtagaaccaatatagccatgtgaaggataaacactaatgggctaactttgtctttgttttttgttttgttttgttttgttttgttttgttttttgttttttttgtttttttggttttttttttcaggagaggagctactcattccctgtacggtctattttagttttctgatggattctcgcaatgaggtttggtggaccattgatggaaaaaaacctgatgacatcactattgatgtcaccattaacgaaaggtatcatgggggccagcaagggagtgattaacctttgtttctcaacttaatgatctctgatgtgtgttctagtcaatgaaaataaaaattctcatttttccctatcactaacaaaaatcggcaagattttcaaatctttggtgattgcatcccaaaccagggttactgggctagcaatgcaaggaatagatgctgcctgatgaccagtggagagctgaattagaatgttctgaggctgagcatcttcatcagattgtccagaggacatgcaccctattgtcttaagcccagcaagattcacacatttatgatacccacatggaagtagagagaatacatatcttacatgaataaaaaggtcacaatcaagggttgtgggtacgtggaaacctacagtgtagttgtgttttttccttttctcaatcctagtgtctggccctatgtatttgtgccttaggtaattgtgttttgtttttttttgcattgcagtgagcatgcattttctctctcctcctctttcttatctcatataacctatagttacatttataattagtaatttttaatattaactaaatacgtttgtgtaatttaaattttattttaaaggtagatgggtagtaatataactcacttttaaaataaaataacattttattcctaaataaacctgattttttaaagcgttggcaaagtggaaagtgtgcgtccttgaagacagaaggttccactgcaaatgaagcataccattaccgaacagcagttggctcactgcaccaattaaaaatttgcagctggtcagctatatgacaaagtaatgtagctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcgttaagcttaagcaaaaccaatcagagcccttaaccaaattctcatacctgacagtaagcctagttaaaaagagaacctagatggcagtcagctgtagcagagagatttttctctgcgataagtaaaggagttcaaaggaattttaaattctgatcttggacccaaaacacttgatctctgattcactgagagttggatatatttatttttacaaagtttacgtgttcataacagctttctctttttatatgttaggatttaaccatgagatttcagatttctgaccacagtattctagctgtgttcggaatccatgctttgggaatcactgaaatgcatcagctattcctatgggataacagtaatacctacatgaatatttattaagcattattctaatattcatgccttagcatattcagtcctcagaattcctgaataaattaatgcatgtaatgcactgtgtgggcattatgacttccctcttttccaaaagaggaacctgagacctggaaagattagttatctcacccaaagtatatagccaggaattgacaaatcctggataaaaacccaaaaggacctggccccagaagcttctctctaaactgatacagcatcctggctcagaagtttaagcaaaagagacattttgttttgaagagagatctataaaaagaagccagtattgggatttggtctagacaatgggatagtgtgtagcgtagatggtatagtatagtgttagaatcttaccattaatactttgtaatcactgcattataggtggctcagcttatcaaccttcctcgccctcacctgtagtgggggtctgtggttgcttacttgtctgattcctacacagtccatagctcttgagtcactctcaaatgctttgattttcttctctctatttctagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaatcagactgtgtctaaaactttctttgtgtctctcacctaacacagaatcccagaaaatcccttcaaggatgttttcaatggtcttgagaaaagtaatgatgagttatcacacatgaaatcatgaaatcaggtcattcagaatcctcctggctcctagtctatagagtgtgtaatatttcttcaaaagtgaataacatagcacataattgttacattttacagagacttaatgcttttttaaagctgatgaaaaacaggattcacctcaaactttcattacaactttaaaactaaatagcaaaggcctgaaatgtatatgctgcgtatgaagtactagtgaatcagttcagggtaattcattgcttctgctcctcagaagccagtgtgaaaaggaaagactgaagtacatgatgtaaggcagtttcccaaattgagttctcgggaacactactaagaatcagtattgtcctgcaatgcattattgtactctagaatcagagcacctgtgttgaaattctggtttctgcacatcctaactctgtgaaaagtaaatctctctgagccttaatttccttatatttaaagtagacacaataataccactaccttataaggttgttttaaagtgctcagcacagttattggcatatatacctatatatgaaatgctcaataaatatgaactcattatttccttaagattttcataggtgttatttgacaaaggcttttatcatcaaataagtatcatttatgtctggattttaaaaaatcaatcaagttactttagttaggacccattcaagtatttaatatgtgaacatttgatgggaatatctgcgggaagttggattatagtggcaggatgttttcatatgtatttgactccagatttcttaagtatggagctttttgtggggatcatcttctgagggatgtatcctggggaataattatggaaggtgacataaattaataacttattgtcaaatgaataggatcagaacaatcaaagcaaggtgtaatgtaggagtgaagcacaagtttgcctcccagagcgaccagagtagctccccttttacagaagcccctgctctaaatggtgtaataaggacagtgtcaggaatgtgaagtgacaggtggatcctctagactagatgatctgtgctgaaagctgatataaaatcactgtttggtcacacctgtgtatttccggtggtaccagaggagttgtggttttcttcacttggcttctattctgggccagctaatgctgaaattcagaggttatatctgagttcacattcatacattacatgtatgggactactctaaatttattagcaaagcattatatgaacttcctcaaaaggacatcaagaaaagactaaggcctggaatgagagaaagacactggtgtaggtcttattgacagcaaaatttcattatagtcagttaaagctaagtattaaagaggaggcagttgttttatttatattttatgtatttatttttatttattttttatttttgagacacagttttactcttgtcacctaggctgaagtgcagtggcatgatctcggctcactgcaaccactgcctcctgggttcaagtgattctcctgcctcagcctcccaagtagctgggactacacaggcatgtgccaccacgcctggctaatttttgtatttttgctagagacaggatttcaccatgttggccaggctggtctcaaactcctgacctcaggtgatcctcctgcctcagcctcccaaagtgctgggattacaggtgtgagccaccacgcccagctcattgttttataataacagcatgaaaaggactaaggcaaggtatctgtttaactttgtgagaaactgccaaacctgtttccaaagagattgtaccattttacctgtcctctagcaatgttcacaaattccaggcgctctatttcctcaccaatttttggagctgtcaaactttcaaattttagccatactgatggatgcatagttttattacattgtgctttaaatttgcatttattggatactaatgatgttggacaatttttcatagccttatttgtcattagctaatatatctttttgtgaagtatctgttaaaatgtttagctcatttttgttactggtcatttgtttttaaatttaatgtatgttaggatatagacacagacgcatatatatctcaaataaaagtcctgtgtcagatatatgaattgttaatattatcacccagtttgtgaattcattttcttttaaacagaatctttaaaactttgatggcatttattgtatcaatttattctatgcttagtggtttctaaattcagtattagcaatctttgcctaaagttagaaaggtattcaggttagaaaggtatccttctgtgttttcttctggaagactggtagatttttcttttagagttaggcctatgatccatttttttaatactctgaggtactgggttaatgtttagtgttttgtttttccacatagataaccagttgttctcatatcatattgaaaaatctttcctttgtttgttgaattgttcagaaaagagcccaaaaaattaattctatgaatatagatctatttctgcattccctgctctgttcatctgtttatctatctttagtccaatgccactttatcctggttaacatagttttaaaatttaaagtaagtcatgaaatcacatactatatgtcttcccccttttttctttttgaagattgattcaactattttaggaaccatatattttttttcgtatagatcatagtatcagtttgtccatttctacataaaggcctgatgatattttgattgtatttaatttataaatcagtctggagaaaattgaaatcttaacaatactgtattttccagtccatggatataatatatctctccatttatttagatcttaacttttttcagcattttttcttttagatttgagtgtacaggccttgcatatatattgttaaatgtatgcctaaatattttgtttttgatgctattgtaatagtacttttatttaaatttatttttgagacagagtctcactgtcacttaggctgcagtgcagtggcgtgatctcggctcactgcaatctccacctcctgagttcaagcaattctcctgcctcagcctccagagtagctgcgattacaggtccccactaccatacccggctaatttttatagttttagtagagacggggtttctccatgttggccaggcttgtctcaaactcctgacctcagatgatccaccctcctcagcctccctcccaaagtgctgggattatagtcgtgagccaccatgcccggcctgtaatagtactttttaaattttcattttccagttgttcattgaaaatgcaattaattgatttgtatatattgatcttgaccttttgaactttagggtggggtttgtttgtttagtttgttaggattttccatatgcttgattgtgtcacccatcatcaaacagatttttacttcttcctttctaaatttcataactttaataactttttactgtccgtttcactcttttggacctccagtacaatgttctgtagaagttttgagagcagccatctttgcattgtttccaaatttagagggcaagccttcaggtttttatatacaggatttttttgtagatgacctttattttcatgagcaattttttcattttcagtttgccgagaatttttttgtgtgagtatgttgagttttgttgaatacttaactggatctattgagagaattatatgtttttatttttaatctgtcagtgtgatgatttatacttactgattttgaaatgttcatccaattttgcatgtccagaataaaccctcatattgtcatgatttattgtcctttttatatattactggatttgatttactaatattttgtcacagatttttgttcatgttaagaatttttttttttttttttttgagacagagtttccctcttgttgcccaggctggagtacagtggcgcgatctcggctcagtgcaacctccacctcctgggttcaaatgattctcctgcctcagcctcctgagtagctgggattagaggcacccgccaccataccagcgaattttttttttcttttcagtagagattgggtttcaccaaattttgttcatatctttgttcatgaaggatattggtttgtttggtttgtagtattcttttcttgtaatgctgtgactaatgtgagggttatgctggtctcattacatgagctgggtaatgttccctcttttgtgattatgtgaaagcctatgggtaaaactggtattatttcttgctcaaaagaattactcatataactatctgggcctgttgtgtttttttttttgttgttgttttttttgagaaggagtctcgctctttcgcccaggctggagtgcagtggcgcgatctcggctcactgcaagctcggcctcccgggttcacgccattctcctgcctcagcctcccgagtagctgggactacaggcgtccgcctccacggccggctaattttttgtattttcagtagagacggggtttcactgtgttaaccaggatggtctcgatctcctgaccttgtgatccgcccgcctaggcctcccaaagtgctgggattacaggcgtgagccaccgtgcccggccgttgttttctttttgggaaagcttttaattatgaattcagtgtcctttttagttattgagattttctgtttcttcttgtggcagttttggctttcaaggcatttttttccatttcatctaagttgtcacattattggcatacttttctttagattatttcctattatccttttaatgtctgcaggatttttagtgatgttccactgtcactcctgatattagtaattggtgttttgcctttttttgtccttcatcagtcaagataagggtttctcaattttgctaattttttcaatgaacatatttttattgatttttctctgttgtttatatatttatttactttattcatatacttattttcctctttttgcatactttgcacttcattttctttttgtcagtcatcctaaaatgtaagctgtatcactgatttttaagtaattcttcttttccaatataagtattctgagctatgtgttttcctcataggattagtttaactaaatccaacaaatgttgaaatgtcgagtttttgttattattaagttcaaaatactttctaatttctgttttcatttctttttgacctaagggttatttcagtgtgtgttttttaatttaaacatgcttggaattttccagatcgttttactacattatatatgaaaattcatttgaattttagagttggctttatgttcactcttgatagttatttgtaacatttcatattgtcatttaagtttagctaatgtaaaaaattagaaaaaaagtctgggagcaggtatctccaacttagaactacctgagagaactacattacggagtggagaaacataggtttttgttctagatagacctgggttcaagttccggactcagtgctggctgtgtatatgaactagtacaagccttccttttcttatccttcaggttcaatttccagggtatctgtgaaaaccgagggaatggggaatgagagctttgccacagtgctgcacacttgattctaatttctaatcttttatttaattctgatgtgtccaaagaacatactttgcatgattttattctttttaagcttattggtacttaaaaaaaaagtatttgcagactgcctatcttggtaaatgtttgatatgcatttgaaaaagacatatattttgtagtttcgagtggtgtccagtaaatgtcaactaagaaaattggtgtcagtgttgttcatgtcttcaatatccttctgatttttccaatatactttgttattcagttattaaaagagagaatggtgttgaaatctttacatataatatggatttttccaattctctcttcagttctgccagtatttgtctcatgtattttggaactgtgatatttaatacatgcttatttaggattgacaagtctttttcatgaattgactcttaaattgtgaaatgtccgttttttctctgttaatactctgtgtctaatatgaatgtagccattccagctttctttttttttacttttttaattaattaatttttttttggtagagggacggagtcttgctctgtcgcccaggctggagtgcagtggtgcgatctcagctcactgcaagctttcttataattagtatatgttttttccattattttattttacctatcagcatctttatgcttttatacttatactttatacttaatgtatgtatcttatttacagcatattattgggtattggatccaatctgatcatttctggcttttaacttgaatgtttaatccatttttctttaattattaatatgactgcctttaagtttaccatcttgctatttgttgtccacctgtctttatttttatctcctctagactaattggtattttcattgtattttattttatcacttttttgagcttttggctcttcctttttgtttggggcttgttttgttttgtttcctctagagtttataatatttttcctaaacttatcagttgatcttgaattaatcactttacatattttatgagaaacttactatggcgtatttccatttcttccctcccatcctttgtgttgtgctataatacattttggttttgcatgaattacagtgtaccaacatgtattgtgaaagtttggctttaaataactgtcttctattaagttaagaactgatctttttttaaatttatttgcttattttttatttctgacactatccattcttggtaacattttaatctgaagaactatttaatgtttctggtacatctgctggtgacaaattctctcagctttgttttaatctgaaaatgtcctatttcattttaatttttatatttcaaaactttactaagaaagttttcaaatatatggaagattttaaggaattacacagtgagcagtaatacagcctacctagatcctaccattaacattggttatctttgctttatcacatgtctattcattcttctgccagtatatcaatccatcttattttctgatacatttcaaagtagatgcagacatcagtaaacatttaagctccttatcattatcagtgttttaatatttatttgtaggtttcttttctaggtaaaatttgcataaagtaacaaattgcataattcaagtgtaccatttgataatttttgagaaatgcatatatatatgcattacctaatatcctattaagatatagaatattaccatcaccagaaagtaacattcttccccttatcagtcaatcctttctacccccaccttccccacctccccaaacaatacaactgtttttatttccttttttagaatagttttttttttatatattctagaactctgcgtatgtggacccatacagaatgcgctactgtataactgtaccttcactcagcaaatgttcttgatattcacccatgctgttgtgtgtatcaggcattttctccttttgtttgccatggagtggttttgttttgtttttgttttgtttaagaatgcagaatgatttgtttattcattctctgggtggtgaacatttgggttgttatcagttttggggtcttttgaataaagcttctgtgaactttcttatccaagtttcttaatggactaccgcttttacttctctgagatgaatacctatgagtggaattactgacttagttttatcagaaactgttagacctttttttttccccaagtggctgtatcattccatattccaccatcaacatatttacatcttaaggatttggtgttgtcagccttactttgttttagcaattataggtgagtgtatggtggtatcttactgtagtttaattcttcatttccctgatgtctcaaaatactgagcacttacacctcatgtgcttattggccatctgtatgtattttttgatgtgactgttcaaacattttgttcattttataaatagtttgtattttattattgaatcttagctgttcttcatctgtcctggataccagtcctttgtcagacacatgttttgcaaatacttttccccagtctgttgcatgacaatttgttttttcgtgaagtgttttaatgagcagaggttctcattttttatgagatgtaatttattaacttcttctttaatgattattaatttctgtgttctaagaaagctttgcttacccatagtcaggaaggttcacctttgtttaggcctatagtccatctcttttcttttttttcatgaatggtgtgtagtagaaattgaagttcagttttcctttcataccgatatccagttgttccagcacaattaattggaaagatttttactttctcattatgtttctctggtgcctttgtcaatattttcacaggatatgttgaaagtgtatctatttcttttctttcagccctttaaggtattccattgtctcctggctaatattatttaaaatgcaaacggggcagtttttgttgctgctgttgttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctcactctttctcttcttttagtactccagttgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgtatcttttagcttttgaatttccatatcttcattgaaaggtccctattgatattttctatttgctgttcacagtgttcatggttttaaaaaaattgaacaaatacacatagaatactcatttttaggtgtttatctgataattccaccacttttgtcaatttttgttctgttttgattagctatctttttattagctaatatagacttttttgcttttttatatagctttttaaaaattatatgctggatattatggatgttacaattttgagttctgaatttcgtaagacagtgttaaattttgttctagcgggtaattaaattacttgcataactgcttgcttttaaaaaagcatcttatctttgttaaagcaggtctaaaatagccttttctgtaaggttagattggacctacttctaaagcatgtcatacctgaagtctctaattaatactggggagctaaacacagtctcttcactctgagtggcctgtaccaaatgtctcacagcccttcatgtgctcctagagttgatctgttcccagctattctttgcctaaccttttaaagtattcccccaaatatgtgtagctttgtatttggccgaagactcgagataatcctgtgcagatttctagagttccatctctaaatagttctcttctctataaatgcaatctgactcaacagcagccttgaactctcatttctatctctttagctcagtgtgaccactttctcattttggctttcccttctctgtgccacagtttaaaaggtgcctttaatcgaaaagccagagtgatcgtagcatttacctcttttttgtcttttctctcacagatcacattcctgtgttaccagttgtccaactttttacaaactgtattttagatatggaaggaaggctagtccaggactagttactcctttaagaacagaagctgaagtccaaagtgcacatgttttaacacactataatagccaaatcagtaacatctgcgagttaatttagtcataggtctctgatttatcataattttaataaagcattccctttgtttacaactcaggagaatggtcattaccacagttccaaaaattatccatcagtcccaataatttagaacggagtagccatgggttctgtggcagggaacacttggaggtgcaagcagctggcatttagttgggacatgcagtggatggcaaggctccaactgcaataataaagatgacggaaatcactcagatttcctagagaaacgtgattgtagagcaagaactcaaaacagggaaaatgccaagagctaaccaaggtggttacctggaaatttgggctttgaagccagttatttacattgaactacaaaagggatggaaaaaatactgatttaaggactaacaaccatcaaggagctaaatctggctacatcctgaatcagaatattagtaaaatcaatgagagaagtttaggagtccagtttggtcgtactacatcatgtctttctgataggaaattctttttttatttttatttttatttttttgagacagagttttgctcttgttgccaaggctggagtgcaatggtgcaatcttggctcactgcaacctccgcctcccaggttcaagcgattctcctgcctcagcctcccgagtagctgggattacaggcatgcgccaccacacccggctaattttgtatttttagttgagacagggtttctccatgttggtcaggctggtctcaaactcccgacctcaggtgatccaccggtcttggcctcccaaagtgttggggttacaggcgtgagccactgcgcccggcctctgataggaaattctttagtctggcattgcatcagagtgaaatctttttgtcaaaacacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccagcttggaatgagattcttctaagctgtgtctcagcaaacatttaacatctacaatgttctaggtgcttacagaagccttccctcaccaccttatgcagtacaccgcccttgccccagtcccacccttcaatcacctctatcacattaccatggtttatttctcttatagcactaatcactatttaaaattaaccagctgatttatttctttacatatttactgccctgaattagaatattagccacaaaagggcagagaccctttccgtcttattcaccattgtatccccagaagcttctggcaaatggtagatgtcaatagataataatcaaattgactaatacacaatttaagccactcctgcttcagacccagtaaatatactgttcctccttcaaacacttaaacttcattatcacaagctaataaagcaactaaataaaattgtgaaacataatttagtaatagacttctaaatatcccagaagtgtaaaatcttatatgtggaaatgttcattgagatactaggcattctagggatatcatggaagaaaaagacataatctctacctgaaagactgtaaaggtatagttaatgagagggagtgaagaagctgacctgtagacaaattacaatataataagtaatgctgtaatcaaatgataaacaaagggaagagtaaaaatttctacacgggagagccaggtttcaataaaaattttattctataaaagcttatataaaataatgatattcgagcatagacttggaaactaaaaagagaaaggacttccagccagaagtcacagcatgagaaacgggcatcatattaaatcttcctgatgtttttgatgaaaaagcaatggtaaatgagaaaggaaggaaggtggttagtaatttggttgtgacagaccttgattatagggctaatgagttaagatctggtttttaagtactggagaattacctcactctatttctgatacttccaaagaaactgcaaaggtgcctaaaatataaaaaataagtagataatgcagaaatctgttcacaatcagatattgcaagttcacctctagaatatgtactgaagaactgtgaacatgggaaataacttccagaaccaagcatattcagcatctggtggatgtcctttgcttttgcacagtgaaaataatgtttttgaggccgatttccaagtagaaaggaaagacaattaaattcctttcatactacactagacaagagaatgaaactatagtggaaaaatattgagatttttactcaaatcagctgcatcaacaattaaaattctaccaataccgtggacttcttcaggtagcaatgagaactccatcccaagatatggaccgaggatggaatgataattttcaaaaatatttgtaaggaggtttaggtgtcaaattgtgacttgaatttgatgaccttctaagcccttcctgatgttatgattctgttttaatttatatattgtcaaagactattcaaataaaaaacaccttctatgccaggtgctggaaacaaaaagataaacataacacagtctagtattttaaaatagtgctaaactctacaatgttatctctgattgttcatacataggcaggtgcatagctaagctgcttggcttatccagctatttgccgggatggtgggtcactgtggtcaccacacagaaatcaattctgtttctttgttgttcattccagtgccagctccaagatacacagtggaactggcttgtggttttggagccacagtcctgctagtggtgattctcattgttgtttaccatgtttactggctagagatggtcctattttaccgggctcattttggaacagatgaaaccattttaggtaagtaacagaaatttgacataaacctcttctactgtcatctttagaacatatgttgtaaaaaaaagaaaaaagaaaacatgttgatttgaaaaacctagattaactggaagatttaagcagattaactttaatttcaaccgttgctattagaaatctttccgaagattattattctattttcttggattaattagtgagtcggtctaaattaacaccctccaaatagaaatataatgcgagccacttacctacttaaaatttcccagtgaccacattagtaaaagtaaaaagaaacaagtaaaaataacgaattgactaaatatatttataatactattttttagcatgcaattaatattaaaaagctaatgagatattttagtgttttctttggtactaaaaatgttcaaaatgtaaaatgtattctactttatccttatagcacatctcaattcaaaccagccacatttcgagtgagcaatagactcgtgactcgtggctgctgtattggacagtgctgatccacactccttgtactcagatagagatctgtgaaccagcagcaacatatcacgtgtagcttattagaagaagaatcttagacctagcccctactgactcagaatctacatttaaaccatattcccaagtgattcatgtgtacgttaacatctgaaaagcacagctctagtgcaaatttgcttagtgaaaagaatagagcatttaaacatacaaattcataggtccaccccataaagattttaattcagtaggcttatggaagaaacacggaatcgatagtttttaatgagatgtgatttttctaattaagcaacttcgtgaaagattggtccattaaatctaattatatttttaattttagttcttttcagatataaataattcaggcagtttcacaaggttttgctcaatttgtaattttaagatattaatgagtgataggcttggacaggaagttgaaattttctctacagtgttaattgccagtacctatgatttaccttctggctttgttaatttacagttgaatgggacaaacctcactctttttccactgtaaagcaacctgtaagatgagagttgaggatatatcagataacattcaaaattacatcttcaaatagtcgttttgcgtggagacttgttgcaagtagaaaatcgcactggaatctgtcacataatgaaaatgtctaatatgcagaagttagatttaagaaaaatgtaatggtattgagaaactttcctaatttacattgtatctgtgttccttttgctagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaagtaggtatttcagaggagtacaaatgatgctaccttgaaaggcagacagaatcattagttttgcattatgggagagagtcatggcacagcatctttggatatttaatgtccgatgctctttgatgtaacagactcctctagaaataaaactacgttggaaatgtatactattcaactcagtttatggtattaaaatattttcccttgcaatctttcagagatgcatgtcagaaaagcatggaggcacagtggattagagctctgttaaagggccatagctgtaaacatcctgtttattcacatttagatttttcggtttaggctaatctacactggttggtctagaactgttttacaagactgagaatttttttttaaagcagttttattttggttttagaaagacagaggtttacttggttttactaaaagtgagtggcggaagagtgtgggtagaatttttccttatgtgattcactgataataattacagtattttcctgtggcatttgctcttttttttccccctcacttttcttttcaagcaaaatagtgctactcaaattccccttttccttgggtctatttcttcttcctgtcagcttatacatttgagggttactttaaaattttataatagccagtgtaactagaaggtttaaaaagaaaggaaatgcctaaattcttgaatgtgttaaaataaaagtacaactcctttttagatccgcacagtaacacacaaagtaatttttcattggtgtctttttaataaatatataagttacattcccaaacccactgttaaactttatcctgttgaaatgcttgtaatatatctaatcataagcaagacaaaccaattttactcctctaaaatcctgtctacattcatcatttaacagtttttttttaaatattgcatggataattgagatagacttgaaattttattctcattttgatttagttggatcagttattttatcttcccaatcatcaaccaaaagtccatcataagatgtttctttcagtataatttttccaggaagttatgacttaattatacagttaaaggataaattccactcattttaatacttaatttccccagtcatttattcacccatttatttgttcgtacagccattcaataaatacttatctaccacggaactgggtaagaccctccaataggggttgataattctttgaagaattcacattctgcataattactcttgcatcttgcatttgttagttagcttttgcttccttttttattctccctgccgctcttacccaatcttctttgactctgggtctcttgccatgcttgcacatgctcagcctccagtgccactgcttggaacacacaatcattcctggattctcccccaggctgtgcatgctagattttaatcacaaggctttccctactgtttctgaacctgtgaagattaaggggcaaaatgacttcataaaggaatatatcaagacatgatataagtttccacaattctagtaagttacctagagttggcaaccatctgaaacacaggtaaaggactatgcaatcctcgataagcaactgtgaggagatggattggttccaagaatttagtgacagaaactaatcagggcccttgacagcagaataaaattacatggcatttccagttttcctgctttttcttcttttttcgttgaagaaagcatttgcctgttagtgcaagtagacacatcatctagcagctgccgaaacacatagctttatagtaatggtcggagtttgaggagaaagatccagcgattaatttaggctccaggggagaaagaagtagaaagcccaccgaggatgtgttaccagccaaaatgccattcagttggctagattttgttaagcttctagtctaaggacatagtgatgttagagtcagagaggtatccaacaatagagagggactttcagaagatgaaggtctctaactttgttgtcctgtcctagcaaaagataaaattctatttttttgattatataacatatacctttttgagtgtccattggtactagagagtttatgcatggtgcatgggtttctttggtgaagaaagggctcatgagctgacgtggctagaccataagatgccacacactttaaagaaactgctttcagtataatgtgtctactccttgtgtctcaagtgttgtttttgaagatcaaggtcacaacactatactaccttttggcttcatgcctgtttggaattctttttagaaatatgtgtatatagtttctgttttccctgaagacagtggtatttaacaaagagagtttgcaggtataaggattaagttgttcacatttttgctggtaaaatgtttcacctcaattcttaggctggtaccctaagttccctacatttgctcctcaagcctcaatgcttttggggagtttttggccaacactaatccccatggttgttttctttcccagttgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaattttttttaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaattttattttgtgcatgtgttttatgtcatttggtcatttggtcatttcacatttggtcataagtgaaaacagaaagaatttattatattcacaaagaaatataataagttacattagttaagtgtctttctgagataaatctgagtaaaatgggaacttcttatcaagaacattttctttacatggaagtaaaagttacttaagtaaaatgaattgttccagaatactaggacatattttatgggtgtatatgtgtttatgtgtgtatgtgtatgtgtatgtgtatgtgtatgtgtgtatgcagagagacagaaagactgtcaaaaagatggaaagatacagagagacagagaaaaaggagagaaagattattttaatacaaaggaaaacaagcttattcctttttactcaacttggaacttaggtcgtttacaggaatatttttcatctaataggctttaacgcaaccacacggtagttgctttggaaatagataaaactaatgccatgactttagttaattgatgatcatttgaatcaaagatgcatttctgttacaaattttgaataaatcagtgattaatatttggaaacatattttattttcggttaataatacaagtccatagtgacagggatgcctttttgctttaaaaaaaaaaatccctggccaggcgcggtggctcacgctgtaatcccagcactttgggaggctgaagcggatggatcaagaggtcaggagatcgagaccatcctggccaacatggtgaaaccctgtctctattaaaatacaaaaaattagctgggcatagtggtgcacgcctgtagtcccagctactcgggaggctaaggcaggggaatcgcttgaacccgggaggcggagattgcagtgagctgagattgcaccactggactccagcctggcgacagagcgagacttcagaaaaaaaaaaaaaatcctatttgttcattttactgagccctgtaacatgctcagaattggttagcttagtaaaggttcttctactgaagaattaattttccttttgcaaaccagccccaaaagtgtaggcttaggatcaacggatcgaagttacaaggcaacagatttctgctcagttagaaaatagctgtaaagcagagttcgacactaatggaattcactatctttggaaatactaggcctgccattaccagaggtatataagcatttatttgatagattttcattgagattttgtatatgagttttttgcactggataagtggttttgagtctgaagttgtttccaaccctgaacgtgttaagtgacctactagaacatactggtgactctttggaagattcaacttcagcattttgcatatgatctacctggctgtgattaaccttccttaaactctcaagatttttttttccagtatatactgatgtcactagctctttaacgcaagtaaatacacagtatggtatgagagacgggtttagcaactagtctatcttatttctctgtttctactcaaggaatataaagtaaccttagtaatgagttaggagatggagtgttttagtagtaattttaatctacatctatttaaaactgaatagacagaacttttacacactattactcttataaatccacatagtaagatgatattttaaagttagcattaataattgatacagattcaataaacattagtccatatatgattttactattgtgttcactagacgttgagcaacagtaatttaatcaaagtgatttatgcaatgtgtactgtgtgctagaaattcacatgtaggcatctaatttgtttatcagccctacgagtttactttatcatatgcattttatagatggatgaactaggactcaaaagatattaagatacaaatagggataaatggagaaagcaatatttgaaaccacattcgtcttccaagttaaatatttccttttttctatacttcaagttttaatagagaaaatga

SEQ ID NO: 17191 - DNA, 52661 bp, Human
  misc_feature (1)...(52661): n = A,T,C or G
gcagccatcagctcggtgatctcagtgtgcccctgccagggatcactgcctcacgcagtcctcctggggcattcactgggcagcagcacgtgtcctgtcgtggaaatgcacaagttccacaagttactaatttgcctgtggtcacagggcaacccatatccaagccaatgacaccgcttccccttcatctgcagaggtgaagttatctggatgaataattgttaatattagcccactcattcattcaacaaatcgttattgtgtgccaggcccattgatatacagcagtgaaccaaaaaagtccctggcctcaaaaagctcacagtttaggaggaggagaagggcagacagtaaataaataagtgaagatatagtttttcacatggtgataagtgctatggggtgggaggaccataaagcgagatgagaaggatgaggggtgctgggggcagggctgctgtttgtatggggtggttagggaagatctcactggtgaagtggcttttcctcattttttatgttaaggtataatttccctgcagtgaacttcaccctctttggtgcacagttccgtgagtcttgataaattaatgtcatcatggactcccagcatggtcaagatctggttctgtcaccacagaacatttccctgtgcccctttgcagcccacccctcccccaccctacctctggcaaccattcattaatctgttctccattcctatagttctgccttttctagaatgtcgtataaatggaatcatacagtatgtgaccttttgaatttggcttctctgagcagaagaaaaagagaaatcattgagattcatccatgttctgtgtatcagtagtttcttcctttttattggtggcatcaaagtgccacagttcatccatttggataccttctagtttttggcaattatgaataaggccactgcaaatattcgcatacagatatttgtgtgcctgtaggttttcattttatttggatagataggttagatggcttttgagcaaagacctggaagggatttgaaacaagccgtgaagacagctcaagatgttttcgcacgtgcactatattgtgatttagccaagtgaataggtttgtgctgcatgactgttctgtttgagtcatttttctcatttgagttatttggaggaagtaagagtaagaagggaggagaccatttattcattcatccattcatccatccaacaaactttaaaaaaatgaaagccaccagtcaacagtctgtgacccaaaggaagcttgcgacccttggatccacaccaaaggctaattttagttggtttatctgacatgacataatttcctttctgagtttcctgaaagttagggtgagagagtggttaatgagtgtggcattatcgtcttcgaaaagggctatgggagcacgagcattttagagagtttttaatctcattggaggcttcagagaccctttcataggtccctgagaactgatattcttttttgtctgtgaggttgtctgtgtgaaagggcaaagtgatctctcaaaagacatattcatttactttcttttttctttttttttttttgagacagagtctcactctgtcacccaggctggagtgcagtggtgcaatctctgctcactgcagcctccacctcccaggttaaagcgattctcctgcctcagcttcctgggtagctgggattacaggtgcacaccaccatgcccagctaatttttttgtatttttagtagagatggggtttcaccacgctggccaggctggtctcaaactcctgacctctagtggtccacctgcctcggcctcccaaagtgctgagattacaggtgtgagccaccgtgctcagcctgaaaagacatgttcaaataagagtcctccctggatgaggggccagtggacaagactgcatcttcctaggatcaggagctttgtgaaaaaaacagaactacaggaaataacttgtgaacttctttgtttcaggtgatgcgactgtgaaaaagaaacctgcccccaagacacctccgaaggcaggtaattggccacggcactatctggggtcaaagaagtcatctaccatgggggttttgcctttaccttgctagactgacacctgggtatgtgatcccaggagacaccccactgcaaccccacccccaccctcagttccagctctgcatttttcaggctgagtttgctcatggagagcctctgcacagcctggctcctggtccccttccacagctttgtctttccatctgcctcccatgttgacagcatcatacaggactagcagctctcctgcctgccccttctacgaattctgccctgctgtccatcctctgccctacccttgtgtacatgaccctcttggggctatttttgtgcccagctctgtgtgtccttgttatatggaacccttgtctgttttccattggatgacacttgaggacttgaatcaagcctgccagccagggtgacctggagtttagaaggcaaggtgatgcttaattcataagtgagttaggacctcaattcaaaaaattagggtaagtcacaaattccagtacaacccataaatggagaatcatgccatgtaagtagtgtgggtcacttctgagggaatcagaaagaagaggtgaacaaacctagcaggtccatgaacttggatgtcctgcagcaggatcactgcccctcagtcttaccctgaaggttccggaagccaagagagaagccaacagaccactgtggacaatggcgtcgaatgtgatcagaatgcctgagacccttctgcctcgctcactttctccctgtcctccctcagcaatgccccctcagatcatccagttccctgaggaccagaaggtacgcgcaggagagtcagtggagctgtttggcaaagtgacaggcactcagcccatcacctgtacctggatgaagttccgaaagcaggtcagtgacggtatggggtgggcactgggggtgctgggaataatccgtacagcctttggaccgaaagggatgagaaatgccgtgctggagatggcctcactcttcgtagctttagaaatgggagaggccactcccctacccatcgctcacctgccaaacctgagttcttgttaacctttgcttctgaatctaccaataatccccgcctttgtagacaatttgtgtaatagaagtgtgaggggaaaagtagaaaccatccatgtccctcatctggtttgatagcacagtctagaatcctattcagagtcaggaaagtcgagcctgtgacccaagatgacccttagactccatgagcttgctgtgattctgtgccagcccactgattcctgtctgttataaccacttaaacttgccacatgctgaagggacaaaagcaaatgtgagtatttggatagaagaattgtatgataaatagaattgtgtctgactgacccagaaatctagctacaatttatcataatggttcctatggaacaatgtttgaatttctagacaaccagcattgaaaggacttggggagcccagcagctccaccaatccacggtggtagtgtgtgcctgtatgcatgatcagcagagaccctggaatgatgggttggcacaggagtgggaagttgtgaagatttattctgagccctctgttactctgttttaaaatcactcaaattctcctagccccagagatgaacacttagtactaacagggaggaaagtagggttggtctcaaaagatggaaatgagaagtttgcctttagcatcccagagcatgtttgccctgagcgacatctggactactgttgtctgaaataagatggaatctcatcacttttcagagacatttagccaagtcccagctctgtccttcagaactttctgccctgatgaaagtgttatctctgtgctatccaatatggcagccaccagccatatacatggggctattgagcacttgaaatgtggctagtgcaactgaggaactgaatatttaattttaattaattaaaaattgttatagcagctttgttaagatataattcatatgccataaaattcaccctcttgaagtgtacacttcagtggttttcagtagattcacaaggttgtgcaagcatcaccattatctaattctagaatactttcatcatcccagtaagaaaccccagacccattagcagacattcctctccttcccccaggccctgacaaccactcatctactctcagtatttatggatttgcatattctggacatttcatatcaatggaatcatacagtatgtcattctctctgtgtagctttctctttttttgacttagcatactcttttcagggctcattcttattgtaacatgaatcagtacttcattcctttcaatgaattaataataaatattccattgtcaggatagaccatattttgtttatttgttcatcagttgatggacatctgggttgtttccacttaactaattaaaatttaaatagccacatgtgactagtggctacagcattggacagcacagaagaggctagaacccactggagtggatcttgtgaatgactttgctgagatgtgttctcctatcatcccattccagagaggtagagggagaccaggatatttctgggagcagtgagtgctcagctagttcatccatcctgcccctgctccacaccctccctgcccaccccagacctggcaccctcagggaagctggactctggatgtaggagagaaggggcctcagggagaagggcagagtccagaccagactgagcccccccacagcttgtccagctgcatccttcaggaagtagggaatggggaggagcccccttcctttcctagcccaggggcccaaggctccagcacctgctccatcctccgcccctagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtgggtgagtctggtggctgggtggcatggagcttggggcaaggggaaggcagggagcccccaggcaagatacgtgggcctcaggacttcatcacccattatctctcaccactcctgtgcctgacttataaggcaccacagaaagaagatcacggcaacccacagactccctgctagaccctgctgacctccaggctcagcagaggggccaaggctgggcagaaatccttttccctgtctctatcaacacctctctgtgatagctgttcctggagttccccgccctcaggccttggcatctagcttatttgagaaataagagacatgaggcataaacttggtcaacttcttggcccctacgccacaggtgtctgtatctgtccccatcctgactccaccctccaggctctggggatggcccaccttggtcccaccaaaggctgctcccttctcctgtgctctggaccccaggtccttgggggctccaccatccctacttctctcttcaacctcttcctctctcctggctcctcccagcagcccgtaagtgtcgccatcttagccagatgcacaggcattaataactcctgcaatgttctctctcactctagccaccctaccttctctctctgacaggggtgagtctctactgcacttccgcttcttcaccccccagcaccctccagctgcctatggcctcacccccacgccccattagtctgcagggactgttcttctgaggtcaccatgacctcccaatcctgactccactcgattttccttaccttcataccaggatttccttcatcccaggattgagtggggtctgtctccagactgattctcaagttcacttttcctctcctcccttaacactgtcttcgtgccctggtcagctctctcctggagcatcaagagagttttctaaccagtctcccgctgttgtcatgttctgctccagttgttccccgtgtggcaggtgcttgggacagcagaagaatgagcaggcagaggagcagacagagagagagagtagactctatgcctcatgcatttgtgggccttcatatgttgtgcatgtgaaagcctttgacctggcatttattgatatgtgcacgagacccgagcgggttttccatttgtccttggctttcaagcttatagggtacatttgtgaaaattagaaaaaggggccttgctgggcagagtgaaaagggtacagcacccccagcctcaccccagaactcatgacctggccttggggaggacaggttggcccagatgcccccactagaccccttttatgcagtgcacaaaactctcagctgtgtgtgctgatcccaaccttaacttcctgcaaactagcctttcctgtgtgttcctggtgcacacacacgtgggcacacagaacaaaaggatctgttggtaacagggcttgtgtggctaccgtggttagaagtcttccactggaatctctcttatggaagtatctagatatgaagttagaagttgtagacattgactcttaaggtctcttgtagctctgacattctatgattccccaactctattctctgacattctgattcctcgactctattctctgacattctatggttcctcacctctgttctctggtggtctgtgattccttgactttgttctctgacattctgtgattccctgacttagttctcaagcagtttttctcccctatcttcatctcgtatcatcaccttaggactaggatggacaggactgatgtttccagccttatgcaggagaaactgaggcctaatctgaacaaagtaacatagtgcatcagaggctaagtgggaactagctctaaactttcaaacacttgtcctccagtgccactcatgggagtgtgaagtaggtacagaatgtcccaaaaggtaaaggaacactctggctgcaaaactcatcttgaggggagacatgcaagccttttggggagctgtccacatgccagagagttgttgatgtctgtgcctccatttttctcatgctgagccttaggaagccctgtagcacttcccttcagcccctaagcagctggggaagaagaagtccttgtccaaccaggtgaataaggaagacacgaggataaaggtcaaagtaatacagagctgggaagacaaatgaggtggccaatgagctatgcccatgccagctaccagaacagaccacaggttccacaccctggcccgactccccagagaggaagtactgcaaagccccctggaagattgtccctggacacaggggacccgggagagggaattcacagaggactgagctccagcatccactccccacccccagttgtccatatttctgtttaccttctctcttgctctgttcctctccctggccttgtttctttaccctgtgttctgtttcagccatttctcagtgtccgtcaccctgtcccatgtcccctcttttccctttgtcttccttcctctgaccctgttcttttgtttcttttggttagaagtttcagatcggggaagactggtgtacaaaggggtcagggaatgggtttttcatttctaaaggagaagaacaacccttttctcactctgtctctttttggtgactccaggtgtttatttgaataatttcctcccaaggagtcaggaacctgtggaggcttggtgctagtgatccactttactggtacatttagatctgttctgaagcactgatttggccctgtactcccgtcctatcagcaagcatcagtttaaacttttctttgatgttctctctcatctgctcctccttaagcaactttggggtcagcttctttgaactgcttttctacagaaaagctctccctccccccagcccccacgatgcccagctcctgcgcagtgccacgcactcccctcctccgatcaccactgcgcgggctgcagttctggccttttatggtttagtttcttattctctgcagccagtgctgacagggccattggcgtggctgtctgccagctggcaggagcagcatgttaaatgccgtcctgggaggggaatggaatggaggagaaccgaggctttctgtctgcctccccctcaaagaactaagaatagaattgctcaataaaataggactcacattgatggatacagcaaagccacattcattcagagcctgtacacttagaattagttcaaagtaaacctggatgaagctcagatttacctgtgcatcttcagggacatctctgtattccctgatcagggtttattaagcagatgtaaaatgtacatgaggtaaaacaggaatcacttggtctgctccggacagttttcatgcatttacagaccagctaaataaggccagtttaatacaactcctccttgttagcagcaaacttctcttattgtatattctttaaagggccactttcttttcagatcctctctggctcctatttttcaaacaataataaaaactagcctttccctctgttagcttaaatgagtgatatttagctattttggagacttattattattatattttaaaaggcagcccaggaatttgcaatgctcagagcctcttcctgcacatgcgcccctggtcttggcctgtggggaataagggaggggacagtgagcagcatacccagatggattccttaaggtcactcacccagcacgagaaaagcaggtctcttttcatatctttaaaggagaaaaacaaagtagagagaaccccaaatacccaataatccccaaatactaactgagtttggagcttgcatgatttcccatcttaatgctcagctcaggcttaagcaagatgccttcttgagctcattctgcctgatagcctggaaagtcttgagccctggagcgagggtccagaggctttttggaatctccttttggctctgccactgactactgggttttcttgataagcaaaatgccttagctgctgaggacccatttcccaagggctaggattatccaggtagatgacatgtgggggcccttccagcagctgctgaagtcccagggaagggacatccaggtggggctaggcatagccactggtcatcttcaaataagcgaggaccaagagacctcaagagcagttactctagtgggaagctgtaggacaggatcctccattttcctggaaattagaacatttgctgaggagaaaatcctggagctggtgccactggagactcttgtcttagactgagctgagtttcctattctgttagtcaagcctccagggagccctgggagaattcagaggaaatgtggagtctcctttgcccagagatgcccagggtctccctcccagtctgagtgtgtcgccgtggaggacaagctcacaggagctccctgttctaaggacatctgttcttttctgagagttttcatccctttactagttcagccactgcatggggctcatagcttagaaagaacagaaagcattaggtgcagcccacagctctaaaggcaggtggaggagtgggaggcctccaatctcctaggacttctgacttgggtcttttctgaactccttaatttggtagcaaattccttaaaaatgttggagttttacttggaattaaagtccctcgccccaaattttgcatcttctcttgtgtgacaagtcttacgtatcacatatgtcatgtataggttctcattttcagccaagagacatgtgtaacagggtagggtacaaatggcacctcttctgcaacacccatttctcagttttcttttcttgaccaaagcagaaggaagatcagttggcagagtgcattcgtttataagcccacacaactccaactgtggccaatcacatggtctccaggcagtcttctctgggaggaatagtgggtctgtcttccatccctcttcaggtttttttacttccttagctgggtcttgagaggacttgaaccacttgtctttaagagagtttagagtaataaacatcttagccaaaaccagaaatgtttcaaaaaaggccaatatatctctcagaacaaacagtttttctaagagaacatattaaacagccagtgaaagtgcttccatcacaggaggcctctggcatgactgccagcactgggaagtggctctgtcacaatcccagaatcattcccagggctttggttattggggtagacagtttctgggcagtgcattctgggctggaatgtggatcggcagggctgggagaggggacaagaatgaatatgagtatgagtatatatactcatatacacatgtatatacatgcagatttttcttctccatatacacagggtcatttgcagccattgcctttggccttcctgccttgctggaggtgggagagtagcggtcaagtactttatctatgtttgcttacttgatgcttgcaaaaaccctaagaggtaggaacatattagcaccattctctgaatgagaaagccaggcaaacaaaccagtttcaaatttgctggggttgacatagcttaaaagcatggtttcaattgctagtttgtgaggcttcatgaaatcaaacagcattgggggagatgaagggttaatgaacacaacacagatatctgtaactaaccaaccatctgcaaaaactaaatctgaaaaataggagagttttgctcagataagcaactaataaaatcagcaaaactcaagagcctcattaaagtattggctaccatgatttgacttgaagttggcagtactgctagttctgaggccaggtcatctgaatgagaaggcagccagccaaaagggccacttcttatttgtgtcctcagctcattttctgtccattagtcagggatggctgtgatttgctattgtggtttgcttttgaaattatttatatctcaacagccctctgagaataaaagaggtagggtaggagtaatttttaagtatataaagttagaaataaactcctacaataatcttgatagtaatgactagtcaagccagccactcttctaagaatttcttacaaccacctgtgatacaagtgctgttgttattcacattttacagatgaggaaactgaggctcagggcaattaacagctactgtgtggggacagatctgtgttcaaacttgaatctgtctgacttcagagcacaaacactgtgctataccaccccttggtggggcaggcatttctcaagacccagagaaagtggaggcagacccctagttatgtcacaggtcattggccaagggcctgaaggacagacacacacactcatgctgaactctctctctcaaaacatgttttcgataggaaatagtccacgccttctgggcagcttcctagatctgtttactctgacaaatatgtttatgacttgggcaaagtacaggaaatcgtgacttgcatgtagactggaaaactagcaaaaaaaagcgagggggccttttttggagcaaataattatacatggggctttccgtacaggtgggtttgtacatagctctaactgtgatgtgcggatgagggaaagagacgcaggaccagggactttggattgggttctctaggctgccttccccccatgacacaggtaattcaaaaacttcctttgcctgcaattctggaaagtgtgggtgatgttgtgcttctttatccccagataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaaggtaggctgccatcacttcatcagtggcttgaaacaaatgtgcgtgactgaccttgtgtatgtaaagactgtactgaaaggggtgaaaaggaactgaggaaacattaatgatgactggcagggtcttttggggtcttggtttccaagacagtgatgttgagccattcttcaaaaaaagtattaatacttaggacatttcaaaaaacattgaaccagcaattttggcatgctgccaccagggggtgatggtatgttactcaggagcataggagttcaagcggcctcatgttcctcttccaccctccaccccttctcttctcctcttgtatccatatttgagtgtctacttggtgtcagattcttggaacacaaagataagacatggagcttaaaatctagaggaagagaggtgtgtatggctaactataatgagaagggatgcatcctattatagctgggtaaaaaaagaaccaaggggacataacaaaatgcatggagcatttttccatggagaccaaggaaggctttctggagaaggtgacacttagtctgagtcttggaaaaagggataggattctaaaaggcagggaagataaggaaaggcactctacaagaggaaacagcatgagcaaaggttacaaagccatggcagtgtgtgacattttcagatgctcgtgtgtggccaaggcatatgttgtgtgagacagaacaggaggaagtaagactaaaagggcattttaggtaaagttgtgaagttcatcaaagattctcaggcaggggatcgagacgattagagctggttttcagagaactagggaaaaagcagggatttgctattcacagtgcagttgtggaccagcagccttggcatcctgggagcttcttagcaagcagactcccccaggcccttctgggccttgactgaaaatgatccactccttggggattcagatgcacacgaacatttgagaagcactggagtggtgggtgggtcagaggagatgagactgcagtcagccatatcagatgggcctctgggatgacagtccaggggagggatggaaagggcacgaacttcaagcctcaggaggtagaagtgaccatacttgatgactttttgcatagtgagttgaggaagagaactggaagattctaagatgacttacagttcctggctggggtaactgaacacaaattcaagagccagctagaggtttattgttataattcaccatggctaacatgtattgagcacttactctaagcttacgatgtgttaatcactttatatgcatcatttcatccaatcccaatagcccaatgaagcagatactgttattaccctcattttacagataggagaaatgagatttagaggggagaagctacttgcccaaagtcacagagcttgtaattggtgaactgatgcttgaactcagagctgtctggcctgaagcttgtgctcctttggttagactgagggaagaggtcaggctgtcttccaggttcctgacttgagtaacttggaggttacataacagtctgggaggagaggggagctgcggtttcagccctgctgagttgaggcatctaagggctagccgagggaaggtatcctaagactgttgggtctagagcccaggagaaaggtttaagctagtgtggcaggcttggaagtcttcactatttaattaataattgcaaccatgggcattgataaggttacagagagtgtggtagagaaagtcaataccaacaccataaagaaggaacttgcagtaccaggagaaaggactgagaggggagagaaccaagaggaggctggagtctcaaagaaacaggggagggagaaggtgcaaagagggcttcataaactgcatccaatgctaaataaaaatgaaggagatgaggactcagagggtctttggatttagtcctttggttggtagtgatctttgtgatccaagtctgtagagtttccactgagtgaaaagatggttgccctggttaaggaataaatggaagaaagagaggccagaagcatggaatattatttcaagaagttttatgtgaagaacaggaaaaggacattgtaaatttaggataagaggccgggcgtggtggctcacacctgtaatcccagcaatttgggaggctgaagcgggtggatcgcctgagctcaggagttcaagagtagcctgggcaacatggcaaaaccccatctctactaaaagtacaaaaaattagctgggcatggtggcatgcgcctgtggtcccagctactcaggaggttgaggcaggaggatcgcttgaacccaggaggcagaggttgtagtgagccaagattgcaccactgaactccagcctgggtgacacagtgagactccgtctcaaaaaaaaaaaaaaaaaaaaagaattaaagaatataggataagaaaaagttgggggttaggagaaggtggagggacatcaagggaagagagctcttggagacaggagaatgtagagttgtgaggcagatggtagaagactcaagtatcaaaggagactgagctccacatgcagaatgtcacttgaaaaccaaaactgatcagtaggtgagaatgtatttgacttcttctaattacaaggaattagaaatcaagtgaggcaaatagtgaacctgagcaaagctcagaaagcgagaaagcgagcaggcctggcatcaccagggagctagagccatcgtgagtatggaaactgtcatctgattcaatgaccctgtttagttttgaaaaaaaaattgaaaattaggtacaaaataggtattaaaattttactttcaattaaacaagggctccagaaagaaagaaagttagggtaccaatgggaaacataccaactttacaattttatgctagcagctgtgtgtcaggcggcctttacccgttgagccatgtcaatatgcatagagcaggtctccttgagagctatggtgcaagtcacggagacgtgatgcctgctcctgggacagctttcgcagggatcccaaccactagccactcccaaatgtctgtcaggggacactgagtaacaaaactgccatcactgtcttcttacacacacacacacacacacacacacacacacacacacacacacaacatccctctgaaatgagcagagtgggggctgcatagagtgtgggtcccaggggggcaatcaagttccagtctgtggtgttaggatgttacttggaaaagtgacaggaaaaggagtaagattgcagtgtgaagatgttcattggctggaaaggaaatcatccaggtctgtgctatggtgtaaagagggagagactggagaatccccgactaaccccaggcagcaggaccagaggccacgggagctacaaggtgtggcccccaggggtctaggacagctgctcccagggctgtgtggagactctgccaggaggaagagctgtgactgcctgtctggggcaagtggcctctcccttgttccctgccatcagcccgctgaaccctctctgggccttcagactcccctcccctgctgccacccctcccagctgggaatagacaaagggcaatgttgaaatcacttgaaatccagaggaggagtccagtccacccagggcttccagacaggaagctactccccagctgaggctggctggattaccaagggggaggaggaagagggcagaacagttggcaagtgttaggcctcagggcagaggactctggttgaggggattccaggcaaaagtcctccacggtctgctcagatgcttgttagttataaagcttcataggccatccctctgctgaagagggaaatggctctcagggaagtggcgtgtgtgttcacgcacgtgtgtgtgtgtgtgttggcagagaggtgggatcaagtgacaggtcattgtaggtcatttctgtggagcagatggggtgggatcatattaaaaaggcagtgctgattaacccacactccatgaagcccagctaatgttggctctgaccttcaccactaccaccacagccactgccactcctgcctctcgctcttctacttcattctcatgcctcatttgcatccctgttggtaccctagccctcatcccacatccactcaccatgtgttctgtgcccctcctgtgttctaggcactgccatgggcactggggatacactgggggacaaagcatgggttccccgtggagctccagtggcttctctatgccagagccactcctaagactagggtccctgaactgacaatgtactcccaaacccaagtgcacagagccagaaccttaccacagccccgctccctcccagcccagccaggtcttgaactgtactcctcctcaaatcctgctgtcactcaaatccactccatccctgctccttaccctaatttgttctagtctgtataattgttagcaaaacagctactgtgactgaggcttcttgcagaactggagcctccttgcaacccccaggacagttcgagatataaagcctgtaccgctcccatcccaggctgcagctacgccctggcctcagaggccgtctccggggcgggggtgccctctagtgttctctgggtgtgcaacagtccttggctgcaggaagggacaattctctgtccaggggactgactggacttgtgccatgtgagggtcctgagcactcagctgatcctctcccaaacactccagggtaacgagactctcatctgtttgcagaaatatctcagaaccatcttccaaatagccttccacttagctcatggatctcatagctcattctgaacagattttttttttttttaagttcagtggaagacccttccctagtggaaagatggaaaccagttcacctttctcaacaaccctttatgcaccaagagctctgctaattgaactgtggtctttcctctacttctctctcactcctccccttgtggtcaaatagaagagaggcaggacaagaagggaaaagcagaaggggatgtagcagcctggaatctttctcttttttaaagagatcgggtctcactctgttgcacaggctggatttgaactcctagacgcaagcattcctcccgcctcagcctcccgaatagctgggactacaggcacttgccactgctccctgcttagtccggactcttgatccgagtttcctgcagcataaaggaacacagtgcactagaaagaggggctggaattccttgagaatgatctaggtccttcccccagagcattagcatgagaatcagatctgccacagacctctggggtgagaggcgaaggtgaggcatggatgtgggctcatgagtgaggccagaggctggccctgtggctgtctacctggactcacagtgacaggcaggggccagctctaggactggatgcccccttcaaggcacgcagggaaagcctcctgctgccgggccattggcaagactgcttctcctgacaccaggccaggaaagctgccctctcctttccctctcactctgctgcttggaatacactggtctccatgccacgccgggaaaatgtggcacaggaacaagaaataaaggatgactcaactggtgaaccactatatcaggcagcagcaccacaggtcaagacaggggcctccctgacagtaaataggatgattctgtgtcgaagacctagtccagtgactggtccacctggtgtcccatcactcattgactccaatattgttgcttctcttaaaaccctgtttataatatcatcactgaactaacctaaatgtctattgaacatacttattattctagtggtacttctcatgtgtgagttccatatccctccagccttcctcctacgtgaggtagaacactaaatggttcccccaagatgcagtagtcatgagttgatgaaaagtctgaaactctcatctcatccttggcgattgtgtgattctctttaaagtcatgtccattttagacttctttcccaacctcagaggcctcaccttttctgattaagacatagcccttcccttcagtggtcttgcttgccacctccagctccattgtggcttttggactgccgacagccagagctccagggcaggcacccagggcgctctcaacagctacccagtactcacccctgtttggggcccatgcacactttgccctgtgacagcatctgacagcccaagcagtagattgaggagctgctgtttctgtcttgggtattaactatggactttagggttcaccaccctaaaaggtagaatgatcagattctcctgaacactaactccattcctggcttctagttgcattgctctcaggtcatcctttccacctgtgaattggacaatgccactcttaactctccaacatgtggatttaggaatattgaccagttaggcccacatcccgacagtaaccgtgaaacccacctctgatacttcagctagactatctgggtgtccctgtctatctcatccttttttatttttccatggcagcttcctttctgtgataaaatatactttccaatcccattcatgtttagttttagtctttttttaaaaaaactaagctttgtcagcagcattttaagaactctaaacacactcacactcacactcacaccggtacacccgcactcacactcatatgcccactctctctcacacacacacacatacacacacactcacactttaaaaatccttttcctccctctatgctttctctcctgtctttgttttgcttccttgggaaacctcccattcattgtccagctgtcagccaggacgcagcccagacgatggctgaggaacacacagcacatgacgaagcgtggcatccagagctagccagggccagagacatcaggtgcaacccttcctcttacagatggggaaaccaaggcccaggaagggaaaggcaatcagccaaggtcaggaagccagagtggctcgattgtcaacaaacaaacctgtatcgaggcaaaggaaggcctggagctctgaagtgggcgtgctgtgctggatgcccccctgttccggggaacccctcctgttccccggaccctgttcactcctgacacggccatgggagcagctggcatgactgtgtccctccctgccctgcctcacaaatacctattggtttcatttgtgtgacatcactcacgccttcattgtattccatcatttcctgtaagacgcaactcaaaggctatttcttctaagaataattgctctcacttacaattgcaccattttgtgtcaccctcctctgttgtgtattcactttgaaccatggtgatatgtgcgtgattatggtacactttgtaaattgttacttcaagtatatatgtttttgcctcttgaactaaattataagctataagaaaggagagaccatgccttctgtgtaatatgttttgaatgcccacaataactggcattcaagatgcttggtccagtgctgggatgccgtcaacaatgttcaatgaatggctacatggatttgacactagaagcagttataagttgctgacttttgagccagggcagaaagagactgtcacagttgtgtgtaggttctgaaagtcagaaagggttggatgagatgtggagaagggtatatctggggaccatgaggctagagaggatgggacagaggggagacctggtggagaagtggagctgagtggagggaggaggctggcacctgccagtctgcactgggccctatttgctatatggactgaccagccccaggggatgcccagagctctggacctggtagtcgtctgcctggggaggctgaggcctggcagggcccccagcacatcttgctctcagtgggccttcagtactaatcacctgtgtcctctctgtccttccttgtgccccccccagagccgaaggatgaagtggaggtgtcagatgatggtgagtgcagcccctgtcttcgggtcaggctcttggggtggagggggctgagtgggggcatctgagactcacaccaaccctgacctgtgccccacagatgagaaggagcccgaggttgattaccggacagtgacaatcaatactgaacaaaaagtatctgacttctacgacattgaggagagattaggatcgtaagtggagtgggaagttgcctctgggctcccagggtgagggtggtgcgggtctcacagttagattcagtgcctcagcttcctgttgctccctggggcctgcctcctccccagactgagagtcctgcaggatccaaaggactgacccacgaaagcatcactcactcacccaggactctctgcagagttgcccatgcggtcctacactgccccaactctgcaaaggctgtgggcaagtccttccttttctgtgcctctgttcagagcccaggaccaaaatgagacacagggaggggaataacactcactggggcctgtcaggggagagcagggggtgcggggagcagaacattagggagaagagctaatgcatgctgagcttaatacctagatggtggggtgttaggtgcagcaaaccaccatggcacacgtttacctacgtaacgtacacatcctgcacatgtaccctggaacttaaaaacaataaaataaaataatttttaaaataaaataaaatgagaggactggatcagattatctttggcaccccttccatttgatccacagaagtcagtgtagcctgatcagtgctcactgtaaagcaatgcctgcgttagtgctccattaaacgcgcagcagtcatcaagctccctcatgaacttggctcgcactgcttactctggcttctccctagggcatggaggatagagtgggctcagaccccaaccctgagccaagctgttcatctgcccttacgctgtccctggaggaatagaagaggtgggagagaaaggagtgggactccacttgtatttccagtggtttctgggaaatgaaggagtgatgcaaactgggtaacagtgtcagaaagaagtcagtgccatcacagaggagccccactctcccctctctcagcagtaggaagcaggaccctgcctgggccatcaccagggggtcagtggtagggagtggaaggaaggaaggcaactgctcagtaatactctgcatttgggaagggctgtctccacccatcttcatgggttccactgcagggaggggaagagatgccatcagccaaagttgacagtaggcttgtcaacattagaaatgtgcttcaaaggccaggtgtggtggctcatgcttgtaatctcagcactttgggaggccgaggtgggaggattgcttgaggccaggagttcaagaccagcctgggcaacatagcgagaccccatctctaaaaaaaaaaaaatgtttaaagataagaaaaaacaaatgtgcctcattgctctagagcaggagtctgggcctttcataaaggctgatatcttagattttatgggcgatatgcctttagctctgccactgtagcacaaaagctgccatagacaacatgcaaacagccaggcagggctgtgctccagtaacaccttacttataaaaggaggtgggccagatctgtcccatgggccataatttgccaaccccaagttagcggaaagcttggctaaatgtggcttttctctcctccccctttcatttgcagtgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatgtgagtggcccactgccagcagcgtgggcaccacagggagcccccaaacgtgtctcccctactgccctaccccagccacctctgccccaagatggaaagcactgcagacaggagtgtgatatgtaagatgctcaccagccatacagccaggcctgaccaaacagaaccgaaggtctgtgcacagtgctggccctgagcctctgagcaccagcccagctgcagccttgtgcttatttccaaaacaaaccagtagatctttgaggaccctggtgtctttctcgccctcatctccccatgaaagggccaaagctatccctaggctccttggtttcatttggggcattcacacctgaaggtggtttaggggagggacagggcagcttcctgacttccctgtgaaagataagggggcccctggctgggggcttgaaatccaggatggaagcctctctctggtcctcagtcccatcctgtgtctccacatgcccctggtctactcttgtttgtactctttggacttctcactcactaaagagtggtgctttccctatggggttgtacaaaggcagggggattatcagatgacctccagccaagcctttcgcagaattcattgtttcttctgcacctgaatcctccacctcccttacctctgagctgttggtgcatgcgtgtacacacgcacacacacacatgcacacacacacacatacagtcaagcatgcacactggcatcagcaagccaggcatcccccacagcatctgcattcttaacagtttccttttttatctgaatttttagaatatatgctacaatcacctcaaaaaatattaggaaatacacagtgaaaagtctaatttccaccattattcctgtctatcctttcctaaacactacaaccatcaccaacacaaacaattttattggcttttatctgtatccttccaaagtttctttatgaaaatataagtgtatacagacacacacacacatatatatattcttattttcttgccttttaacacaaaaagtaacttcttatactcactgtcatatactttgcttttttagtttggtttgtttgttgttgttgttgtttgagacagagtctcactctgtcgccgaggctggagggcagtggtgccatctcggcttattgcaacctccgcctcccaggttcaagcgatcctcccacctcaccacaggctcacgccacctcacccagctaatttttgtatttttgtacagataggatttcaccatgttgcccaggctggtctcgaactcctgggctcaagcgatccatctgcctcagcctcccaaagtgctgggattacaggcgtgagccaccgcacccaacctactttgctttttcagcaaattgctatgggagttagtcccatctcactacctagtgagcttcctcattctcacagctctgtggggttttgttgtatagaaaatcacaattcatttaagcagccttcttttgatagagattgagtggtttccagccttttgcttttacaaacaagcatcgtttgtaaccttgtacacacatcttttcactcatgcctgtgaatatctataggataaactcccagaagtgaaggagagctgggttaaagggtatgcacatttgaaatctttagagatattgtgaaattgctttcaacatccttgaaatgctcatcctgaacttggggggtctctgtcctttggtgagggctctgttagcatcttggaattctctcccgggaaagttgagtccagtaagacatccccaagctgtagatatgagtggaatattagtcttttctctcccctcatgccattaacattctggcacacaagtatttcctttccgtatgtgttccttaggaaaggcaatagtagttccgagtgtaggcttgagtcagatgaaccttacttcaaatcccagctctgcttctaacttgttatttgaccttgagtaagttattctattgtaccaatccctagttttattatccataaatgtagatacgacacccacctcatgaacgctgtgggattcaatgcaataatgcatatagggcacagtgctctataatggggagttattgttagtagtatgatacattgactttttttgtatcctggtttttttccacttaaaaatactttttgagcatttaacttccaacaaggtgttgtggaacaaatcctccctagtattcaggaagcctggcttcagtttctgctactattgagtcatgattttgcaattgtcaaatcctatcagcacgaagaagtacttggattagaacagtcaatctcaagatgccccttttggttataaaattctactatttcatggaaccataaaagacgcggtgaagaatttccattcgtatcttacaatctacattcagccccaaattcaaatgttcctccccattttcaggaaatacgtagcccacatctgtgacctcattctttacaccctcacaatagccccgtgggctgcatcttttcacatttattctagaacaggttgcttagtccaggcggtgtgggcatgtgaggacatgtggagaaatgtcttatctttagaagttaaaccttgagcaagttgagagggtgcagggagggcaggagtcacagggcctggggaaggctaggcagcagcaccagtgggcagaataccatacttagcttggaattgggagttggcaagctggatggaaaaagcaaagagaaaatgtaagaaagcttcagctagtctggctttcatccctccaccccatgcctcccctgtggacagcagcaggtcttccatgcccagataccagaaaatttgcctgcacttgggaccttggccaggtcgccaagagtaggaacttggtaagaactcagtcaaccaaagaagaagggaacaggttcatactccatctatacatcccttccagcttaaacactctaagacttgaccactgagaagggaaagaatgattttcaccagtgcaatgtgctaaccttgttggatggagaaactgagattaaaagaaggatgatgcctggggatagaataatggaaatgtattccagggtcccagccttaagtccagttgcttcagatctagtgggaaatagtaatgaatgtgtcttcatcctttctgacttctgattactggatgagcccccaccatatagtagttggtctgacacagcggttccttcaggcccctggcctacttgggcttgtccttttggaagtgcttgggacattccaggtggttgtgggaccctgagcattgaagacaatgtgaagtttaagctgtgtcatccatggctcatctcatgtttgtgctactattagcaaaatttatcaaagaacgttccagctggctgccatagggcaaggagcggagggtctcgagtccagtgatagcaccattccttcttgcttcctatgagagctagccaaggtctagggtttgggggatgaatctgattccttaggatagggatcacttatttatttagtcattcactcactcaccattaatttaagcctaatcttggcccttggcattatcccattactgtgggtggcagtttctgtctatcaaaccaatattttccacccatagcattaagtattttgaagataaacccacagaaccattaatcctgcctctttaaccccttccatcttagaaagttgaaccataggaacagttttcaaaatataataagtatatctgaataggattgaacctatttgaatttatattgaataggtttcctccagaaatgcagcaggaattatctccatggctcagattcccaccactcactgcctcagacattcccaagggcattgaaaacaatggttgcttgctttttcagaatatttaaaatttaaatgtaaacattttggagcaccttgtctgtgccaaatatagtcggaggcaaataagggtctagagatgagcctgccacctgtgatgtgttcagaacttcaaggcaaagccaacttgatacacaaagtgcggagacgaggccatggacataaggccatggaaagtgcagagacaaggctatggacataaggccatggatgcccagtgagggaaagatcattccatgtgaagaaatggggagtgactttttcagagggcgtgaatttcagctggcctcccaggagtggtagttgagtaagccagtatttctcaaacttgtctgatcataaggatgacctggagtaattattacaaatatagatcctcagatctctcccaagactttctaaatcaaaatctccagaggaggagcttgggaatttgtatttttaataagagccccaagtgattctttacatagaaaattgatcattaatattgagcattgactgtgtgccagacacttccaagcactttacctgtgttgactcatttagtctttgaagccaccctgtgaggtgaggctgtttttaatctgcatcttacagatgaggaaaatgaagcacagagatgttaataactggctgagacctaagaatacttgtagatgagagtttgtcttggagccttggcagagagcaatagaaatggagggcataaggacaagagcgccacctgcaggccatttggggaccttcttctcagatgggttttaaagtatgagttctagctccctccagctgtcactggcacagactgaccttctccagttcagcccttccagaagtgagtgtgtgtgtcacgtggcagaggctgtggtatgctgggccccacagtgcatccctgtctctctcctgcaggggtcagtgacaagatccacctagcccaccacagcttatcaaacgataagtaataagtgttgagcaccttctgtgtgttaggcatgatactttacaaagcctcctacattcctaaaaactctatgaggcagggatagataaggaaactgggactcagaaaggttaagcaacttgcccaatgtcacacagctcataaaaggcagaagcaggattcaaactcagctcctttcctcttcgtgaggactctctgtaggagaggaaatacccttgcaagaggacaggcccagaacccacccggccttgttcaactggtggacctacaggccactgcagaaacatgagcttatgactgggtgacagagagagaccctgtctctacaaaacattaaaaaaattagccaggtgcggtggcacatacctgtagtcctagctacttgggaggctgaggcaagaggatcgcttgagcccaggagttcaaagttatgttgaactatgatcacagaactgcattcaagcctggaagacagagcaagaccctgtctcaaaagcgaaagaaaggaaaggaaggaggaggggaggggaggggagaaggaggaaaggagggaggcaagggtagggaagggaggaagggagggagggaagagagggagggagggaagagagggacggagggaggagggcagtgcaaggcggaaggtcatgcggttgcaatggtgctacaaaggggctgaatgaannnnnnnnnnnnnnnnnnnngagggagggaagagagggacggagggaggaaggcaggcaggacagaaggaaggacggaaggaaggaaggaaggaagataggtaggttggttggttataggccaggcatgatggcttatgcctgtaatcccagcactttgggaggctgaggtgggataatcgctggagaccaggagttccagaccagcttgggctcccctcccctcctccttcctttcctttctttcacttttgagacagggtcttgctctgtcacccaggcttgagtgcagttgtgtgatcatagctcaacataactttgaactccttgtctctaccaaaaaaaaaaaattgaaaaagaaaaaaagaaaagcaagcttactgatatctgggtgctgcataagttaccagagagatgctttaaacttgctaagcagagaccaagaaaggtgggtcagagggctaggacaggggaacagagaggactcatgcaactcaggcggtggggccatgcatttgcactgaagggcaatatgctgatggctgagaccccggggcagtccctagcagaggatgcatgcctgtggctgcagaagcaaagttcactagaaatagccaggatccaaagcctatccagttagaaaggattacacagctggggtaaggaaggggtccaagggagaccagttaattatgactgcagggagtaaaccaatactataggcctggccagagtaagcaaatctgtcacagctgtaggtataatgagttacagccaactaattttagaaaatttgctgaggctcattattgatgattgaagatatttttccgttcctggctatgcagaacaaatgcttgtgggaactgtgagtattttgaacttgagttccctgtgactaaaagacacggctagagtacaagaatgttcccttaggcatgtgtggtcatttgagggaaagagactgtttagaggtcactctttttgctaagaagatcatgtctggatctctgtgttcacacccacctctgaaactgcctagtgtagatgcttccctgagtccccagcagcttagaaggtgcagggcagggttccctgatgggaaaccaggaggccctgacccttctcccatgtcggagggtggggattcaggaattgcccatcacccccattccctgggctttcctgccaatttctcctacccccagcctaccctggccagactccctgccagcctggcctccatgagcctgtggcctgaccaccccgtgcacgtgttcccgcagcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctgggtaaggctcatctgcctctcccatggacaccagtgtgtattgcactggccgtttcctctcacactgagtgtgagaggaaacatacagtattggggttaaatccgagaccatgaagacttcccaggtttgaatcctgcccctaccacatactagacgtgacagtaagcctcaaattccccatcagaaaagtgggatcatagtaggacctaactcacagatttgttaggaggatcaaatgtgttaatataggtaaagggatgggaagagtgctttgcacatagtaagactgcttaggtgttagctgtatatatgatgatgattatccccttttgtttttcactctggtgccattagcagcaaaagtcattttggtgatggtggctctgcacatctgcatcatactgtacagtttctagagcactttcacataaaaaataaaccctatgattctcaccatgaggtgagcagggtagattttatgagccccaacttgtagactaggaaacaaaggttcacaatagctttgcccaggaggtcccactgtgagccaggggatgtgctgggattggaacaaggaccccagaccttgctcagggtgctctgcagcacctctgattcttatgctagccaggagagaggtcacaggggtaggcggtcagggtctcaaggccgccctgaaagcactttggtagatgcctgcctggctcacattctgcctgcatccagcctgcctctgcagccctttgatgtcccggtgattgaggaaacagcttcatcctcccttcttagccactgccctgctagcaaggagcccgagggctggggtgagctggctttatttcaccaccctgcagggagtagaaaggaggggccaaatgaatgccacccaataaatgtctcccacgatgttcagtgctggctgaggctgtgttggtcataaagaggaaaggggtaagcaggggcgaggttccgatagactatgaccggtctggtggtcagcgcagtcaggtgagaaacatgcctcggcgctgggcgcatgtgcctgctctgctctgctcactcctgctaagaggacagggtaggggcagtggctggcatacagggcctgcctttgaacagtgaccaccaataaattaaacaaataggccactgtcctcaggagtcggcagtgtcagagcccagggaacacaatgtccagcttccactggtgagggatactgtgggaacaaccgtgtccaccaaggaccagataactgagaagtggctaaaatgtagcagaaagggctgagaggcaggaattggagcagagctttcacatctgagggctgttaaatgctttgttttagaacatttgctgtgagctctgcgaagttaagcaagaccaggcatagcccacaggtacctgccttttgcacatattaacagacatctctggtcctttatggccaagaggtaccaccctggggttgaagcctctcccgactaccctaccagtagctcctgaaggacagccatgaagctgtgtgaggagtaggagaggcaggagggaggaacggtggtaagcatggctcaggagttggactacctgggcttgagtcccgaccaccacttgttaaccgggtggggaaatcactgcacttccctgggcctcactcatgttctcagtagcacgggcattatacctaccccttggggtgggtgagaacccttgtaaagctgccggtggggtacataggacatagtgaatgctagagattattattaagcataagtcacagtccctgcctaggggaactaactcatgagacagactcacaaaaagaccattcaggggcgggtgatttagcggcctcttctccccctgcccaccctgcacaggacatttgaggtgagtgtgaggtttgttggtttcactggtgtgttgacgcacctgtttaacaaggaggtcagatgtctctgtgcctgttctctgtgccaaagcctgtgtctggcccctcccaggttggggtcaacacacagattcgggcagctgctggtctcaagctggctccgtgatgtgctggcaatttatgcctctccatcctggtttcagagaacgcggggtctctgaaggtcctctttggcaccccagaatttgtggctcctgaagtgatcaactatgagcccatcggctacgccacagacatgtggagcatcggggtcatctgctacatcctgtgagtcctggggcacttggtggactggtggaccacttggtggaccagtgggtgggggctgagggttccacaggagggtccccaggctgccctgccattgtcatgatggggagccccccccagagtcaggagggtggcaggctcccctcctatccctggcagcccaccctgctcctgggctcccagggagtcagtagcatgcatattctatagcatcatgtagctacacatgctaagatccccattctgggtgctcactgtccccaaggctggccagcctggggcctttggtcaggagggtgggaaatgtggctggcaccaagtaataaaacctcacttgtgtgggtccacaaagaaggagggcaggaggccaggggcgaatctctgggcatcctcattgtcttcagggcatagcactccatccccaaggcacggggaccccaactactagcctcatctttgagtctagtatatggatgaattaataaacactattgatgatcgagccttcaatgggactaacagataaaagaaagtaacacagtaattagaactgaaaaatcaggtgggaaatccaaagccatttcaatgaacaataatgcaggagaggggaggccagccatctaggccggcacttcacaaacattagcatgcctgactcacctaggcggctccttacattgcagggtttttgttcaggtctgggtgacctggaatgccacatttctaacaggctctaggtttgtgaatgtgctggttcaacgactgcgctctgagtaacaaggcttgagaacactctgtcggtggggtctggctgctttagtccctgaagccccagggtgcggacggtcattagcccctgaacctgtgtggccacatgcagttatgggatggtgtccccaaagatgcagatgtgtatgctttcattcaataatgtttttactgtcagaacaaaaggaaaaatttaacattttcatagaaaatgaggaagacctctatgaatactttcttagacccctggggccttcagactccagtgtgagagaaggttctgggcgattctgatgcatagccaggtttagaaaccagtgttataaaagctttagcagaagtggtgtgaattttgtgcaatgtgactttttcacatgctcaggaactttactcactatagcctgttaggacagtcccctcagtggaacctgcaccacaggcattgtagtccagacagttatcctctttcctgcctgggattagccccaccaccacagccttccccagatcagcagaaaaaccccgggccaggtgtgcatttccctgcctgtttccctgccccgccccctcttggagaaggggcgctgacaagtgaagacagcagctggactggagcttgactccctggctccctagataagtaaggaacagcagggtagggggcggggccagcctgcccctttcagggcggccccaggcctgggcagtgctaacctctggccctgggaaaaacaccagacccttgagaagcagtccttggtcagctctcactgttcagccccagctgcgctgtggtctcgcttggtcccagggtccccctccagccgtcatggagacttgccttactgtttattcttcagtgggttttcccactgccgtggcatcaggatcttctgcagctacagattttcacataggaccttgtttgatgctcacaacaaacccaagagtgggtcatggcagggattccatcttcatgtggcgttgaggtgacaggggccaaggaagcccacgtggctgcccacttcccacagtcgggccaggggaccagtcgtcccagtctgccaggatacaggacttttggtgctaacatgggaacagtcccaggcaaaccaggacaattggtctctctactggtcagtgacagagcagtgactagactgctcactaagttttcacctgtgtaacctctacccggatcaagaaaccaagcactgccaggcccccacagccctctggcacccctccctgttaccaacccccagaggtcaccattaccctcaaggctaatgtcaatgaaatcatacagaaagaagtgtctggctttttttgcttgacatcgtttgtgagactcattcatagtactatgtgtcattgtagactgtttattctcagtgttatgtagtatcccattgtgtgaatataatccagttaatttatccgttctgctttgataggcttttgagtgggttccagtttggccattggaagcattctggttcacgtgtttcagtgaatatatttgtacatttctgttggatatataatctagaactagaataattgggtcatagggcactttattgtcaaatgagagttcttttcggtggaggaacatagtaatttgggcactatgttaccttgtttaccagattacttttaaagcaaagaccaagaactagggcagagttttggaaatggggagaagatagttttgatgctgccagtgcttgggcagagggttgtcaggagggaggaggggtgtgtgtgtggcaaggacccaggccaggtggcactgactcaggctggatcaatcctgtgccacatcttagctcctggacccccactgtgagccactgccctctggggcttttccagcctggctctctcagcatggatggaagtcagggagttcccccggcaagccagggctctcaacagagagcggtgctgaaaacaaacattggcgccaaggagatggtttcctttaagcgcctgctatgcagaactctggagccactgctgggagcacccaaaagaggctctctggtggccctcatggcatcctctggcccactctatccctctctttggagcctagtcatctgtcgggcagtccctgtcagggcgacttccacctttgtaccacagagcccctcctgttctcctttctggggccagtgagagatggagaggccagggagttggaagggaaggcaacagaccgtgtcaccataggacgatgtgactttactctctcccacccagcccagccatcagggcagtttctggccctatagggaaggagcagaatggggtcgtggagcccccacactcttaccccggatcctgaaaggagatagtaggttgtgtgagtacctagagaccttctgaagttagcaatacccatgtggtttctggcaggaagtgagaataccagagagctggaggccacacttccatacgggagaaatcctaagtccacctccgtttaagagccctcctccccctgctgtctccctcccctacttcctggacttggtacttccttgctgcctgtggggaggccacaacagctcttctccgagcccttccctcaccctactccacaatgccttctctcccagcctccctcaagccagagcgaaccagcaatggctgctctgcttcctcctcctgcctcttcctgaccaggcccagcagcacagccttcccattcatgcttgtttgtttgtccaacacccaccgtggtgcagacagctgtcagctgtccctccccaccctggtgtgtggtcgggagatgccaggagggaggagaggtgtgtatggtggggaggcaggtcagctcttctggtgacagctgcccagtcagctgaggaggggtcacagtgccggggcatcgggggcctcctcagaccagggtctgactgcagggctcctcagccagatccagtaacctctgccttccccacctggggctgccgctgccctctctgctgctgagcctggaaatacgctctgattccagccctaggatccctgttccctctccaagcccggccaccaccttcaacttttactaacacaactaaaccccaggtcgctgcttcctcggccagtccacaaaatgatgcacagctcttcctgtggacctactcagccctctcagctctcccaccagagtatcagatggctaatatggataaaagactaaccccttcctagcagtcagtagttccatcagcagatgtgtggtccccttagctggccactggtacagtcggggcatctgtctgctgcttgaaacacaacacagaagccaggtgcagtagtgtgcacctgtggtcccagctactcaggaggctatgatgggaggatcacttgagatcaggagttcaagaccagcctggctgatatagcgagacccccatttcttaaaacccacacacatacacgcacacacacacacagaaagtgtagtccaagaggcatttctgcaccctctgctctcctaaccttctgcccccacagccaaacaggcttccacatcagattccctgggggaatttctttggcaatgagctgagaattaagaaattagaatgccctgcattcatgaccattgtgtttcatcagcacaaagactaatatttgaccactaaaaatcaacatgtagagtctggctgtacttgatacatccagtgaagaaaaagtaaagcatccaaggacttgcccagactgattatagttttgtgaaaaacagatcaatccattagttaaaaactagataagaccagggagataaagaggtgttttaatgctaacattatttgttgaccggttgatttttttaacaaataatgactgttatctagctgggcgcagtggctcatgcttatactcccagccctttgggaggccaaggtgagtggatggcctgagcccaggagtttgagaccagcctgggcaacatggcaaaaccccatctctgcaagaaatacataaggtagctgggcatggtggcgtgcgcctgtggtccctgctacttgggtggcttaggtgggagggtcacctaagcctggggaggttgaggctgcaatgagccatgatcacgccactgtattccagcctgggtgacagagcgagactctgtctcaaaaaaataaaaagaaataataataatgactattttataaataaaaagacaaggctgggcacagtggctcatgcctgtaatgcactttgggaggcagaggtgggaggattgcttaagctcaggaatttgagactagcctgggcaacatggtgaaaccccatctctaccaaaatacaaaaaattagccaggtgtgttggcgcgcacctgtggttccagctactcaggagactgaggtggaaggatcgcttgagccagaggttcagtgagctgagatcgcactactgcactccaacctgggcaatagaacaagaccgcatctcaaaaaaaaaaaaaaaaaattaaaagacatgatcccttatgcaaattctgccacaaagaaaaagttccccaaaaaggtttttaaaaatcctgtaaaaccccaccacccagcaacagcattactgaaaattcaaacaccctctttgtcaacatgctgtgtatgtattatattttttattccagacacatgctctttaataggaagaatgctgggggaacttgggcaggcaaggagccaggcagggtgaggagagtatttcagatggataggctgccaggaaggaggagtgccagaggccagaggcgaggaggctctccctgactgtgcccagagttgcagagattaagacctatctttgcaggattatagttcctaataaggaagggaggtttgcagaaggggaactttctgcattccacagcagggttgtttgcttttcctgccatcttttggagtactgccggacttcccccctctctgtttccagtggaaaatgtaaagaagcagcaggtggctgacaggcaagagacaggctgcttcctgatggggcttgcatgggccacgtgggggtcggggtcacagagacagagagagctgggaggcccctaggaaatctagcctagtccccttgatgtataaaaggagaagctggctaggcgcggtggctcatgcctgtaatcccagcactttgggaggccgaggcaggcagatcacgacacgaggtcaggagatcgagaccatcctgacgaacactgtgaaaccccgtctctactaaaaatacaaaaaaaatagctgggtgtggtggtgggcacctgtagtcccagctactcgggaggctgaggcaggagaatggcatgaacccagggggcagagcttgcagtgagcagagatcgcaccactgcactccagcctgggcaacagagcaacactctgtctcaaaaaaaaaaaaaaagaaaaaggagaaactgaggcccagagaggggaaaggagcagcagataacagtgcagactcggggacaggtaaatgcccacccttccctcatggggacatgaccgagaatgattctctttgccttcttaaaacataaatcagggtcttgctttaaaaaaaaatcccatccacaaagatctattattcagaaacacaaatatgttgattaggatgagacaattcacattgtaaaagctttcttctctttacaaaaggtttcaccagagggttcctcccatggcaagctttttctcccaatatttcaagtggggtttgttctgtcaaactcaaccaaagccttactcctgaagctgtcagtgcttggcttatgatgatggattcataagcatttgggagaagggacattggtaaagccctaacttgacaggttgatggcaggagggccccagacccatctctctttttttttttttttgagattgagtttcgcttgttgcccaggttggagtgcaatggtgcgatattggctcactgcaacctccacctccagggttcaagcaattctcctgcctcagcctcccgagtagctgggattacaggtgcttgccaccatgcccagctaatttttgtatttttagtagagacaggacttcaccgtgttggccaggctagcctcaaactcctgacctcaggtgatccatccattttggcctcccaaagtgctgggattacaggcatgagccaccacgcctggcccccagacccatctcatggggctcagctgagatcagggcaggaacagctacacaatttgcaacatgaaaggtggggccacttgttcaaaccttattgagaatcttgagacgacagcagcagagcattaaaccaagcacagggcctgtctaagggtgggactgtgggcaactgtgctggtctaacacccatgaggctgactcacaaggccctcatgaacagtggggtgagttgttgctatgaaggtgaggtgcacagaggtgagaggtaaggtcagtaagccacaaatctgctctattttgttttgaaattctttaccttataaagtttatttggcttaagctgctggtcacaaagtcattcctgcactcacagcttggtaaggcagtggagggaacccagcagaactgcatgagatctccgggcatggaccgcctccttactgtggaccaggcctggtgccagtgctgaacactgcaatttacttcatctttacagaaatgttaggatagtatagcatttaagaggacaggctctagaggcagatacctggcttccaatctcactggctgtgaatctttgggcaggtgacttgagcctgggctgtgcctcaattccctcatctgtaaaacaaagttataagaattacttgcatcatagggcagtgttaagattaagtgagttcacttgttttaggcacttgacccagtgcctggcacatagaaaaacctcaatgaatgtctgctgccatcatgatgatgatgaggatgaagaagtgaccaccctatagttaaatggcagcttctccattttagaggagaaaactgacacagatcagggaattgtccaaggccatacagcaagcggagaggctgcactctgtcctctgccatggcacctcatagggaagttttctagtttggcataaatgcctcaagttccccgaacctacattgctgattcaaagtccatctatccattgggcacacacttcacttgctgagcctctcttatttgccgggccctcttcttggagctgaaggtgtgtggagagaggtgggaaggaggggacagaagggtgcagtggtgatcactaccatgtgcccagtccacagagagggggcaggagcacgggaggaaggggcttggagaaggctctagcctgggctttggggaataatagaaaaccgggacagagggacttatcagccctgccgcgtaccctgcagaagcccgtaatctaaagccaacctgctgcacctcagcctcacaggtaggtggtgtcaagaggcaggtgaccaagaaaagacagggctgtgaaccacaccctcttttctttccacaagtggaagaaaggcaggtgcaaggcccacagagcatgagtttgggggtggggaggctggccgaccctcgcctttgacctcagttaccactcacctggtcgtcgcgccctctcctagccacacctgctgtcctgctcttgtctctccagagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaagtaatgagttgggatttcagtctttgcttccctactccctgccctgtgttgggaagcaaagggggattcctttgcctgttggggtgccctccttgccaccccgccttgggtcgttcctagcattccctgaggaagggagggtgggcatggtaagagacccgaatgcatgtgggttggggaggcgacttcctaggccctgccccctggagctagacatgggattcaccttcagaggctcagacacctgacttgaaaagcgacacttgaccacgttacagagcaaggggcagctgttctgtgtgaataatgaccacccttcttattttctgggtacagttgtggccagccacagccctcttcaggggctgcaggggaaggaccctctcaacaagcaagagcagaggacacgggcatcttagaacttctctgtgggtcccgatcatatccccagattattattattattctggcttagtgtttttttatatctcagttatttaataactgcctgcttgaatacagccaggtacgttctaacatctggccaaagggaggctatgatcccagaccactgggcttagccctctcccagctcctcctctgttgaggttccccacctgtgcctgctgcagctgtgaacataggaaagtgaacagtgggaggtcagcatgcatgggctgtggggaaaggtcaggcactcaagccctctgggtttcagtagaagattggagcttggagttgtagaggagaccagagtgggaggttggctgaaggtgggcagtgggtgtgcctagacagaatctcctggaaggaactgtcctgggctctgcatgtgtagggagagctgcccagggaaagggagcagtgggactcaggtgagaacagctggcctattgggcagctcacccactctgcaaataggtgactagatgaggcagggcctgactgtaggggtgccgaggagcttggagctatacttggcaatcccagggagcagttgtagccttgccaagaagggtggtgttgacatgggtggcgtgctagagagaaggggaggggcctggctccagggcgggcaggaggctctgcactcccaggtgactttgcagccttgcggggctgccgatggctcccctgaggaagaatggctgttcggggcaggaaggcacagttagttgctgaaggagcaatattggagtgtctcagatggctctgtcaggctttcctgtgatgcaccccactctcagtcctttttagccagttcagggccaaactcccccagaggccacattctacactccttgacaatgagatctttttagccttttgctgtcacagtctgtatcagaaatgggcatgacccaaggagaactgagatactgtgggaagtctaaattctcttccaatatgagggacccccacacccaaggtgcctcaggagatggaaacctcctcagtaactctggtacaaggatggcttttgtcatccaagctttattcactgaagatttggtaaacaaggtattgtgtgtgtatatatcttattttctcatctgaccttgaattaagtcagtaacaggctgtactggatccctctgtgctcataaaatggattcaccaaagaactgatcttattcaaatagatcaagacactaaattcccataaactcttatacccagcctctcttcaaccagaaatcaccacctatcagcacttaaaaaaaaaattccttcctactataaaaataatgcatgaaaattatagaggatttgaagaatataataaaatttaaatcatctataatccctttatctaaagttcactacattttgctatacttctttccagtcatttttctatgtatgttagcatttggttctttaggctttcctagtcctgttacagttaaggcaatggctctaaaatgtttctagatccccagagctttcagaaagatgaagtgagtttcagcgcagttctaaagtagtcataattcataggttataggcaggacctacttctttgagttgtaatggaaaaacctgatattcaacaacaccgtaagacattaaacatgaaagttcagtgattgtcggagattttatcctaggatttaactctcccctcctccagacagggtggcaggaggattaggctttgtgggccccagccctcatgagaggagcagaatgacgccaccctggaatagggtgccagccaatcccagaaacgtctgccctgcagcacttactcttcctcgatcccaagagcaggccatggagcccagtcacttccttggtgcttgggctttcattaacaccaacccatgctggttctggttagtgtgacccagaccaagtgaggagaaaggtgaagagcacagtgatcctgatcacggtggatggtccgggagcaggggccctgggctctgccctcatgaccagggacaggtggcctcccatttctgaactaaccagtggtctctgaggtctcctcctgctcaaaaatctcctgatctctgcctctgtcagaaaccgcctggactgcacgcagtgccttcagcatccatggctaatgaaagataccaagaacatggaggccaagaaactctccaaggaccggatgaagaagtacatggcaagaaggaaatggcaggtaatgagagggtcactttggactgggatgttgcccctcatatttgtgttgttcaagccactttcattcccagcttgccctggcctcacaccaagaaagtttaaatttatttctgaagtagtctgggaccaatttaggcagctgattaaggtacagtggtttgcttagtcctgagtgcagagtccctttctcaaggagatgggatggattcttagcttagctgtctctctgttcctgctcacctttgccccaggggaccgtaaacccttattcagattaagccaatgacattttgtgtcttcatggcttgggatgagcaacatcactttaaggtccatttgtcaaccctgagaatggggtggtagtatggtggtttcacatttctttatgatgaaggagggcacatgatctaaagagagagacatggtcccaccatctaggaaggttgtatgttaatagccatgtgtccttagcaaatgatgtaaccttgctgtggatttttctcatctataaagcggggataatagtggtaccaacttcacagcattgttgtgataattatgagaattacacgagatcatcctcatgtggcctttagtagtacaatgcctggcacatggtgagtgtccagaagcgatcccagtcgctaataggtatgaaggtaggccatctgtcagggaccatttaaagcactatctatgcactaaatcttttaaccctaggaggcaggtactattattatccccactttacagacaaaattgaggcagagaaaaggttaggaaagccatccaggatcacacagctaataagcagaagggtcaggattcaaacccagagcttgactgcaaaacacatagtcttaaccccaagactgcctctgataaaaggcatgggtggataaaattattatccaaaaccacaggatgtttttcagtttatcaccatcatcacctattttatcatttttattaccacaattagaattacaattcttttttttttttttttgagatggagtctcgctctgttgcccaggctggagtacagtggcacgatctcggctcactgcaagctccacctcccgggtcacaccattctcctgcctcagcctcccaagtagctgggattacaggcgcccaccaccacgcctggctaattttttgtatttttagtggagacggggtttcaccgtgttagccaggatggtctcaatctcctgacctcgtgatccacccgcctcggcctcccaaagtgttggaattacaggcgtgagccaccactcccgacctagaattacaattcttaggctgctggagaagacatggtttcttttttttttttttcctcgagacaaagtctcactccattacccaggctggagtgcagtggcacgatctcggctcactgcagcctctgcttcccaggttcaagcaattgagaggacatggtttccttactcagggactacgtagtgcaatggggaactgaagcaactagacatgaaaggatgtaacacgcaccaagatgtataaactatccggatagttctccatagccatgggtgtgtatggatagaacggacctggtcgcaaccagagttggatgtgattatgaggaaatgctcccaggtgcaggagtttgaattaggtgtggaacctcagtcagaatacagagaagaggactgcacaggtggaggagaaggcacagaggtgggagccggacccattccggctgggcttggctggacaggagcagagtcttttagctggatactcaagggacccaggggcattgagactttgcctgggtggcaaagaaaagggaaatcactgtgttggaggcaactggaacactggtcatttaccacaccaggtgactaaatcacagttgcctcagaaagtagagtgtcactcagaggttgaaagagggagcaaaggcgaatgggggccacaagtgtggagtttaagtgaccaccatcctgagcacatatcagctgtgctcctccaccatggaagtcagttcctggctacacccctcatgggaaggtgggtctccaggcctccctcaagtgcaaggtgagttgaaacatctgtagctgcttaccttttggtgccactaggatctgagtagcaaatattctttttaaaaatgtgggggaggatctacaaagtcaaagtcagctgtattaataatcctgtagccagcaggtctcaaagaaatatttctggaaaggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtggtgctgattttttttttttttttttaaagagacagggtctcatgctgtcacccaggctggagggcaatggtacaatcatagcttactgcagtctcaacctcgtgggctcaagcaatcttctcgactcggcctcctgagtagctgggactacaggcatatgccaccagaccggctaatatttttttttctcctttggtagaaacagggtctcactatgttgcctagactagtcttgaactcctggcctcaagcgatgctgctgcgttggctgcccgaagtgttgagtgcccagcctatgctgatattttaatcaatttttttttcttcttgtttacggcattattagccatagggttttctggaagggcgggggaagaaaagggtagaattcagagaatgaaccttaattttatattttagtatagatggcgacatttggaaatgatttttccacaaaattgcacacaaaagttgtccacaaaaattccattcaacaagtagtttccctgaagagtagcttccctggtaacagctctaaccatttcatgttacgttgctccctcaggaaaacgttttctgcattttaactgcaatcaccagggccttagctccccttggaatatgagggttccctcttgcagcagccaaggttctgtgcagtggggtggagtgggctgtgggcgggggcagagggagaggggaagatcaggctcaggtggcccagaactctctgcagctgtgccagagaaggcaccttcttgttattctggtgtggttttcataaaaagccctagaaggaatgaagtgacatgggaacaaatccctacaagcaaagctaggctgggtatagatgactaatcatattactcatcttggaatcaagttattccgaaagaaggtatattttaaatttatattaaaagaattttacaaagatatgttggaaaggtgtagcaatgggggcaggtaggttgagcagattaacagggtttccgcatgcacactggaagcaaaagactagacatcagaggcccttaggtagccatctttattttctgggaaccataaagaccccagcagtatggaccaagggcattaggggagaaaacactggactcagtatagcacggagtattcttggccatcccatttggatggtatgcactgctcaggggaaactgtagtcttggggctactggtatatatggggggctttgatgggtaaccagcttgctgtatgtttgtcagggaatgtcttagtattggtgccaaaagaccctaatcctgggaaactccacaagcctgcctgggcaagccaggatggctggccccacaagctctccaaggggcagggaatttgtgctgcatgaaggaggctggtgcagatactgctcaccagcgacacaggaacccagcctgggcaattgccctcaagcaagaaaaagggagaaattacaaaatcaaaacttggcgatcttgatgttccaaaaatttccaaaggtctttggtcagtaaagcaacaaccaattgtcagctcaaaggcataaaactggaagactagaacatactgatatattcatttctagttctgacaaataacttcctcggcaattttttttcacaaatcaattcccaaatatttttctatgttttagaaattatatgctggatatctccatcttttagaaaagttctccctatgtgagacatatttatttgttaatatatttactacttcctctgaaatactataactcttttgtttcctcattctgatagcttcattttagtcattttgttatgaaataaaatctggaagaaaaaagacatcgtctcgccacaccacacaggtgaagacagtcctcatcagtcccaatcctgatgtctggaattggggagcccatgggctcaaggcgggtgttccttgctacacatttatggatataaaccagagtcgttctgtagaggtctggaactgcaggaagattagaatcttctgctcccaggctactgaggcccagagaggggaactgacttgcacaaggtctcccagcaattagggttagagaactaacctgtcccttgttgggaatgaaccctctgggtttagaggctcctagcccaggacaaaccaatctgtgttggataaagggaatggagagcagagaagggccgagtctgagaatcgggttgattaggaagcaggctggtctgacattgactacgtagggagggctgccatggctggtaccacctcttacctgttcctgagggcagggtaacctcccatgggaagagctgggtctctctctctctacactttgtctagcacaacaaacaggttgaaccagtaacatctcccagaagagcatgaaaggttgccacgtggcctgagcctgcagaggcattctccgcagggccacacggtggttctgcgcacagttaagttgttcagttttcatctctcaccatcttcccctcctcatcacctccacctggggctgcgtggattctgttcagcgacccagcctcactgtggtggcagaggccagaaacatacccacaccatacagtgtgatgtgtgtgagaagggatggccaggggacagagcaaggtgaaatgtctgtccaaagtgcatgagagcagtctgcagcaaggatggcaggaggcatgacagtaaggtcatcccgctcactgcagtaggtctcctctttaaccatacacacacgcacacaattttctgtatgtttccttagcacccagaagttattcactttcaaaatgatcagtctttttactgaagcttactggctttccaactagtcctaaattgtgaggctttactgaagtacttgagcatgtgaagtgaactgaggaggaaaatggctttgccggcagagtttgagatgcaacgagtacaagccatttgcctatgaagaggctgtttcctccctctctcagggaggacaagtagccagtctgtggtgacatctgttgtctagatgcacagcttttcgatgcctaaaaaagatgctttgggtgcaggggtggaaagacttggttgtgccttagttttcttatcttagtcattcctgttaaccttagaaaaaaggtgaaaaacttactgaaagataagaaacaataagacacaattgtacattattagggatcctatgcttggtagaattttcgcaatgtaaataaattacatctcaagttctgatccttttcagcagaaattctttcctctcccaagtctagtcactgagaagcaaagtgccgttgccttttatttcttcaatgcttctttttggtgcctgaatgcacaccaaggaagagctcctctccagagcttcactgcatcacagacttgtgcaggggccagccagagtgtttctcaaaatcttttaagtctctgaattataaacagagctaaatgggaccttggagatcatcttgtccagccccctcctagagaaggagactgaagctcagagtggttaagtgacttgcccaaggtcaacaggatgctgtgttattattattatgattatttttgcatcaggacttgtgggatctgtagtaactattctcttggccaattataatcacatcactggcattgttttacgagaaatagccccgctaggcccagtcagcaataagtctttggagctgtctcagcctgcagttgctttatataaaccatcccttttatgggagttgaagcactgtatgaaaagggtttttgtctcatgttgaccttgtttagtcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaaggtaaggaggagtttctccagccagctggtgagaaagaaagggctggggaacaaaggggcattttgaggttttggttggttttgttcttttttttttttttttaatattccctgcaaggataaattcagaagtaattttgggttgccctgacaattactaagtctaataattattcttaatcgtttaactttaagcttaaccattttcggagggaaagttgttatttgtctaatagaactagatgacctcagctatgctttttcatatattttgtgttaaaattaacaaagattgtattaaaatcttcttttgttcttatggcaaaagtgatattctatattaataggcaaaaataacattaaaattacatgtagttgtgtaagatttataaaatattctattttctaccatctttgtggttttgttttaaataaaaattaactcatatggtccacattctttggcattgttcatgatgctgaatcgtgtcatttgaactgggcagactgggactggcaggtctcctcctggagactaatagggtcagttacttgctcaccatcttagatgctgtcccgtccatctcctcagtgaaaaccccagccttttcctgcttcaggtgcatgcagggccagacccttatctcatttggccagagacaccctctgtccctccctgcctggtgctttttgtatccacaggtgagaatctgagtttagattcccttggtgagcaaaggtagggttattggtgaggccagcaactgcctgctctggagcttcctcacagccagggatagagactgcagcacacaggcctggtccctcctgagccacttctgcccctcctcagatgacccagacatagcctgaagggaagggaggagatacaggtgtccctccaagttacagcttttccctgaaccaatcccacatcctggtccacagtcacacagcatgaaggcagtgtgagcatggagaaagagccactggaagctaaagatgcggctaggacctgactcctcccttgtaaaaagcaggtggaacacctgctgcagaaggaaggcagagggataccaagactaggaaggctgatgaggtcctgccctgctcagataccctcagctgaatcctaaagcagcatgaaatgcagccagaaatcctttttaaagatgatttcctctttcaacatgtcagcataaggggaagggggagtctgatccttcctcagcttgggcacagttccttcttctgccaaaaaccatttggcagcaggccaacctgtccccaggagaaaggcgtgcttatgattcagttctcaaagctgccttctttgctaaatcatagcaacttttttaaaagttagtttctttaagctagaggcgaggcgagaacaacgagtgaagaaatgacctggtcttcttctctgtcttctagaagatgtgtcccaagctttccttgaggctgttgctgaggaaaagcctcatgtaaaaccctatttctctaagaccattcgcgatttagaagttgtggagggaagtgctgctagatttgactgcaagattgaaggtaagttgtagctgtgcttctcttcaccatgaatagggtgtggctggatggtagagtccctaccatgcaccgtgggcaagaagtcagttctgtgcagctggggacaatgaggaactgccaagctttgggggaaactgggtcagcaggagctgctcataaagggctatgccctgcactcccacctcctgaaggtgtgtccttcagtcacttccccagggggcacatttgaaatttcacctacttacatcagccactagacctaagtttagaaatggccttgcatggacttacctggctttggaacatgcttagtgaaatgagctttgcaaactgctgaaaagcatgtgacttgcccatatgaggccctcaaaggaaggctggcacaaaggcataggatgtggaatcggcaggctctgctactcgtccacaggctgtgtgaccttggatggtggtccaactcccctgagttacggtccctctgctgtaagatgatagctaagtcacggagtggctctggggattctgtgaggggacatatgtgagaagggggaaccttttagatcttgtaaagatgtcacagagcaaagggaaaagttgtgggactggcaggtacagagagagtgcatgcattgtgacttcagactgaggccagttgggagccaggcacccgggacaaagcactcagccggcaccatcttccccaggctgcttatctgcctgctgggaataatgcagccacagacctgtcagtggtcagagctcaagggaccttaaggggtcatggcatagcacctgagaaatgagcaaagttgatgacacaaagcgtttccattttcatatagattgcaaccgtctagaaagagaagggacaagataagacaggctctttgcttcaagtctgtgactttcacctgccaaccagggtggtgggttatcacccattttggtctgaccaaataaagcacagaagtttattaggcaactttcccgaggccgcatagcacagtacagcagtcaaaacaaactgtgcctcccactttctttgattctccagcaatgtgactagacaatgccttttgagtaaaataacccaaagttaggaatggaaaaaatagtttttcttctgcatctttatattatcaaagtgccttatcaatgcttcgcctaccatagtcattttcctttcctcactcaattaaaagaaagtggatgtgctgcctttgataatgtgaaaattctcggactggggattctgctgaaggctctggagccactgcttgcaattctcaccattaccattgcatttgggtcttctgaagtttcttttcctttttgaatgttttaaaataacataatgattatcattttgtacttaattttctctttgggattgtttcgtacttaattttctctttggaattgtttcattgatatttatgtaacttttgcctggggctctgatgagaaattaaagcatatggatgctgttttgataaaaacaaaattgaaacttttgcactgagggtgcagggcatgggagtggagggtactttatgaccagctcttcctgacccaattttcctcatggtctgggtgttcctaattacttcgaaaaaacaatttctaaaattattttgaaaaaacaacattgaaaagaacattagaattcttgatttcttatgtataatttttattctggttagggctcatattagcctgtttgcattgctataaaggaatacctgaggctggaaaatttataaagaaaagaagcttatttggcttggtgccagtatctgcatccagtgaggcctcaggatgcttttaatcatagcagaagcaggcatgtcacatggcaagtgagagagcgagagagaaggacgtgccacgttttaacaaccagatccgcatgaaatgacagagcaataactcacccattacctcgggaagggcaccaagacattcatgagggatcggcctccatgacccaaacacctccca

SEQ ID NO: 17192 - DNA, 107937 bp, Human
  misc_feature (1)...(107937): n = A,T,C or G
ttttattgaagatgccacattctctacttggctgattgcttccttgaagtatttaacttttttctctgtttcctgtaaactagcacatagatcagatctaaagccttgattagattcaagttcagttttgttttgtgtgaatggtaagtactgactattgcatttcatgaggagacacataatgtctgatagtcccacttttagtaatgctaagatcaggggattcctgtagtgtcaacaagacagacacggacgattgtaaagtttcttctcctttcaccttattattatttatgtctttagcatctattaatgatcattgcctagatctgttagttcattagcacttgcagaattgtgattttctaatttattattctttttccatttattagcaaaagaagttctaaaaattgttttttaatttttatttttttaagacagggtctcactttgttgtccaggctggagtgcagtggtactattttagctcaatgcagccttagattcttggactcaagcaatcctcatgcctcagtctcccaagtagctgggactacaggtatgcaccactacgcctggccaattttttgtatgttttgtagagacagggtcttgtttgttgcccaggctggtctcaaactcctggactcaagcaatccacccatctaagcctccccaagtaatggtattacaggcatgggccactgtgcccggcctcctgtctcttttgatatgacactttcattaatggcataattgttaaatgaaccttggttcatttaactttagcgctcatgttcttccaattattattgttgtatcttcttgaaggaagcccttaaggaataggtaagacttaaatggcactattaaagggtgcatttgttgggatagtgcgtttgttttgatatgaggagtttattcctcatgtgaacataggtctagcagcaggaaggcagaaggcactgtgataccagtctcgggctgtagagtgatgggagagcaagaaaaataggccagagaaatagcacaaggggccttgccatctgtattgagcgatttggtgtttttaatgcttaggggatgggccgtgaggttgatagaaaattgtccttgttggctgggcacggtgggtcacgcctgtaatcccagcactttgggaggccaaggcgggcggatcacgaggtcaggagatcgagaccatcctggctaacacggttgaaaccccgtctctactaaaaatacaaaaaatttagccaggcatggtggcaggcgcctgtagtctcagctactcgggaggctgaggcaggagaatggcgtaaaactgggaggcggagcttgcagtgagctgagatgtcactactgcattccagcctaggcaacagagagagactccatctcaaaaaaaaaaaaaattgtccttgtagagaaagggccctcttgattgcaaattgttcttgttgagagagggccctcttgattgtcattttcattggaatttgcagagaaaaactcagcctaagaagctaatattttctaaataaagtttggagaaaaatcacctgtcaagtgctggttaactaaatttcttaggaccctgtaatccttaagcatgcagtttattcagatgtcaaatatctatgttgaatttgaatcaatgtggtgtgtgtgtgtgtacatatgtatgtgtatatatttttatttatatgtatataagaataatttttttcctttagttggtggtatggattggataatgtacatatatataatttgtgaagtgataaaagtgtatttaaataatttatttctgctgacttactcttggtttttaaaatatcacattatttaattggcctcctgttacattattggctatattgaaatctaaggactaattgtagattagtggtctttatcatatcttggtataaaatttggctgatggttgttttgctatgttttaattactgatttctagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcaggtatgttaataggtataatttctatgtgtttagcatactgtgtcacttgggggaaatatcattctataatagaaaatgttaatgtaaattatatgtgataatgatagtaatgaagtgatggtaattaagaaaaattagtttatgttagctagtttgaaatgtttgtttgggttattaaaactgtcaagaagattttcttttgagttcgtctttgaaattactgtctttgagcttgtcacacttttaaaaatgtgatttttggttcattttctcttctctcctttttcttctcttccccctttccttgactcttgggggaagaaagacttttctgctgttcaccagatatttttccctcagcaggcttgccttttctgttgcattagtttttaaagtaaattgatgagcaccgttgatttgtaaaaaccagcatatacatgaacttgtttttctaaactttctttctaatgtttttcaaaaagctgaacccaatgtgaatatcaggagttacggtatttttaagaaaacatatttatgatatacctctgaaaactcttggctttggacaagcctcttaactcctttccaagcttcttcattagagaaactggaattctaaaatggcatgatccttaaagtaaaaagaaaatacagaattgacttaagcatctcatacgctcatgcatggtgcacctatttttatagtcaccagtgacaagtatggattcctatggctatacttcacattagattaaccatttatctctttttaattgtgaaatatacataacctggaatttactatttagacatttttaggtgtgcattcacagtgctgtgcaaccatcaccagtatccatttccagcacttaaccatcatcccaaacagaaacttcatacccataactgcccctttccctcaattcctttttatttctattctgttttccatctctaccagtttgcctattcttggtactttatataagtggaaacatacaataaatagctatccttttgtagttggcttgcatagcatagtgtttttaaagttcatccatgttgtagcatatatcctagtttcattcccttttatggctgaataatattccattgtatgtatatgccacattttgtatatttatctgttgatgaacatttgggttgcttccagcttttggctattgtgaatattatgctactctgagcattggtgtataaatgtctgtttgaattcctgctttcagttcttttgggtatatacctagaagtgtgattgttggttcacagtggtaattccatgttttaacttttgaggaactgccacactgttttccacagtggctgcaccatataatgttgggaccagcagtgtacaagggttccagtttgtctacatactggccaacacatgctattttctcctcgctccctccctccctctcttcctccctccctctcttcctccctccctctcttcctccctccctctcttcctccctccctccctcttttcctacctcccctccttcctctccctctcctcccttcccctcccctctctccctccctcccttcttccttcctttcttccttcctcttttcttacattatttctttcctttttttgtttgtctaagagatacgatcttgtttgccatattttctgtgtgtgtgtgtgtgtgtgtgtgtgtgtgtgtgtgtgtgtgtttaatagtatccatcctaatggatgtgaagtggtatctcattgtgggtttttttttgttttttgttttgtttttttgagacggagtctcgctctgtcgccagactggagggcagtgtcatgaccttggcttactgcaacctccgcctcctgggttcaagtgattctcctgcttcagcatcctgagtagctgggactataggtgcacaccaccatgcccagctaatttttgtatttttagtagagatgggatttcaccatgttggccaggatggtcttgatttcttgacctcatgatctgcccaccatggcctcccaaagtgctgggattacaggtgtgagccactgcacccagcctcattgtggtttttatgtgcatttccctcatgactaatgatgttgagcatctttttatgtgcttgttggtcatttgtatgttttttggagaattatcttttctagacctgtactgatttttaaactttgttttctgttattgagttgtaggagttctttatatattctggatattaatatcttgtcagatatatatgatttgcaaatattacctcccattttgttggttgccttttcattctcttgataatgtcttttgctgtacagaagttttaagttttggtgaagttcagtttacctttttttcttaatgttactattttgagcctttagaatgaaaagtttacctatcattattattattgttgttgcttgtactttctcctgtatgttttatgtaactgaatctgagctgaggattggccacaatttttaactcaggtctgttattttcagctcttagcttttgtactggctgttaacaaaatatgcaatccctttttgtttttgtgtggtgaacttcttttatattatctcatccaggagacatggaaagagatgttgagagattgattatgatcattctgacaggacagtgttagtaaggatacccctgataaaagaaaagagtgcaggacaaaaataatttaaatattgtatggaggtggtgatacatactttaaattaaaatttttttttgattactcctgatcagtagtttctgcttacaggaaagtgaaatatgaaagttttcattgagtcttacttgtcatagataatttgcttttagtaatttcatttataatgcattttttgtgcactatgccattatattaccctacaaacatgggataataccatatatactctcctataatttgctgttgtaagaaaacttgaatattttgtatggttttccatttcagaatgaatttatatttttttctatttttctgaatatatttctattattttcaccgttctgtaatattctataattcatttaaccaatcttttattgctaaacatttgatttgttcatagttttttatttttacaaacagtgctgcagtgagcatccttatatctttgtacacttgagcaagtgtttccattccagaaaatgtcttattttttctcatagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtaaattaaaaaataaaaaaaaagtacaaattcttaatatatctatttatataaacatatagtaagtatatttaagacattgcttttcaaagtgtggtccatggaccactgctgatctgtaaattgttgccagtttgagataaggtaagtatagaaattgagaataaatgtttagaaacccctttagcaatatgatattgccatagcatccaagggcttatgtttagtatatgtttttgttgtctaatgatttattatttatttaatttttaaaaatagagacagggtctcactgtgttgtccaggctggtctcaaactcctgggctcaagtgatcctcctaccttggccccccaaagtgctgggattacaggtatgagccactgtgcatggctgatttatttttattttacaaaaatattgatctttgatggattggaaagaaaaaagttgttgctttacctcagattgtttgagaagtccttgactaaaggagacattatccttagtttcttatgaactgctcctatagaatgaacatattttatacacaactctctatgccaaccaagactttaagctgtttgatgtttccataaataaattattgacaaattttacttcttaactgaaattatctttaagtagaagttattttggtagagagtcaggaaatatcatgtccacattattccttgcaaatttattccatggaaaattgtgagtaacacaatcaagaacatggaggagtctctcttgctatataacattaggagtctcaggggctaatgttttatcaatatcttgctttagagagggtactgacttgaattaggaactacaaaaggttactgaggaggggactttatagtttaaatacaaaaccagaaaatccactggagatttatgtatctagattgggtacctgtattgatcagattcactgttataggataatatagtaccatcccctttaaaatactattctttgatcttaaccctataataattcaggctagctaatgattatactgtgggactactccctctgagtgcatagaaccttgttagtttactaagggatactctgatatttaaaaatatttgattacttcagagggtggctagtttatttttggcaataaatttttcccagttaacaagtttatagttatgtatcatacaaaattttttcttatatattagtgacatataattagaaagcattattagaaagcatgcctttctattttctagagctacaaaggtgtgttttgttttgtttgttttttgtttctgtttttgtttttttggtgacaaggtctcgccctgttgcccaggctagagtgcagtggtacgatcatggctcacttcagccttgactcgaccctcagtcgcaagcgatcctcccacctcagcgtcctaagtagctgggactacatacagatgcaagccaccatgcctggctaatttttgtatttttattatagtagagacagggtgttgcccaggctggtctcaaactcctggactcgagctgtctgcctgcctcagccttcagagccacagcacctggcccaaatatttttatagaatttaaatttttgtccattataaaaggttttccctttgttctcatgcccataaaaagttgaagaatatatggaagaggagaaagaaagaaaaaaaatcacttatagtcttatcatccaggacaagtatattgaccgacaatattttgatatatttcttttgaataaattatatgtatttcaaggcttttatttgtttttgtttctgtggattaaaatacttagcttttctgtattctcatgctaatgtaagaaagcaaaccagaaccacattgatttttagggaagctaaaatatttgttaatccaaaaagtaccacagagtaggccatgttctttttgatttttttttcttttttaaatagggtctctctctgtcacctaggctggagtgcagtggtgcgatctcagctcactgcagcctcaacctcccaggcttaagtgatcctcctacctcagcctcccgagtagttgagaccacaggcatatgccaccatgcccatgtagattttagcatgttgcccaggctggtatcaaactcctaagctcaagtgatccacctgcctttgcctcccaaagtgctaggattataggtgtgagccattgtgctggcctttttatttttatttgtatttatttatttgatacagagtctcactctgttgcccagactggagtgcagtggtgcaatcttgactcactgcaacctctgcctcccaggttcaagagattctcctgcctcagccttctgagtagctgggattacaggcacctgccaccatgcccagctagtttttgtatttttattagagacagggtttcaccatgttggacaggctggtctcaaactcctgacctcagatgatccgcctgcctcggcctcccaaagtgctgggattacaggtgtgaaccactgcgcccagctgtttttgtttttatttttaaattgagacagggtcttgccctgtacccaggctggaatgcagtggtgcaaccaccagtcactgcagcctcagcctcccagggtcaagtgatcctcccacctcagcttcctgagtagctgagtgcaagccaccaagtctggctaattttttctttttttttgtagagatggaatcttactgtgttacccaggatgtgggccaagtttcttcaaggcattggtatctctctgaaatttacctccttcccaacatttaccaaaacatggattcattggccaccattacctcttcctatgcctgccaaatgtggcaaataaaaatattgaagattgaaatattacatatgctgtgcttatgctaaaaacatattcattgtttatctaaaattcacattgaattgcgcatactgtttttttttaacctggcaaccttaccttttatcctaccatagcataggggtataatctatattagactaatgaatttaattttttctttttttttttctgttgagacgaggtctcactctatcacccactctggagcatagtggcgcctttttggctcactgcaacctccgcctcccaggttcaagcaattctcccaccttggcttcccaagtagctgggactacaggcatgcaccaccacgcccacctaatttttgtattctttggcattttgattatatacacaaatttaaatgttaacatttatttaagaaattgagtaagttgtgtatttaagaatgaattttcacttttaatacttgagaagtcaagtcaatttttgcagttgctgatttgtctgtgatgaccatggcttgatgaggccatgcctcctgggaaaaaatatacaattatttcagtttaactttaggaacaaggttgccacctcctctctccaaagaaaacaatagaacctttagagacgtaattgccctgactaggctaaaaataccttttcctgaaagatgatgtggctaatcttttttttttctgtgtttattccaaataattatttacagagctgttgtttgagttctgtttgttctctgtagtaaggtgtatgccaccccatattaatttctccaaacactcagtaaaagaatcgtaatcagaggattttgttagcattctgaaaaacatatttgtaaactcccttatttctcctgacctatctaaacctgtggtataccttaagtgagggaaatagctagtctgtaggattttttttttttttttttttatatacagagtctcactttgttgcccaggctggagtgcagtggcgtgatcttggctcactgcaacctctgcctcctgggttcaagtgattctcatgcctgagcctcctaagtagctgggattacaggattgcatgactacacccagctaatttttatattttttgtagagatggggttttgccacattggctaggctggtctcgaactcctgacctcaagcgatctgcctgccttaagccttccaaagtgctgggattacaggtgtgagccaccatgtccgacctagtctgtaggattttaacaccctctttagtatgaataaattgttcactcagtactttttaaatataaaaattatatttgactataaattttacagtagccttaaggaaaatttaagctttgctgttagattctcttacaagaaggtatgtagggtattaactaggtttaaaattaaattacttagcttaaagtgttcgttatttttgataaaatttcttttttttttttgagatggagtctcgctctatcgcccaggctggagtgcagtggcgccatctcggctcactgcaagcttcacctcctgggttcacgccattctcctgcctcagcctcccgagtagctgggactacaggcacctgccaccatgcctggctaattttttatatttctagtagagatggggtttcactgtgttagccaggatggtctcaatctcctgacctcgtgatccgcctgcctcggcctcccaaagtgctaggattacaggcgtgagctactgcgcccggcctaaaatttctgtatttaagagatctttatggtggttcccaaatttagattgtatcagtttcttaaaatgaatatgctcagagattgggattcagtgtgtctggaataaatgaaagctgtatttttttatgtgattctaacagttacatgaacagggtcccttattcataatatattgaaaaacattaccaaaacattagtgattgcagttcagtagtattgagtgtttatacttgaaattttaccagtgaccgtgggtgatatggtctctgcttagacctcacaatccagtgggaagtgaggatcagtaaacacagttttattgcaatgtattaactgctatgctatgtcagaaagggtcaccttcaaatactgtgtgatctcacttaaatgtggaatctgaaaaagttgaactcaaagtaaacagttgaatggtagttagcagagccagttgggggcatagaaaggggtgtattgggctgggaaaggggagacattggtcactgggtacaaagtttcagttagcaggaataagttctggtgttccattgcaggggttctcctctgctccctgttgctggttaggaaccaggccgcacagcaggaggtgagcagcaggttgggtgagcattaccacctgaacttcgcctcctgtcagatcagtggtagcattagattctcataggagcttgaatgcgaagaatcctattgtgaactgcacatgtgagggatctaggttgtgtgatcctaatgagcgagaatctaatgcctgatgatctgaggtggaacagtttcatcccaaaaccacccccacccccattctattgcatagcaccgtgactatagttaataataatgtattgtatgtttcaaaatatttatgagagaatttttaaatgttctcttcacaaagaaataataaatatttgaggtgatagatatgctaattagccagatttgatcattccacaatgtatacatgtgtcaaaacatcacattggccgagcttgggggcttattcctataatcccagtactttgggaggataaggtgggtagatcacttgagcccaggatttggagaccagtctgggcaacatagcaaaaccccatctctacaaaaagtacaaaaaattactcaggcatggtggtgtgtgcctgtagtcccagctacttgagaggctgaggtgggaggatcacttggcttgagcccagaggttgaggctccagtgagctgtgatcatgccactgcactccagcctgggcgacagagtgagaccctgtctcaaacaaacaaaaaaactctatcacattgtacctcaaaaatacatgcaattattatttgccaattaatgaaaaacaaaacttttgaaaaggaaagtcaccttaaatcaattaggtgaatcagggatgacctcttagaagatgtatacctacactgagccatcaatgctgattaggaatttggcaggtaaagagaggtggagaaaggaaaaaacaaaaagaaatggcacatgtgaagaatggcctattcaaggaaaagaaattgattatgggtggtgtagggggacagataggacaactaggaaagactagagaggcagccatctgcagagcatacagtgccatccaggccatgtaaaaagtagagctttactactaagaacacttgggaagctattgaagaaatataggtaggggagtaacgtgataaatttgcattttagaaagattatttaggttgtagaatgaagagtggattggagggattaagaatttgaatagagaaattagtgaaaaaatgttgtaacccaaaggaagggtgatgatggccaggattaggttaatgtttacaggaattgagagaagtggacagagttgagagacatttagaaggtgggttaaacatgatttgtagcagattaagggaaataaagcatttgatttttgttagatgtatatattattgggtacttatttccctttcgtcacctgtaatacctattgcctgtgaatagaatgaatattaacagtgcactaaaatgcttcagccattccacccaaattacagtccattcatagctaatttagagtaatgtattttattccagatctaaaactatccaggaaatcattttacctttgctgtgttatacctttgctgtgttttatttttctatatttaataccacaaaattgattctaggatatatttttgaaataacaactattgttttcagtgcataaaagtaaaaagacaatgcaacccttactgacatgcatatgttcaaatagtatagtatagattaattttatggaataaaaagtaactttcctcactgtgcattcctccctaatactacaaaataccactagcaatagagtcatctcaagtatccaaaacaaaaacttatgcatattctgtattcttccttttgaattttcagaaaagggattttacctgacccattctctacctacttttaaaaaatatctggtgcccttaaaaacacaaagattgattgtatttttatctcctgcaccactgtataatgatacatggatgtatctttatttaaccagtcctgaatgatggcctttagattacattttaattattatacacaaaactgcagcaaatattcatatattgatagtatatccataggtttgtagaaataaacaaagaccactcagatgagaacagagactatttatgcagaggttgctatagtaaaagaacttgagcttggcagagactcagaggcaggcaggggagtgggaaagctttacagtgaaaaaaaagggaaggtttcagagatgcctgatgggaaattattggcagcagggagctggaggtgggctaattagaagcaaggcatcttatgtgattggtgttgggttagtatacttggctttcttcgttggtcctgaatctctcaggttgagattacgattgataaaattgtgaggtctaaggatgtgtgtgtgtgtgtgtgtgtgtgtgtgtgtgtgtgtatgatttctaataaatattgcaaaattgccctccaaaaagttcatattaatgtagtttctcaacaaaactatactagaatgcctttttctctctgccccttccagcacagggtattatcaaattttaaaatatgtgccaacctgataggtaaaaataaatgcacacataaacatttatgtatgttgattcattcttttagatttctaaaattatttactggaataatcataagtttttgaaaaagttgtcatatataattgtcttaatggcagaagtgactaaaaattaagtacaacccatccttcagcaataggtttgaactgtgcagggccacttatacgtggatattttttaatacgtatattgaaactttttttgagatttgtgacaatttgaaaaaacttgcagacgaatcacagcctagaaatagtgaaaaaattaaaaagttaagtgtcattaatgcatgatatgtatgtatcatttactaccataaaatacacataaatctattataaaaagttaaaatttcaaaacttaacatacacagacatttagacaaccatacatggtgccatttgcagttgaaagaagtgcaaacaaatgtaaagatacagtattaaatcataactgcataaaattaactgtattatactactgtaataattttgcagccacctcctgttgctattgtggtgaggttaagtgttgtgagcatatgctcagaaatgccatgtgactctaatcatctccacttgagcagtttctctgtctagtaaattgcatattgcagtaaaaagggatctctccgagttctcatgtattttttaaattgtgtttactggaatactgcaaaccttgaataacactgtgggacccatacaaaatgctacttgtgatcctggaagtacttctaagaacagagaaaagtcatgatattataagaaaaaagttgaatgcagctagggtgcacaggctgaggcaagaggattgcttaagcccaggagttctaggtactagtgtgctgtgattgtgcctgcaaatgccatatatatatatatatatatatatatatatatatatatatatatatatatatataaaggctgaatagcttgatatgtactgtagatggaggtctgcagctgtggttgcctgccatttcgagataaatcaatccagtataagtaccattgtgaaaaaacaaattcatgaaactgtcgccgcagctatgtcagcaggtgctaaaccttgcactttttgtgaatcacctttttatctcagagtaaaaatgcagcttgtatgtgggtgcaggattgctataagaaaggcataccaatagactctaatctgattcaagaaaaggcaaagttatgtgacaaagcaataagaaactgaaggatctagtacaggagaattttaatgctagcaaaggatggtttgacaattttatttttatttatttttatttttaattaattaatttatttatttttgagacggagtctcactctgtcacccaggctggagtgcagtggcgtgatctcggctcactgcaagctccacctcccaggttcatgccattctcctgcctcagcctcccgaggagctgggactacaggtccccgccaccactctcggctaatttttttgtatttttagtagagatggggtttcaccatgttagccaggatggtctcaatctcctgacctcgtgatccgccctcctcggcctcccaaagtgctgggattacaggcgtgagccaccgtgcccggccgatttgacaattttagaaaggtttggcataaaaaaaatcaaggtaacaggagaagttatttttcctgacctagaaatagcagatgagttcccagatgccattaagaaaaatcactgaggagaatagatacctgcctgaacagatttttagtgttttgtttttgagacaagatctcactctgttgcccaggctgtatccttgccctcctgggctcaagtgatcctcccacctcagcctcctgagtagctgggactacaggcatgcaccaccatgcccagctaatttttaattttttgtagagatgaggtctcactatgttgcccaggctggtctcgaacccctgacctcaaggaatcctcccacctcggcctcccaaaatgttgggattataggtgtgagctgccttgtctgaccctgaacaagtttttaatgcagatcaaagtgcccaattctggagaaaaaaaatgccacaaaggtcatttattaggaagagaagtcagcaccaggatttaagacaggaaggctaactactgttttgtgcaaatgcagactagtttgtgatacactttatttgtaaagctgctaacccccaagcctcgaagggaaaaagaaacaccagctgccagtcttttggttgtacaacaagaagacctggacaataagaaccctttttctggattggttccatcactgctttgttctgaagtcaggaactactttgccagtaaggggctgcctttttttttgagatggggtctcacttcatcgcccaggctgcagtgcaggggtgcgatcttggcttactgcaacctccgcctcctgggttcaagcgattctcctgcctcagccccccaagtagctgagattacaggcacacaccaccatgtctggctaatttttgtgtttttaatagagatggggtttccccatgttggccaggctggtcttgaactcctgacctcaagtgatccccccaccttggcctcccaaagtgctaggatgacaggaggattataggtgtgagccactgtgcccagcctagggactgccttttaaggttcttttgatattggatgatgcccgtggccacccagaaccccctgagttcaacactgaaagcctcaaagtgatttacttacccccaaacacaacatctctaatttagcctatcaggaggtcataaggacctttaaggctcattactcatggtactctatgaaagagaacctggatagaacatcatgaaagtctgggagtattacaccactgaagatgccatcgttcatatagaaaaagttgtgaaagctatcaaacccaaaacagtaaattcctgttggagaaatctctgtcccgatattgtacatgacttcacaggattgacaacagaaccaatcaaggaaattaagaaatagattgtggtatggcataaaaggcagcagtggtggtgaagggtttcaagatacagatcgtggagaaatccaagagctaataaacaccacatgagaggaattaacagaaaacaacttcatggagatgagtgcttctgaagcagtgccagatgatgaggaagaagatgtagaagaaacagtgcccgaaaacaaattcacatgcaacagtctgacagaaggcttctgattattcaagaatgctttttacttcttttataatatggccccttctatgataccagcactgaaactaaagcaaacagtggtaggattggtactatacagataaacatttttacagaaaagaaaaagcaaagaagtcagaaattatgatgtatatctgtgaagttacatacagtatgcctgcgtctgctgcctccccttgtacctccttcactcttctgtgtctgccacccctgagacagcaagactaacctctccccctcctcctcagcctactcagtgtgaagatgatgagttatgaagacatttatggtgatccacttcctttttttttttttttttttttttttttttttttttttttgggggagtctcgctctgtcacccagtctggagtgcagtgacacaatctcggctgactgccagctccgcctcccgggttcacgccattctcctgcctcagcctcccgagtagctgggacttcaggcacccaccaccacgcctggctaatgttttttgtatttttagtagagatggggtttctccatgttggtaaggctggtctcgaactcctgacctcaggtgatccacccgcctcagcctcccaaagtgctgggattacaggcgtgagccactgcgcccgaccaatccacttcctcttaataaatagtaaatatattttcacttctttgtgatttatttaataacattttctttttttctaatcagaagagtgctggaataattaacattttctttagcttactttaggaatacagtatataacatgtataacatacaaaataagtgttaactgactatgttgttggtaaggcttctggtcataagtaggctattagtagttaagttgttcaggagtcaaaagggacatgtaggccgggcatggtgactcacacttgtaatcccagcactttgtcagactgaggtgggaggattgcttgagcccaggagttcaagacaacttggacaatatagcaagacctcatgtctactaaaaatttatccagacatagtggcatgtgcttgtgactgtaatttcagctacttgggaggctgaggtgggaggatcgcttgagcccaggagatgaaggctacagtgagccgtgatcacaccactgcactccagcctgggtaacagagcaagattctgtctcagtgaatgaatgaatgaatgaatgaatgttatatgtgaattttctcctctgtagggggttggtgccccatccaccatgttgtttgagaatcaaccaaacaataaagaacaattttatgtttatgggatttttgactaactaaaacaatatatgataaccatttaaaaatcacaatgaactgaaaattcagtctataaaatttaagtgtactaggttttctttggtttgtttttgtttttttaaagactatgaacagttttaggttcacagcaaaattgagaggaagatacagagattttccgtattccctctgcccctgtgtattgtagccattcccatagtataccaagttttggtgaaataataacttgattcttagttttcttctaatatagtattgaaactgtttttcagattcttagtctttctcacatattttaaatgtgatttattaatacttggtttgtaaataaaaacaatgaatcttttatgtgtggctttaaaatatgtattgtgaattactttgtaaaactggtaggcaaactacatttctttatgaggttttgagttgtattttttaaaaaaatataattgtatgtttgtcttctgtacatgagatttattgttttatctgggttttttgatctttaatggtattttcctccctagtttcatctgcttgataaaagccaagcatccaacatccaagttagtttttgttgaatatactttgtattctttctatattcttttattattgttagttactgaaaatgacacctttaaaaaatgtgtttaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggtaggattatatttttttaagaaatattttgtaataaatttctcatttttacccgaatacaactgcatttttagaagtgtctgtcgcttgcctagcaaacactattagaaagaacaattttatatttcagatagaaatgtatttaggattatatataatagtctaaagtgatattctgtacacgtatctgttttgatacagtggaatggtgatttagaatgggattggcaaactggactgtttaattggtttttacagttttaaagggatgttaaaaagagaaaaaaacctcaaagatttgtaaagggatgtttaaaagaagaagaagtaaaaagaatatgcaacagagaccactgtgttgtatgttgtttgccaaacctggtcctttacagagaaagtttgccagttgctggtctagatagtgttccttattggaaatatttttttctcatgtgacttttctcccccatcggtagaaatgaaagcctaatcaaaatggtctctttgtttccatattcttaaatttgcattctgtgactatgtgaattaattaatgatatggaagtaggcattataatagagttgatatacagcccatccatttctgaatgttcatagcaattatacaaactagatgatgctactactgttgtatcaagtatagtggttctagcatctagggtctggcattagattaaggtagaaactcaaggatttttttttttttttttagacggagtcttgctctgttgcccaggctggagtgcgatggcgcaatcttggctccctgcaacctcagccccccagtctcaagcaattctcttgccgcagcttcctgagtagctggaattacaggcgcctgccatcacacctggctaatttttgtatttttagtagagatggggtttcatcatgttggcaggctagtctcaaacttctgacctcagatgatccacccacctcagcttcccaaagtgctgggattacaagcatgagccactgcacacagccagatgttttgttttgttttgttcttgaattactgtgaataaccatagcaatgacaacaaccaattatgcagggtaagtgctcaatgacttaacagtcgttgttctgtgttgagcacttattctgcataattcctggtatggcttatttttcatatattctccagttcccacaccaaccttacaagtgttgttgtctttcccccatcttacagtgaagagactgaaaggaagacaagtttagtgttttgtgccagtcctcatagctggtcagtggtagagccaggatttcatccaggtgtctctggttttacccagttttgcctccttttagacaacatgttaataagtatttgttaggacagatgtgaaaaaaagattctgccttcaggcattttctctaaacaagtaagtttatctagggaaaaacaccatttgtcattctgtcctgagatacgttgagtctaaagttcaatttaagtcaagatttgagtatcattaaaatgtcaaggtcaaatttacaatactgtttaaggaattctccgtggtcaagagaggtagaataggggaatttactgttgaaaggtgatgagagttcaacttgagaacactggctttaccaggtgaggtggcgcacagccactttgggaggctgaacagggaggatctcttgaacccaggagttcaagaccaggttgggcaacatggtgaaaccccatctgtacaaaaattacctgggcatggtggtgcacatctgtagtcccagctacccaggaggatgaggtgggaggattgcttgatcccagaaggcggagtttgcagcgagcccagattgcgccaccacacttcagcttgggcgacagagggataccttgtctcaaaaaaaaaaggtacaatatttcatgaagtcattgaaagtgataatgaacaactgcttgaaatatgggaaaactattaggatataagatcattggtgtcttactgggaggtgaggtcaaggaggaaagaggaggcatgcgacttctcaaaatgattcctagcatcctagcctgtgttctttgatgtgtgtgacactgtcttagtctgtttgggctgctgtaacagaataccatagactgggtggcttataaacaacagaaatttatttctcacaattgtagggttttttgtttgttttgttctgttttgttttgagacggagtttcactttgtcgtccaggctgcagtgcagtagcatgagctaggctcactgcaactgccccgtttcaggttcaagggattccctgactcagcttcctgagtagctgggactatagacaggcgccaccacgccatgctaattttttgtatttttagtagaggcagggtttcactgtgtttgccaggctggtcttgaactcctgagcttaagtgatccacccgctttggcctcccaaggtgctgggattacaggtgtgagccactgcacctggcctgtttctcacaattctggaagctgggaagtccaagatcaaggcaccagttcattccgtgtcttatgaggattgcttcctggtgcatacataactatcttcttgctatgtccttacgtagcagaagaggagaggaagctctctggggtctcttttattttttttttttttattttttgagatggagtctcactctgacaccaggctggagtgcagtggcacgatctcggctcactgcaacttccaactccctggttcagggattctcctgcctcagcctcccgagtagctgggactacaggcaggggccaccatgcctggctaattttttatatttttagtagaggcagggtttcaccgtgtttgccaggctggtcttgagctcctgagcttaagtgatccgcccgcctcggcctcccaagatgctgggattataggtgtgatccactgcacctggcctgtttctcagaattctgaaagctgggaagtactagatcaaggcactagttcattatgagggattgcttcctggtccatacgtacctgtcttcttgctatgtccttacatggcagaagaggagatgaagctctctggggtcttttttatttattttattttattttatttatttttttgagtcggagtctcgctctgtcgccaggctggagtgcagtgacacaatctcagctcactacaacctccgactccctggttcaagtgattctcctgcctagcctcccaagtagctgggactacaggcatgcaccaccatgcccagctaatttttgtatttttagtagagacagggtttcaccatgttggccaggctggtcatgatctcctgacctcattatctgcccacctcggcctcccaaagtgctgggattacagatgtaagccagcgtgcacggcctctggggtctcttttataaggacactaatcccattcatgaggactctgccctcatgacctaatcacatcccaaagttttcacttccaaatatcatcacattagagattaggtttctacatatgaattcgccaggggagacacaaacattcagtctatggcaggcaccaactcatagaaaacacagaagaacaagtaaaatactggaaaaaatagatgtgaaatagtaagtttagtttttaaaagtttgaatgtaagacatcttaaattcaggggagtgatttatttaaattaaattagtggaaaatattatggaattgatgtcaggtcagtatagagaatagcaataagttagttgttcagagtagcagttggttgctttgggagatagcttcttatatctttagtatatgatcatataatgaaaaattaccttgctagattatgagaggattcaggtgttaactgtatcattcagtcttatgatgaacagatttggtaatgctatatcgattccaaactatatcttcatttttaattgattagaatttctatatgtttctatttacatgtctctaaaattggacgtaattgctaattatggtttaattcgtataaagtatggctgtcttcttaccagtgagaaatgtgtaagtttttaaaaatatatatacaaaatatagctgcagtatgtggccgggcatggtggctcgtgcctgtaatcccagcactttgggaggctgaggcaggcggatcacaaggtcaggagtttgagactagcctggacaacatggtgaaaccctgtctctactaaagatacaaaaaattagccaggcgtggtggtgcacgcctgtaatcctagctcctcaggaggctgagacaggagaattgcttgaacctgggagacagaggttgcagtgagccaagatcgagccattgcgctccggcctgggggacagtgtgagactctgtctcaaaaaaaaaaagatgagatgttcattggaaaatgcctaatggtaacctttagttaaatattaatcttacctgtggaagctgtgcactatgaatacagtaagatgactttcaaattatcagaaatctttatctttcagtaaacttgtctacattctaaatatgcatccatataaaatttgttaaggatgtacccatataaatattatgtacatttgtacatattattacataatgattgtaatgtgatttttcagcataaatataacatttactgcttttttccccatctccctcccccttcaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccaggtatgtatattaactattaatttaccagaaaagtctatgagtatatatatatatatatatattttatttctgactttaaaaatgtgttcccacactggaacatttggaatatacagaaaattatacagtattaaatagtaaatattcataatagtacttacctctgagataatcattgttacccttttggcatgtttttgtcactttttgcagttatgtttgtattttagcataatgattgtacagacaaatatgtgtatgtatatgtttgtattctgctttgctttttttttttttttttttttttttttgaggcagagtgttgctctgtcgcctaggctggagtgcagtggcatgcagtcttggctcactgcaaccttcatctcccaggttcaagcaattcttgtgcctcagccacccgagtagctgggattacaggtgtgcgccaccatgcccagcttctttttgtatttttagtagagatggggtttcaccatcttggccaagctggtctcaaattcctggcctcaagtgatccgcccaacttgcttggcctttccaagtgctgagattacagccataagccactgtgcccggctcattcggctgttttgattgttttagttagccttataattattgtcttatatcattatgaatttttttaacacttatagctgctttctatttcatcatatagtataaacgtgaaatattctgggggaggtaaagtatttaaaaatcgattaaatggtcatccattgaattgtataaaaacttatttgtgattatccattagctaactaaaggaaaacttttcaattccagtctgaaatatttatgcgtggaatttcccttgccccttttttgttacttccatgaatggcaagaattttgcaggcattaggtttgaccattctcaaaagcctttattaatcattcgggtatttatttattttcatttaattaagaattctttgagaatatgcttctatacggcactgaattgccccagattatttttggagtaaagtggagtttaaatatgctatgtgcagtgcagcacccctctccctataaggtatactgtttaaagactaggtccttggctttgccttcaggtaacttgaagatgtttttgttgaaatatcttggagactaaaaaatagtcattatgtaaggaatattattataagtgcccagttagaggttagtagttacagaattttaggaaagtcttgttattttgtgatattattgttgttgttgtttaaacaagaggggtataggcatgccaattataaagtaatatgtgtttgagaatatggagctgcaatttattagcagataacatgatgttacacctcttctcaggtttctggtgtggccctcaatttttgtggtttagtacatataaggtccaggagcagttataacttatgtgcacagctttgggagttgtggtattctgatagtaagctgttgaactctagtccataagaagaaacaagatgaaaaatgcttggtgggcaacatagaagtactgacttttcttcatgttctgccgtcattcaagtagatttctgtttctttaatttaacatttctttttaccttaagaggtgtaaaggagaatgtatattttaccagcattatcctctattattataaagaaaaacagaagcatgtatgtgtttttgtgcagggttagacaggagagaccctgtacaaaagagagagagagagagaatatacagtgtaggcaaaggaatgtgagagaaatggatctttcatagtgaaaagtttttggatgaatatatttatcataatatcatatataacttctgagagacattctggaagttttttttctctgacaaaaatgtatttttaatggttctgaattgaattacgatacattgaatcacactctggatctgtataggaaattcattcttctgaggaatacattggattcctattcactttgttaggaatctttggtaatatgaataatcaccccttttcttatatgcctctggagagtcattctagttttgtgaaaatagaacatcaaactgggatgatcggtaggtttttgatgggaagacggctggtaatacttgcctagaactctgtgatggaaaggggccatctcagggatccatagaaagtgtgaatctgccacatgcgaaccacgtattcagcttttctagccaagctgaaagtatggctgaagtatgactttagtgttagacaaatgggtttaaatctaggttttacagatactaggtgtgcaacttaacccttctgagtttcatttctttaatatgttaaatgagtgtaatgagattagctgtaacatacaataatcatctaactcatttctttaggtacttaggtgttcagttaatgatagctattttttgtattgtgatttaaaattctcatatgcttaggctgggcttggtggctcacacctgtaatcctagcactttgggaggtcaaggtaggcagatcacttcagctcaggagttcaagaccagcctgggtaacatggcaaaaccctgtctctacaaaaaatataaaaattggctgggcatggtggtgtgtgcctgtagtcccaggtactccagaggctgaggtgggaggattgctttagcccaggagattgaggctgcagtgagctgtgatcgtgtcactgcattccagcctgggcaacatagaccctgtctcaaaaaaaaaaaaaaaaaaatttttttttttaatttcttgatattctgctgtggtttaagacatactttcacagtgcatttgatatagtgttgttcagcttcattttattctattgatttaggtgttggcatgaaaatcaataccttcccctttcttgcccctatagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctgtaagttttatttctgaacctttagtaaccccaaaagccatgtgattgtgttagtttacataagtttcacacatatttcctttgctcacttctccttctgtgaaaaccaatacatatttgccaaaaatcgatcaccatttatttaaaaattatctttctagatactattatttttactcaagccacaattaaatgtaaatatgccgtttatatttttgatgtctttttctgccgaagaaaaatgccatcaaattagagattttgatttaaatataggacttcaatgagtaattggagacatcctagtagaaaagttagatgtgcagaaataattgaattaaccagtatatttcatttctatcagcttaactatggtagtatttttggtataatttgcctgccttcttaatactgaattcttttagtactaaacatatatgaagggcactattgtttttcagaatgtaatatatttgtataaagcaaattttaactttgtctttatttgaacagttaatactttttagtcagttactcagtcgtcacaaattgtatattgaactactccttgatgatgttatttctatattaatataaatggtcagctcttaatttatacaaagcttttattactatttgttaatgctttttaatttagtgaaatctcttagcattagtggaatgctgcctatgttttgccatgaaagccaagtgctaggggttataatgcttaattaattaattaattttttttttgagacagagtcttgctctgtcgcccaggctggagtgcagtggcgcaatcttggctcactgcaagctccgcctcccgggttcatgtcattctcctgcctcagcctcccaagtaactgggactacaggcgcccgccaccatgcccagctaattttttgtatttttagtagagacggggtttcaccgtgttagccaggatggtctcgatctcctgacctcatgatccacctgcctcagcctcccaaagtgctgggattacaggcgtgagccaccgcgcccggtcaatgcttaatttagtatatgtgactttcagttgttagtttagagctctattttcatagttttgccaatagacattagaactgatgacaattgcattgctagcatagaatattcatttctttcattaaaataatttgtatttattttattcttttacagcatgtttgggaaaataacaaccctttccaaattgtcttggttaagggaaataaacttaacacagaggaaactgtaaaagtgagtacccactaagatttgaatttgccatccgctccagtatttgaataactcactgatatgctcaataatgtcacattggagattgaattttacccatattgatcaattacatgatatagaatatggtaatttattataagactattgagaatttttgttttaaaattttaaaattttgttttaaaattcaaagacttttgaatcattagagatctactggaaagattgacattatttttccagtatatattacatatttcttctatatattatatagaagaaatatataatatagatgggtaagactgtgaagaaagttgagagaaataattcaaaggtgcaaagtagagttatcttggttgaataattctagagagctaatgtacaacccgaagactatagttaatgatattttatacaggaatttgctaggagagtagattttaggtactcttaccactccttactcaaaaaaaacaaaggtaactatatgtgatgatgaatatgttaaatttcagcaagtgaaagttaagccaaaactatagatctcatgtttttatgcaagcttactctcctctctcagccttgcctagagctgcactgaacccctctttcagtcttttttttttttttttttcttttctttccttttaaactgagcacagagaacatgtaataccatttcctggaagaaaatagattactacgttatggaccacaagttgttaacacatgggggtttattgctcaatcccatacatttaaataaagacttaacaaagcattttgtctcagagtataaagcatttattttccctaatttgctgggtaggaaattaagtgaataatttttgtgatccaagaaagagatttggtttgtttgaaatgtttgttgcttgaagatatattcaggagccccttgccaaaaattaccaatgtcttgcttttgtacatgggtattaaagattttgggggagagtagaagggtggttaccgcctttggtgttagacaagtgggtgaggctgtgaaaaaagttgagagaaataatttgaaggtacaaagagttatcttggttgaataattctggagatctaatatacaacatgaagactatagttaataatattgtatacaggaaatttgctaggaaagtagattttaggtactcttaccgctcctcagaaaagaaaagtgtgtgtggtaatggatatgttgatttacttgactgtgtagcaagcacttcattctatattaaaacatcaatgttgtacaccttaaatatatgcaattttagaagaagattctttgagtagctatcattaaaataaaggctttgcttttatatcctcagctagatttttcttttttttttttgagatggagtctcactctgttgcccaggctagagcgcagtggcatgaactcggctcactgcaacctctgcctcccgggttcaagcaattcttctaccttagcctccccagtaactgggactacaggcacacgccaccacacctggctaatttttgtatttttagtagggatggggtttcaccatattggccaggctggtctcgaactcctgacctcgtgatccgcctgctgtggcctcccaaagtgctgggattacaagtgtgagccactgcgcccagcctagatttttctttttaatgagcatgtttatggccggttaacctctgttttctattttagtggtaatcctgtttttatcttttaatttaaattttttaattgcaaaagtataacaagactaattgttgcaacaaatgaaaaagtgcaaacaggctgggcgtggtagctcacacctgtaatcctagcactttgggaggccaaggcgggcagatcatttgagtccaggagttcaagaccagcctggggaacacggcgaaatcccatctctacaaaaaatacaaagcttagctgggtatggtggcatatgtctgtagtcccagctatgagggaggctgaggtgggaggatcgctggagcctgggaggtcgaggctgcccctgagctgagattgtgtcactgccttccaccccggtgacagagtgagacccaatctcccccaaaaaaaagaaaggaaaagaaaaagtgcaaacatgattaagaaaaaaggtactggtctctccttaccatcataagggattcaaagttaacaagctttgtgaatgtcctccaggtttataaaaatatatataaacatatgatatggaattaaaggggttttggttgtgtttatttctgtgatttgtcaaatggtttgttaataaagggatgatactatgtacattgttctataacttgatttattcactttataatatgtgctggacagtcctctggattagtaaatagtagacttccttgaggattttattctttttttaaaaaaattatttatttagagacagggtattactttgtcaccctcactagttgagtggcatgatcatagctcactgtaaccttgaactcctggtctcaagcgatcctcctacctcagcctcccaagtagctaggactacaggtatacaccatcacttccagctaatttttatttttatttctatttttatagagatagggtcttgctatgttgccaatgctggtcttgaactcctagcctcaagcagtcctcctgctttggcctctcaaagcactgggattacaggcacaagccaccatgccagaccagatttcatttttaaaggcaaaaatcacatggagtcaaatctacccacaagtcatatggaatattatatatatatatggttttgtttagtaatttataggtatcgatatagaatctacgtagtaacaaatgggaatttctgcttgttcttcccatttgcaggttatcatatttgtcttctgtagataatttatcagttctttgatttgtttatggttggtatttctctgcagccctttacttaatttcttcctaaagaatatccaagaagccttcattcgtgttttattttttctcaagcattatgcgttattcctttgtcagtggtcagaaacccaataaagtcattgacattttatgtccatatgttttgccacttctatcaggtatcaagcttgattgattctattgtttgccgttgttatgttcatggagaggattaatgggcttaatgacaggtagtatttaatgtatgtacctcaccccaccgtacctagcactgtagttctctttttctttcttctccccagcaggattatatagttgaatttgagtacattaaatgtaattatgacatgattttcctgtagatataccttgctacacaggtgaggagctccagtagaatgttaaagcaaaatctgaaaaaaggtggcagctttacatctttctttccaaacttttttctttcctgtatgcactggctaagaatcccagtacaatttcaaatagaagtgataagggtaaatggattactcagggttctccagagaaacagagccaataggatacaatatgtatagctatatctatattatcacatataaataagcaaaaaatatagaagatttattataagaaattgacttaaatgattatggaggtgggcaactggagacccaagagagccagtggttgagttccagtctgaatctgaaagcctgagaaccaggaatgccagtgggtgtagttcctatctgaaggctggtaggcttgactcaaacccaggaagagccaatgtttcagttagagtcccaaggcagggaaaaaagccaatgtcccagttacaaggcagtcaagcaggaagaattctgtcttacttggggagggtcagtctttgttctcttcaggtattcagctagttggatgaggctagcctacatcagggagggcaatctgctttacccagtctactgatcacaatgttaatcacatccaaaatcacccagaataatgtttgaccaaatatctcattagtaacacccagaaaaatgtttgaccaaataccagggtaccctgtgacctaatcaagttgacacataaaattaaccattatagtagaccttcttttttttttttttctgagagagtctcactctgtcacccaggctggagtgcagtggcgcaatctcacctcactgcaacctccgcctcccgggttcaagtgattctcatgcctcagtgtccggtgtagctggaattataggcacctgccaccacacccagctaatttttgtatttttagtagagacagggtttcgccatgttggccagcctggtctcaaactcctgacctcaggtgatccacccacctcagccttccaaaatgctgggattacagatgtgagctactatgcccagcctgccatcttgattttgttctttatcttaaaggacagcattcattaagtctttcaactttaaatataatgtagtttttttcatagatgccccttattcaagaaattctcttcctagtttgctgaaaatttttatcctttaagaaaaagttaatcactttttctgcattttttgagatgatttgtatattttaattcattggttttcttctttttttttttgagatggagtctcactctgccacccaggctggagtgcagtggctcaatctcggctcactgcaagctccccctcccgggttcatgccattctcctgcctcagcctcctgagtagctgggactataggcacccgccaccatgcctggctaatgttttgtattttttttagtagagacggggtttcaccatgttagccaggatggtctcgatctcctgacctcatgatccacccgcctcggcctcccaaagtgctgtgattacaggcgtgagccactgcgcctggcatccattggttttcaaaagttgaaaccaaccttacttttctgaaataatgttcactcggtcaagatgtgttagcctttttatacattattaaatttgacttattaatattttgttatggattttatggtctatgctcataaggaaaattgaggaatattggtgtgttcttgacttgtaatgtctttctttgattttggtattagaataacgttggtcatataatgaggtgagaagccttctctattttctgaacaagtttacgttcagaaaataccagttggactggtattatttattgcttaaatatttaattgaacttactccatgccagctgagccttaagttttctttatgggaaggtttttaattagaaacttaatttatagccaggagtcgtggctcatgcctacattcccagaactttgggaggccgaggcgggtggatcacctgaggtcaggagttcgagaccagcctaaccaacaggccgaggcgggcggatctcgaggtcaggagatcgagaccatcctggctaacactgaaacctgggaggcggaggttgcagtgagctgaggtcacaccattgcactccagcctgggcagcaagagcgaaactccatctcaaaaaaacaaaacaaaacaaaacaaaaaaagaaagaaattcaaaatttatttaatgggtatggtagacagattttctgtttcttttgtgtcaattttggtaatttttgtctttcagagaatttgttttgttgttgtttattggcataaagttcatagtagtcccttatgttagttttctgttgctggataacaaaataccataaacttaaaacaacatttacttactagctcagcaatctaggtgtactttggctgcactcctttttgaaagctctgaaagagtctgcttctgaactgattcaagttgttggcccagttctgttccatgtgattgtaggcctgaagtctccaattccctgctggctgttggctggggtcttctctctgtaactagagacagctctcagatccttgccctgtggccctgtctaacttttaagtctggaaaatttctcacgcatcaaattttctcattctttgactcttttgctaggaagagctgagtgtcttttaagggttcaacaaataagtcagtctcactgaggattctctgccctccttaaagctgacagtatcatatagtataacctaatcacaggcgtctaatccatcgtatttgcagtctgagagatcatataggacacatgactctgtatgaggtctataacagaaatctcaaatgttcagtgttgactcaccactctgcctccctggcacttgaacatcttccatctctgtgggagtgcttggaattctgtagcatatagcttcctgatcaatctttccttggccttgtagggctttttgtttgttttttgtttttttaaagacagtcttgctccgtcacccaggttggagtggagtggataaacacggctcactgcagccttgacttcctgggttcaagataccctcctgcctcagactcctgtatatctgggactacaggcatgcaccaccacacccagctaattttttttttttttgactttttatagagacgagatttcactgtgttgtccaggttggccttgaactcctccgctcaagtgatccttctgcctcagcctcccaaagtgctgggatttcaggcatgagccaccgagcctggctagccttgtagtgttttcctctttcatgtgtacatcttaattaatattcagcagaagcctgaactcagtgttgcctaaagtctagaagatgacattatttatagctgtttatagctctagtgggaaaggggtcttctaactctcagagaatgtatgaattgtacctctttttctcctctttttgtttcttttttctcttctgcattgccccggtctctgaacagtattgtggcaatagcaacggtggtagcagtggcagtggcaggagaagcggggacaggcagagcctaagactcagagttgaatgtccgtttcaattataggagttgtagatacaagagaatggagtaagtctccccttccctcacccccctagtgtttagcatagttgcaggaagtgtgagtgaataaagccgcagctttctggttggataacaagtaaaggggaaccccagcctactaaaaaatacttggaacattgcagagtgagataagctcaggaaagcaacctcttaaagttatctgtgtttataagcttattcctgagctgtgcatatgaggatctgctcttaacagtctacatactttgagaactgaacagtggcatattccattagccaagtctcaaactggttaatgtgtagtgcacacatgggacagatgcaaatagccctgcaagaagacttgaaaactgaactggtatcggaactgtagctcacagaaggctcatggaaacttccaactgttgaacctaactaactatggtcccccaaaacaaaaatatcaacattctccataggatataaacaagacccaatgtctcataacataatagacaaaatatctggaatacaattcaaaattagttgacacataaagaatgaggaaaatctgaagttgtgtggacaatgatagttcaatagacgtcagtgacgagatgacacagatgttggaattatctcacaaagacattaaagcagttatgaaaatgctataacaactaagggcaaatcagcaggagggactggagagggagaaagtttcagccattaaatagaagatataaggaagaatcaaatggaaaattcagaactaaaaaatataataactgaaatttaaaaatacactgaatggacccaatagcagaatggtgatgaaaaaggaaaggatcagtgaacttaaagattaatcaatacaaattttccagtttgaacaacagagagaaaaatgggagaaaaattcgatagagccccaggaacctgtgagaaaatactagaaagtctaacatttgtgcaatctgactttgagaaaaataagagaaagagtacagttcaggaagactacttaaggaaataatcacaggaaactagattattggcaaagtcagcaaaagacagaaacacaaattcaagaatcccaagagaaatacaagtgcagacatatcctgtatcacacgtattagtcatacatcataattccccatagcctagttatataggtctcaggactccttatctattaaagtatataacccaaggaacttgtatctttaatcttaaacattaaaaatatatatatttagggagtataaatgcatatttcttacatgcatatattgcatagaagtgaagtctgggcatatattgcatagaagtgaagtctgggcttttagtgtatttatcacccaaatactgaacactgcccaacaggtaaattttcaaacctcacacccacaccccctacccccacaccttccccgtattttcctctttttatcttctttcagtgcctggaacactgaataaatatttgtgcaatgaatgaatacattttaacgtaactgtctctaacattttatccttagttgaaggtcatgtagtattcttctcataagtcagaacaaagctacctttttacaaattgtgacataataaagaatatacatttggtctccgccgtggcttttggcacagagctccttaagtcccttgtcatttcctgagtgataggagcatctattattctaatggtttgatctagtctcagtgtcctgacaaaagagctttcaagacccatggaatctgggtaatgatagaagtgtctttttgtatgctgacaagatgaatggagacttacagtccctagatagctccaggatggagccggttgccagagaaaccaaccacgtgaatagaggattggaactttcagctccacaccgggacttctggagtggggagggaggacagagaccgacttaacagtggccaatgacttaataaccatacctacttaatggagcctcctccataaaaaccctaaataatgggatttgcaggacttctgggttagtgaatatatccacatgctgagaggatagtgcagccaaattctatggggacaagcttctgcacttggaacccttctggaccttgaagaacatatatataccttttcatttggctattcatttctatcctttgtaatatcctttataataaatgggtaaatgtgtttccctgagttttgtgagccgttagagcaaattgaacctgaggagggcatttgtgggaacccttgattgatcacaagtacaaataataacctgagatttgcaattgtcacctgaattggaagtcagtcttatggaactaatgccataacctggtagcatctgccctaagtccaggtagcatcaaaattgaattgtaggatacccaattggtgtccagagagttggagaattggttggtgtaggaaaaccctcacatttggtgtctgaagtgatgaaggtagaagagacagtttttcactttttacaaatgatcaaggctgggaaattcccaaaacatgggaatttccacctattcatgctactgatctttttttgtgtctaatatctaagggcaaaaatgtagtggattttggccatattgtggaacaagaaggaaattaaaatgttgatgtgaaaaaaattcatatcttattcaacacagaacatttttaattggtgagtataggaatgcagtctgtgtgttggcttggcacctccctgctatagcacagtggcaagtcctttgcatgtcaaagcctgacttcttttgctctcctaatgttctggggcttgtgaagaagtgtttccatgaaaatttattaaagttggataataaaacatgtaaccgtataaagcatgattattatttttatttttgagacggggtctcgctctgtcacccaggctggagtgcagtgacacgtcttggctcaccacaggctctggccccaaggctcaagggatccttccacctcagcctcctgagtagctgggatcataggcccacaccaccacgcccggctattttttgtattttgagtagagaggagagttcgccatgttgcccaggctggtctcgaactcctgagctcaagcgatctgcccacctcgacctcccaaagtgttgcgattacaggcgtgagccactgtgccaggttttaaatcatactttaaataaattatactttaaaatgctttacttctcaagattgaagataacccagatcaaacttcaggaaatgggacaatttttataaaatttcatgtgatacaaatttagaggatggattttgttactgctttttctgaaaacaaaaacttctttttttatgcttcttttctttttattgggagattctaaattcagagaacaaaatttttagcatcattataaagttgggtcttttttcctactcttgtttctttttaacgatttgtcaactttaataattatggtaaattacacagagatttctcaagcagaactaatcttaatgacttggcctgaaataaatcatactttgactgttaaataatgatacttattttcaacaaattttttcagaatgttcagggtcttgttttttttaaattgtcaccatgctcaagttagattaattctttattgttattcttttcaagatcacattttttgttgtggctgttcacacagatggtacgggacttttttttagcccattataattcagggttttttgggttttttttttttgagcttttatagcagctcatccctaattctacttcatttcctatacctgagttttgccagaagtttttggatgcagttataactagcattctgttttgttttgtttttaaatactagcgaacatttattgagcctttattatatggtgggaacttatttgtctttatttctcaatgtctttatcaccagaacactgaaaaataatcatttgtaaaattcataattttctgcataaactatatttaaatgccatattaaaaaggtgacaaattcaggtaagattatcgagagtaagaattgaataccacttttatcctgatattcctatcttataacctcccatacaacagatgcaaaatatattttatgtatgttttgttttatttatgatttaccaaatctcattttacagattatttgaggtgagcctacacacgtgtgtgtgtgtgtgtgtgtgtgtgtgtgtgtgtctcttacatagcacatacaatacagacagttttgactttaaaaaaaatagaggatagttaattgacaggaaataagaaaaaaaaaaaaaaaacacccagtagcaagattcctagtaggtatgtgtataatattagatcctgtgtgattaattttttgatgtgggctacatatttgactgtctgcttgccctacacctagtggacaaggcaaagagaaaacatgatcagttataatattcagaatctcataaggtaaaacaaactagttatttatgagtttgtagcatatttcaatactgtaaattgagagagatatgcttagggaatccttatgaatgagacacagtgagtaatgtagtgagcaccaacacctctgacaacatcatattatagtaggcaaaataatgcttctcatctctcttataatgtctttcactaggtagacataaaatacaatattgacagtataatctggaaaaagtcattctagaagagaccaaattaattcagtcttagtactgtattcacccatttgatggtttatctttaattgaataatatttggacttcctaaataaatgttgtgtgtttttcaggaaattctgtatgcatatttttattcaaaactggatttgggaaagattaggcagtggagactttgttgtgttcatttaaagtcaaataagatcaaagtgtatatacatatatatgcacacatggatcatcaactgagcctagagtaacattaaatcatcttggccatgcccagtggctcatgcctgtaatcccagcagtttgggaggcccagacaagtggaacacctgaggtcaggagttagagaccggcatgaccaacatggtgaaacctcatctctaataaaaatacaaaaaaattagccaggtgtggtggcaggtgcttataatcccagctactcgggaggctgaggcaggagaattgcttgaacccagaaggcggatgttgcagtgagccgagatcatgccattgcactccagcgtgggcaatgagagcaaaactctgtctcaaaaaaaaaaaacttaaggatatgaagtttctaagcagaaatcatgtgtgaatagatggcactgccctctcccccactcacctttcatgaagatacgtggagtgttagttgactatgaaatcactttcattttcccaaaaagtagcttaaacagggctttgaagtttttttgtagtttgcaggcttattatctctctggagagtaaatggtaatagaaattttgagcagtaaaaggtaagaaatcttacagtaacaaaatagttttttctttattttctttctttcctttcttttcttttttctttctgaatgaggcagggtcttgctctgtcacccaggctggcatgcagtggcacaatctctgctcactgcaacctatgcctctagggctcaggcgatcctcccacgtcagcctcctgagtagctgtgactacaggtgcacgccaccacacctgactaatttttgtatttttttgtagagatgggcttttgccatgttgcccaggctggtcttgaactcctgcgctcaagggatctgcctgccttggcttcccaaagtgctgggattacaggtgtaagccacctcacccagcctgaaatagtaattttacatttgaaaacagtcagtcatggtgctggtctgcctgaaaacatttgggatggagaggaggcaggtgattaggtttatccaagatacagacttccagacgagtgtgatgggagagaggcacttgcagataattttggtgagagtgaaggcagacaaaactattagagaagtggggagaaagaggtgttggttgttgaaatagaggtcttagtgatggctacaaagttttcctttgggaatgtattaacagtaagttggaatcagggtgggaagtggttggaaactgagatgtaataattagtgatttggaggtgctagggtgtggtgaagtcaaattcagggtggcatcatgagattgtgtggctgaagggaaggagagaagtacctagttggagatatttaggtcaaggaactcaggagtcagatgggttgtttgcctcaggcatgcggaccctgcatcaatacctgttagtgattttcttctcacttagtcgtcttcacatcttggaaagcaattattggtatctttcttgtcagaaacttgaaaaagtacaccactttgcttgattcccaagctttttttttctagcctagctatttcttcaggtctcattttctattttcacactgtacatacacatttcttcccctacccccctttttttttgtcagtgtttgcagagcagattgggagtttatatgaatttagtttaaatgaatggaatttaggttaaatgttgagtatataatatcatacagaatttttggtaatgtgtttaaagctatgaaattgattatttcttcagccttgaaagacttctctggagatgatacagagctgatacagacattgatgatggggctgtttcttaattgctcaggagaaaataattgttgtatggttcttacaggcaactaaacttttatttagagaaacaaagtaattgggaatatgagaagtgaaatgtgtcttaatatgccttcacttattcctattctttctagtgttctattttagctgtttaaaataccacgctagaccggtgttaaaggctcatacctttgggagccaaggtgggcagatcacttgagctcaggagtttgagaccagcctggacaacttggcgaaaccctgtctttactaaaaatacaaaaattagccaggcatggtggtgcgcacctgtaatcccagctacttgggaggctgaagtgggaggatcacttgaacccgggagatggatgttgcagttagttgagatcatgccactgcactgcagcctgggtgacagagtgagacctcatctcaaaaaaaaaaaaaaaaaaaaaaaaaatactgagctaatgtaagtttctgataagttagatactttgtttatagcatataaggtagatataaagattttctaaaagtgctgttgtgtaaatctttcttcataattttctttagttcatagtctttagaaactaaaaatgaaagtgcccaggctttttgactaatttctgggaacacagggaaataccatttaaagtagttcagagacatggacttaaagaaagattgcttaagggtgtgactacttaatcctgaaactgcctgcttaaagagagggagaaaaacccaaatggttgttttaaaaaatcatatctaatacaaaaataggcatatagaccaatggaacagaataaagagcccagaaataaggctgcacacctacgaccatctgatcttcagcaaagttgacaaaaacaagcagtggggaaaagactccctattcaataaatggtgctgggataactggcaagccgtatgtagatgattgaagctggactccttccttacaccataaacaaaagtcaactcaaggtggattaaagacttaatgtaaatgtacacttatatttactttacatgtaaaacctcaaactataaaaaccctggaagacaacctaggcaataccatcctgcacttaggaatgggcaaaaattttatgacaaagacaccaaaagcgatcacaacaaaagcaaaaattgacaagtgggatttaactaaacgtaagagcttctgcagagccaaagaacctatcaacagagtaaacagcctacagaatgggagaaaatatttgcaaactatgcatcagacaaagatctattagccagtatctataaggaatttaaacaaatttataagaaaaaaaacattaaaagtgggcaaatgacatgaacagacacttttcaaaagaagacatacatgcggccaacaagcatatgcaaaaaagcttaatgtcactgatcattagagaaatgcaaatcaaaaccacaatgagataccatctcacaccagtcggaatggctattgttaaaaagtcaaaaaataagagatgctggtgaggttgtggagaacacatacacactgctggtgggagtgtaaattagttcaaccattgtaaaaagcagtatggcgattccttaaaaaactaaaagcagaactaccatttgacccatcaatcctattactgggtatatacccagaggaatagaaatcattctagcataaagacacatgcatgcgaatgttcattgcagcactattcacaattgcaaagatgtggaattaacctaaatgcccatcagtgacagattggataaagaaaatgtggtacatgatcaccatggagtactgtgcagccataaaaaagaatgagatcatgtctttagggaacatgggtggagctggaggctattatccttagcaaacttatgcagaaatagaaaaccaaatgccgcatgttctcacttataaggaagctaaacgataagaacttatgaacacaaagaaggaagcaacagacactggagcctacttgagggtgaagcggggaggagggagaagagcagaaaaggtaactgttgggtactaggcttaatgcctagatgatgaaataatctatacaacaaacccctgtgacaacagcttacctatgtaacgaaccttcacatgtacccccaaacctaaaatgaaagtttaaaaaaaaaaccacaaaaaatttctattttcattcatggtttcatttaatgagttttggattgactgtggtcattttgctgttatgtctgtatatagggtcttacatttggacattcagccattttataatactttctgggctatttaaaaatatttaaaggtaacattatataaaataaaatcaaagatcattgattttaatatttgtccccctttaatcagaggagacaacaatcaccaatattccagctatccactataaactacttcttttttttttttttttttgagacagcgtctcactctgttgcccaggctggagtgcagtggcacaatcttggctcactgcaacctctgcctcctgggttcaagcaattctcctgtctcagcctcctgagtagctgggactgcaggcgtgtgccaccgtgcccagctaatttttgtatttttagtagagaccgagttttaccatgttggccaggatggtcttgatctcttgacctcatgatccgcctgcctcagcctcccaaagtgctgggattacaggcatgagccaccgtgcccagcctgtaaactacttttatttgtattcttcacacagtttacaaggtgaacatgcttttttttttttttttttttttttttttttgagacacaatctttctctgtcacccaggctggagtgtagtggttcagtcttggctcactgcaacccgcctcctgggttcaagtgattcttctgcctcagcctcctgagtagctgggattacaggtgctctccaccacacccagctaatttttgtatttttagtagagatggtgttccaccatgttggccaggctggtcttgaactcttgacctcaagtgatccacccacctcagcctcccaaaatgctgggattacaggcgtgagacactgcacctggctgtgcttttgataatattttgctatagtatagtattttgatggtatgttgcgttatactgtttttcatttaaggttacatcataaatcaactttttctttgtatacagcatagacttcatgatgaattgaaagtaggagacagaggtgactgagtagctgctggtaccattgtcactgtggtagaaagaacatgtgtgattatggttagtcagcttctaaggtagatttttgtttgagtttgatctgagagagacttgcacaggtttatagcctgctggaggaagatttttccaatgcggaggagcaaaggagtaacatctcagtacttggggagctggagcaatatgggaccaggggacttgaaggattacgcctttttctggagttgaagggaattaggtcatgtgttcagatataaattcctagtgacctgaggatttactgcaactacttttagtatcctttgtaacacctgttacttgaatatttatcatgttataataatccatctgtgtttagaataaccaatttttttcttttagcttaattttttttcaaaagaaaagtttcaaatatacacaaaagtagaatagtataatgaacctccatgaacccatcatccagattcaaaagttattctgatagctttttaataatatttctttagcttttaatcatttaaaaatatttaattctctaatccatctgtgttcatttagctggaattagataaaagaatattatttattaagtcagtcatcttttttttactatattatgatatgtctggcctactaacctacagttttatttatgccagcataacatagttttaactattttagtaggttttaaactcataattatattataaatatttataattaaaattgctgattacatcagtatttaaaattttatattactgtttgaatatattttaatatctatagatgaagtatgtgtatattcttgggtatttatcttccttttcaaatattggcgtggtaactcttaactagctagaaaagcttttgctgataagcttttgaaaaatgaaagataagcctaaacaattccacatatgtattcatttgtttagtaaatatttgttgagtaatattgtgtgctagtatcacatctgaataaactggtataaaaactttgaccttaaaagtgtatcactgggtcaatctctgtgttttactactgtttttagctctactttctccctgagttttaaattggtgataattaggtcacatattttaaaaaactgcaaatgagtaaaattgtctgggacatcttacgcatgccctgcatcactctggccccaggcctttagggaaaaacaaaggaccgtgatatataggataatcaagatatggatggaatatcttttgttagctcttgacttagtatgacaaattcataaattatttagaagtagaaagaaactttggagccatctcatccattcattctttcctacacatagagaagggtaagacaagacctcaagtaaatgaagtcagtgagtaagcatatgatagtatgcttatacttactgtcacggtttctttagacctgtttaaaccattgagcaccctggcatttggaccaatatgtgattttatagctggtttacttagcaagtgaaaaacagattagactaactacggtttactgaacgatatactggttaattacactctagtggttctgcagacaagtaggctttctaaaacttggcatgtttcttcttccagtatgttccttccttctccaaaataaagatgtttttagtgtagaaacaaacaaacaaacaaaaagagatgtttttcgtggtacagtattcatgactttgtttttgtttttgtctgcttcattacaggttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtggtaatgatataccaacttctgaggattgttttatataacggaataattttaagactgtttgaaataattgagtaatataagttaaattatattaggtaactttgatccttaaaaactgattttaagaagataagaaatttccatgtttatatctttagatttatgttcatgcatttatttatgtttatgttcatgcattttttttgtaatcttgctccttctaccatggattttcttttggcaggtttattttataagtgttttattatatatgtaatacttttaagaagatatgaagaatgatgatgtttgaaaaatttacagttctgcagtctttcaactgaaatttcatgtgacagatatgtttaagaattcagaattttgtgtattttagaaagatcattggtcgtaactgactcaacatatcttgtggggtctggggcataaatgtgtcatcaaacatgttaatatttggagtgaaatatatcagtattcacactaaatgtgactatcattagctttttgttatctctggccactttttgctgtcacatgagctatgaacaaaccttcagtttttagagcttctcggattttgaaattatgaatataagaggatggacctgttgtcatactttcatcttccatgttatgttttcagtcaaatgtttcactttcttcttgctttttgaaagctttttggtggggatagggacattaattttatatgtttttaaaatctagttactatatttatctatatattaatttgtgttattttattctttttttcttttgagacagagtctcacactgtcacctgggatggagtgcaatggcacgatctcggctcactgcaacttccgcctcccgggatcaagcgattctcctgcctcagcctcctgagtaaatggggttacaggcacccgttaccacactcagctaattttttgtatttttagtagaaacaggatttcaccatgttggccaggctggtcttgaacccctgaccttgtgattcacccgcctcggcctcccaaagtgctgggattacaggcgtggccaccgtgcctggccgtgttcttttattcttaacatgggaatataagcatctcctctggttatcatcatatagtcttctaaaaataatttttaggctaggcgcagtggcccacgcctgtaatcccaacactttgggaggctgaggtgggagaattgcttgaggacaggagttggagaccaatcttggcaacatggtgagatcctgtctccaaaaaaaaaaaaataccctaaaagtaaaataacttttaatgactaaaaagtcacagaagcattagttccttagtatttttttcttccttaatatagaattatcctcaaagtgtttgattataagatttttgatacactatggtgaaattaatctatttaaatgtttgtataaaagtcctatcagctcaatgcctcctttttagagatatatttatatgcctagagacattatctccttccatattgagatttatgtaggttgaaagctcttaaaacaagtattctgatattatacgtgttttcttggattattaaagatttctcattttggctgggcgtgatggctcacacctgtaattccaacactttaagaggcttaggtaggtggatcacctgaggtcaggagtttgagaccagcctgtcctacacggcaaaaccccgtctccactaaaaggacaaaaattagctgggtgtggtggcgggtgcctgtaattccagctactcaggaggctgaggcaggagagtctcttgaacctgggaggtggaggttgcagtgagccgagatcacaccaccactccagcctgggtgacagagtgggactccatctcaaaaaaaaaaaaaaaaatcattttcacaaggctttttagtccatattctattttattcatatactatttattatgaaatgttaattgagttttaaggttcttcttaaacgtaataaagatagtgagcatttttctatgtatatcttgttctcattttagaagattattttggaaatcatccagaactttctagaactaacattattgaaacaaaggacatgtgcatgtttacaccttaaagttattcttagcatatttatgcaatggtatctttttcaacagcattatcctgtagcgtgggtaaatacgatggtttttgactttaaaggacaattgagaactggagacataatattacacagctggtcttcatttcctggtaagatttacattcttatccttagtgttaaagcataactaacttttggcatgtggactaggtaatatttatgaatcaccgttctttcaatttaataaataaaattatcattttgtattatttattctaaaatagatttacacaaattattttaatattatcataaaattacttgtttctgagtagatttctttacaaattttgttttggtttaaaatcggcctatattttattttattatttattatttttttttattttgtcgagacaaggtctcgctatactgccaaggctggtctcaaaactcctggcctcaagtgatcctcccaaagtgctaggattacaggcatgagccactgttactgacctgtattttaaacggttattttaacaagttagtattttaaacatacttccaacaaataatgtaccattattttgctagtaacaagttaactctagtattaacaaattattcatttagctcattagagattgtctagtctcgctatgggacataacttttaagttttgtgatgggtagctttgtctttaaatcttatgcatctccataccatatttaggaatgaaatagactaaacttctttttttttttttttttttttgcgacggagtttcgctcttgttgcccaggctggagtgccatggtgtgatcttggctcactgcaacctctgcctcccaggttcaagcgattctcctgcctcagcctccctgctagctgggattacaggcatgtgccaccacgtccagctaattttgtatttttagtagagacagggtttctccatgttggtcaggctggtctggaactcccgacctcaggtgatccgcccacctcggccatcccaaagtgctgggattacaggcgtgagccaccgcgcctggccgtatttctgaatatatttcttattttaatgaatgtgtgttgctttcagcattttttgtaggtttttttttctttttttttttgagaaattctcctaaggaacagtgtcttctttataataacctttgttgctcctaattgtgctaactttcttcatgagtagaaggaacatctctaattagggagaaatagtaaaaacacttttttttttttgagatggagtctcgctctgtcacctcggctggagtgcagtggtgtgatatgcgctcacttcaagctccacctcctgggttcatgccattctcctgcctcagcctccccagtagctgggactacaggtgtccaccaccacacctggctaattttttgtatttttaatagagacggggtttcacagtgttagccaggatcgtctcgatctcctgacctcgtgatccacccacctcagcctcccagagtgctgggattacaggcgtgagccaccactcccagcctaaaacactttttctttagttggctttagcctgaaatttgaggtaaatggagcaccttccacacgcttttatttctcaaatactactcaaaataccctcatcaagtgaggtagatggttttatttccatttttacagataagtgaagctcagagaaaataagttagtcttacatagctgtttcaaacctaggatttgaatgaaagactattcaaatcttcccattggtctatactgctttcccaaatgttggaatttttagtgtaaatcttgcattataatagtggttttctttttcttttttcctgtctttatagtttgttgatatatctagtgaagttgtaaactaatttgaatttgaattttttaattcatggctttgtaagtgacatttcaaaatgttcatgtactagcagttgtcacctgaaaaattacttttggataatcatttactgacatatctataaactctttgcaatctaatagtgtgtgtgtgtgtgtccttctattcctatcctctccagcatgtacctctaacagttttcactaattatgttattccccaaatgtaggagaactgtgtatatttgacgtatttctttttgtttgtttgtttgtttgactcagggcctcaccctgtcacccaggctggagtgtagtgacttgaacacagctcactgtagccttgccctcctgggctcagcctccctcctcagccccccaagtagctggtactataggcatacgccaccacacccggcttttttttttttttttttgtattttttgtagagacagggtttcgccatgttgcccaagctggtctcgaactcctgggctcaagtgattttcacctcctcagcctcccaaagtgctaggattataggcatgagccacagctcccagcctatttgacatatttcttaggaggaactaaactttcacaatacaataaaatatagcagcaaaatactgtactttcttgagaatcttaatttagactcacacatgttctccagaatcaccaaccaacttgactagtatttttagtaaaaattacaatttttggtggtgttaacttggcataatactatgaacctgacttcctctctgagaaaatgtatgataaaaaataataaatgaacacattagttctgcatgtgtcagctctagaattgttacatttaacccagtaggggcaaacaagaagcaaagaaactacaaataatctaccatccagagtccctaggtcatcattacaaggtatacaatcacgtttattattttttttcctaactttccataatttttttatgtggactaggaaatacaaatgtcgattcctgtttttccccctatacttacacaaaatgacacattctgtgtaatgttctgcttcttgctttattcaccatatctacatatctacatatcaccatatcttctctacgtatctatgtagagaactgtttttccccccatgcctggactgttagatttttttttttaagcagaattgtgttctgatagttcaaacagtgctgctataatgaataaccatgcttatgtacagtgtatatctgagataaattccttagaggtgggtttattgattcaaagaatagataaatttataattcttataattacaaattgttcctcaatagcgtgtatcaatttttgctctccatgtgtagtatatatgaatgccttttttttttgccacatatggtggttcacatgtataatcccaatgctttgggagactgaggcaggaggatcacttgagtccaggagattgagaccagcctggacaacatagtgagactctgtctccctatacacacagaaaaagagtgcctttttttctgatcacttttgaacaaggctaaaggattacctctatgtatggggctaataagtactaaaatactaaatttgatttcagttaggttgcatttgataggacaaaagtaaaatagtactagagagcagaagtatgaaactgtaaattgctgagaaatcagctctagagttgtataaattattagaattgagccaggtgcagtggtgtgtgtgtgcctgtagtcccagttactcaggtgcttgaggcaggaggatcgtttggggctaggagtttgtatccagcctgggcaatgtggcaagaccctgtctctaaaaaaacaggaagattaaaaaaaaaaaaaaagagttgcctccatccaggtgaaaattgagtttgggctgggtgtgattgctcacacctgtaattccagcacttttggaggctgagttgggtggatctcttgagctcaggagttcaagaccagcctgggtaacatggtgaaaccctgtctctaccaaaaattaaaaaattagctgggcatggtggcatgcgcctgtggtcccagctactcaggaggctaaggtgggaggatcacttgagcctgggaggtggaggttgcagtgagccaagatcatgccactgcaccccaacctgggtgacagagaccctgtctcaaaaaaaaaaaaaaaaaagaaaaagaaaaaattgagtccgtgaggtgagaaaatatttaaaaagatgaacgaagaattaaggaacgaaaacttgtaaagattttccagctttaggaaataattctgagtgtgcatactttatggacattagacctaattagagtagagctgatattttttttccttaggagatacagaaagaacaactgtactacagtcagtataagaaaagaaaaattactttggagagagaggatcttagattgtacacctaactctattttctcatcatgagtttcttatctgtgaaataaaaaaattatataatgcgaactccagagttttctaactacactgaaattctaaaatcacacacacagttctgtgaattgaccatatttagcgtggtggaaaaggaaaaggaaggagtaccttgaagaaagaagcagttggtgaggtaaaaggagcgccacttaatggagtattccagaggctaccagagaaggtattttctgtcagcagttgcaggataataaagagcattatcgttagatttgataagaagaatgtcattgatgacttaaaataccaatttggttattgtgacaaccatgaaaaccagattacatgtgattaagaagtccatatgtagtgatgagattatagtttctatgggccacctaattttgatggagagagagcagttccaattaaagtcttttcaagattgagaactaaatttgaattaagaggtaaagtagtcattcagttttgttaactttctcatttttaaaacatgtatgcaaactcacactgaaattttgttccaagcattaacagaaaattagaggattactgatagaattgtctgtcacacttctgtagttgacatacttctaaggtgattttcatgggaggagatccattacagcttttttaaagcctagttttaaagacattttttaagaaccaaaattatttgcatgttttagatgaactcgaagaaatgttgaatccaatgggaactgttcaaacaaatccatatactgaaaatgcaacagctttgcatgttaaatttccagagaataaaaaacaaccttattattaccctcccttcgataaggtaagctaattatttaaaggacctctatgcatgaaatgattgaatgatcagttcctctatgtatagtttaagctctatctgtctctttcaaaacttcccatacagtgacagctttgttgagtgggaagaccatggatcagggagccttcttaactctgttagttttggttttatcactgactaagtaagaaaaggtacctccaggccgggcgcagtggttcacgcctgtaatcccagcactttgggagcccgaggtgggtggatcacctgaggtcgggagttcgagaccagcctgacaaacatggagaagccctgtctctactaaaaatacaaaattagctgggcatggtggcacatgcctgtaatcccagctactcgggaggctgagcaggagaattgcttgaacccgggaggcggaggttgcagtgagccaagatcgtgccattgcactccagcctgggcaacaaaagcaaaactccgtctcaaaaaaaagagagagagaaaaggcatctctggagttcacttttcttatttataaaatgaagaaatcataattgttctattttttaatatctcacgcccttaaagggctataaatatattcatatgtaactgaatacataaaatgttgtttcaaatattaaaggtatagtcactgctgtattagaattgatactcaaagaacaattgatttttgttgaatatgtctgttagtggcgcttcctaatgtagttattttatagaatctatagtaaggacttcatttctaaatatatttctttaatatacacactgcatgtcttggggataaagagattatctaatgggggctaaatatagggctatggtaatttacatgctaagagagctgagctgtcatatattttatctttaggtttggcatggtgttttttattttaaaaaatggagtatttctctgtcatccaggctggagtgcagtggcacaattattgagcctcaaattacttgcctcaagcaactgtcctgcctcagcatccctggtactgggattacaagtgagagccactgcacctggtagtgttgatttttataaggaaatctttgaacaaattctcagaatttaggagccaggcaccatggctcaagcctgtgatcccatcaacttgggagtctgaaccaggaggataacttgaggctaggagttcaagatagcctggacaacatagagagacccttgtctgtacaaaaatttaaaagttagctgggtgtggtggcatgtgcctatagtcctagctactctggagactgaggtaggaggactactttagcccaggaatttcagactgcagtgacctatggtcatgccactgtgctccagcctgggcaacagagagagaccctgtctctggagaaaaaaaaatgttcagaaaataagctgaaagtttatttaatttcctcaatccgcttgagtacaaactacctttgaagattgatattatactttataaatacttaagataatctacctgtacatttaaagtattagcaaattaaatttatgtaattcactctttcttcattttcattataattggattttatccatctaaggagtaattttttatttcaagttttttaaacatgtttttctgaacaataatttacaaccaaattaaattttgtgcttataatataaatttcaaatatggcaagaatcatatacgttagtatacactgagtagaaaaagctacattttgactcatccaatacgtttatgtagtgtctttagttattcctttggtagaaatttatccataagccatagctactcgtgatatatttaatagttttagctgtgactattatcatgttcagttatgatgtgtgttcaacagttataggctcttttggctcaaatgaaatgctttttgaagtacttttacaaatatagcctcctatatttgcaaatataagtttttttttttgtttgttttgttttttgttttttttttttttttttgcctttctaatctcttggagagtctttcttgaagaagatcagtttgggatagagattttagtctttgaatatatataagccagggacagcagcctttagtcccatctgcttgaggctgaggtgggataattgcctgagcccaggagttcaaggcgagcttgggcaacatagaccccatctcaaaaacaaacaaaaagtatgtaaataagtatatgcttattgatctccttcaattgtacaagttagatattgtcgttacttctacttttggtgtctgttaattgaagaaaaaacataatgagaaaagtttattctacaatttagtaactcttacatgtttttgtgtcttcttaactagaatacatttacttatacttaaaagaaaatttttgacatatatatgctagctggtacttgttttatctccagacaattttagtgcttcctaggagtcataatcccttatagcaataccatcatttccctgttgtcaagagtttaaagcacttgagaagcatcattttgcttttaaaattcatgtttctgttacaaagcatagcaatgccagatcttatgtagtctaagtacaaatgtagtcatttacacttaaaattctacaaatatgagagccaaaattcattttctttaatttttttaaacagattattgaaaaggcagctgagattgcaagcagtgatagtgctaatgtgtcagtaagtatcaagagttttaaatggccctttcttatggagttgtgcacattattaggtatctttgcctcatagtaatgaactcacagaagaccgtaactcatatgcaagaacagtctgtgagtgtgggtaagtatgcacatgatagtgttttgttaaatggcagcccaatttgtgggtgatctgggttcagtgggcaagcccttttctgatacaagtacaggtttagcaggtaatctataagggattctgtggcacctcatagattaacaatgctgtcatagtgaatattatttagtttaatgaggagactgtatttctctcaggtaacaaagcagatttagtaataggcacacacatcatcatgcaagtgacccaaatttcttccatcttagtgctctgccatatttaacatgtattttctatttcatggtttaatattactgcttcagcttcctactttactatattccagccagcaggaacaggaaaaacaatagtagtggtcacaccccattcttattcaggatatcattagtatgtatcatttctgcttacatgtcattggccagatcttactgaccatgcctaagtacacacgcatctgagaggtgcagtctttagccacgccatcagtcatgcgcttggctaagagtaagagattctagtactaaaggaagaagtggagaatggatattgagggtcaaatagtagtctctgccacatatactattcccatttgtttctatgcagatactacaaataggttactttgttgacttgggttgctatatttatatctatatctacatctatatatctatatctatatctacatttatatatctatatctatatctacatatctatatctatatctacatatatatatataaatatgtataccatctgtgcttttttatttaattttttggctctttctagtttgactttgttgagctgtaatccagtattctcgtcatcagtttacaacttttaagtctatttagcaaagtcattctacctgtagcatggcagtgttatagagactaggaggcaaactggagacaatgtgtatgtttttcccattctcacagaatcaaagcactatttaattttggccagttggtgaaatgtctggcctaggctgtcttctcctttgccattagagctctcagaatctttccctagtttctcagtgtgagtcatctgctactgctttcttattagtgtttttggcttaaattttgtcttttgaatttgaatgcttgaccttaggaaagagagcagtagtgccagactcctagtctttacagtttacgaaaggctctgggccagtttgggaccataatagccaaattcttcctctctctgtcttttttcccaaagttttgtgttattcaggtttctggagacagtttcagataataatttaatttgtaaacattgtgcaaattttaatagcttaaattatatatatggcctgaaaaaaatttgcatgatcaattgatgaggctggtgtgataggatccttgtgtttgactgctttttcttgctgaggatgtagacttgagaatggcctggaatctctaagaagtaagagtttattgaaaaagtaaaacagtaaaataaaagtggaagcaatctcagagactagtgtaaaaaaatgtgtgtttgtgtataaatttaaaaaataaaagaaaaactttaaaaagagacaactgcaagagcagttacctttaatgatacaaaacaaatttcttacaggtgttaatttatcagcttattaggcaattactgaaacagataattacagtttaagcttaggagatatagttacacaggcaggtcttggttcaagtgcctgtctcattaccctttataagacaatattgctccttgaacctcagataaatgaattagtttttactatttccaccataaacttgtacctgacctaaatcagagagtttgctacacactgagcatgcagtaatcttgcccaggtctgatatacctttacaatttgtttgttttttattaggcacaaagtacaattaataaatggtaaggatgggtgtgatggctcacccctataatcgcagcactttgagaggccaaggtaggaggattgcttgaacccaggaatttgagagcagcctgggccatacagagagaccccatctctacaaaaaaaaaaaaaagtattaactgggcgtggtggcatggacctgtagtcccagctacttgggaggctgaggtgggaggatagcttgagcctgggaagttgaggctgttatgacagagtaagaccctgtatctttaaaaaaaaaaaaaaaattgtaaaccaaaaatgaaagtttctctctgtgactcccacctaccttcctctccagagctaattgtaaacagtttaatttgtagctatcaatcctaactttatatgtaaatatctccccctttaaaataaatgagatctatatatacatatataaaactatatatatatatagtttctacttttttcatttaatatactttgtggatattgtcatgtgagtatgaataggtctactttttaaaaaatacctttctaacattccatagcattaattactagtatctattagatttttctttttctttttttttttttttttgagacagagtctcactctgttgtcaggctggagtgcagtggcatgatctcagctcactgcagtctctgccaccccgggttcaagcgattcccctgcctcagcctcccaagtagctgggactacaggcatgcgccaccatgcccagctaattttttgtattttagtagagatggggtttcaccatgttggccaggatggtctcgatctcttgaccccgtgatctgcccgtctcggcctcccaaagtgctgggattacaggcgtcagccaccacgcccggccacatcatgtccttttaccccttaattcttcagtatttcctttaaaaaatggcatttttatacataacctgagtagattcatgaaggtcaggaaaataatactgattcagttctatataatctacagattttattcaaatttagccagttttctcagtcatgtgctttataagtcttggatccaatctctggttacttgctgcatttcattgtcaggtatatttagcttccttcagtccgaaacagttcttcagtgtttttttgtttgtttgttttttgtttttttttttttaatctttaatgactgacatttctgaagactataggccaattattttatagaatatccctcagtttggatttgcctgatgttttgtcatgtttaggatcccagttatgcatttttagtgtgaatatcaaagaagtaaaggtgtagttttcttactgcattttatcaggaggcaatatcggcttttaccactactctggaagttaactgttatcccttggttagtacggtgtctgctaggtttttctagtataaagttaataaataaaggttttgtgggggcgtattttgacactaagtaaacattctatttcagatcaagctgtcacccacttctttttgcattcactaatacatcttccttgaatcagtgttactgcagtgggttgccaattttaaatcttgcttttccttttggatttattagttggcttataacataggttagaggcttttcttctactctatctctatctatctatctatctatctatctatctatctatctatctatctatctttttagagtcagggtcttgctctgttgcccgggctggagtgcaatggtacagtcatagctcactgcagccttgaactcctcttctcccccattcatctcttttttctttcttcttttttttaacttataggagatggatttgtgatttccatttattcgatgatttgtaattagttactgtcatttatcttaatgtttaatttatcccagatctggctcatgggagcccatttaagctgtctcttgtctctttttgctttgtccctatcattctttgagcatttctttctttccgatacaacagcgtattccacactcatctagtactttccctaccccagccttggaatcaggcatttctccggagagtttcattttttatattcagtttattccttttatttgtgaaaagtatgtagggatggatggatggatggatggacggacggataaacaaacggatggaatggattgacagtgtctcgctttgttgcccagactggagtgcagtgacacgatcatggctcactgcagcctcaacctcctgagctcaagtgatcctcccacctcagcctcctgagtagctagaactgcaagcacatgccactatacctagctatttaaaaatttttttttaatttctattttttttagtagaattaggggtctcactttgttgcccaggctgttcttgaactccggggctcaagcagtcttcctgccttagcctcacaaagtgctgggattacaggcgtgagccaccatacctggcctgtgtaagatctaggccctggatatgctcattgcccctgggtataaagtaagtaagtgctccttggagaatgcaggggtgcagttgcttccaggcccttttgtgaaacagagctagacagtatatatttgtttacctccatatgtttgggaaaataaacatacacagagatatatttatttatccatctattaaagaccatgagttctcatcaatacctctaatatggatccattcccactgtatattttctagtctttgtcttttcatatttgtaattcccttttctaatgatgagaaatctggatttctgttaactttggtgtatttacttatttgctcaatcccctgtttgtaatcagtcttctagtcttataactgtcttcttagtctccacctcattatccttttttttttgtattttgtattttttgtaaagacgggttttcaccacgttgcccaggctagtctcaaactcctgacctcaggcagtccacccacccacattggcctcccaaagtgttgggattacaggcgtgagccaccttgcctggcctgacttggatttttatccaaaaagcaatactgccacccagtgtttgcacagtttacatttttagatttttagaaactgttttaagaatctcttcatccttagcttagaaattattaaaggatctgccttttttttttttatggaattatatttttgtatctcacatacttaggttcatttattatatataaatatatataaatttactgaaagtttgctgtggtgtttgcacaattaaattctataatgagcattttacttttttagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcaggtaacaaaagatcgtttctataactttttttgggtgtatggtacttggttggattcacataaagtatccttttctcataggtatattttcatagataggataatttaagcaggagaaattttgaggttttaaactcttatactccaagtaatggaccagaacatttccagaatttaaaaatctcagattttgggtaggattgccatacctttcaccaaatacaattgaaacattgatcttgggacaattatctatcaaaagtaccactttctaagacgtgggtaccttctaccagcttcatcagtgaactccagagttttaaatcttttagactctttgcaatgactgttctagaatgaatgtccattgtttgaaaattacatctattacagagaataatattttagataatatatcattcaggtcaattttaacattcatttcagttgtccagtattgctgaatgtatgcgttttgacagaatagaaaaaagaccattttgcttcagaaacccaccaaattttagttccctgatttaattttcaagaccctgccaaaaagcactggcatttattcaattcaaacaacccaccagtgctcaatagaaagacctttgaaatgggttttttaatcagaacaaataaatttggtctactaaaataaccaaattttttcatgttacttatttcagttcaatgaatctctctagtatgtagtcttagtaaatctatagtgactaaaaatttagtgaagaaatacagatttatcttaattatatgcattttaaaaatctttggatttattgtttcacttctcaatttaagagtagaaaggatttcttttgtgtttacttttagtgtctaaagatctttggagccaggcatggtagcacacacctctaatcccagcactttgggaggccaaggcaggtggatcgcttgagctcaggagttccagaccagcctgggcaacatggtgaaaccccatctctacaaaaaatacaaacattagctggacatgctggcatgtgcctgtagtcctagctacttgagtggctgaaatgggagaattgttggaatctgggaggttgaggctgcagtgaaccaaatgccattgcactctaccctgggcaatagagtgagaccttgtctcaaaaaaataaaatggctggggtctgtggctcatgtctgtaatcccagcactttgggaggctgaggtgggcagatcaggaggttgagaccagctcagcaatttaagaccagcctgggcaacatggcaaaaccttgtctctacaacaaatacaaaaattaaccagacatggtggtgcacgcctgttccagctactcgggaggttgggacaggaggatcattcgagcccgggaggctgaggttgcagtgagccaagattgtgccattgtattctagcctgggtgacagagggagaccctgtctcaaataaataaataaataaataaataaataaatctttggagacatgttatataattatattattgtgtgtacctcgattaaacttgtttccaccttagaccaaattagactgaaaaggaactattttattttaattgctgtagaatagttattgtcttctagccactgatgtattatctaaattcaggattcgttttccatgaaccttcagtaatggaaaacaagatctaagcatttttttagttgacacatttgcctgtttcttttggatagtgtctagtgctgagtacatatctaagaaatgcatcatattatttcattagaatcacaatggaaagaatttcttgctgtactcttaaaagctgtcttatagagaggtttggtgagttttggcaatttatttaattttacacttacatgatttaatttttaataattataaataatcttaccaaagtcattactttccaatggtagagttgtttttaaccacaacattgttgaacctctagtattacataatcttatctctccttttcagtgttatttatgggcagtgtattccaagtattaactggagatatgaggagttttttttattactgctatttcaaaacccaggaaatggtctcttcccaactcttctgctcataaagaagactgctggtccattagggcctttggcaaagcagggaggggggatctattagtgagaaaaattggggatgaggttggtgctttatgtctttatatcagtatttctcaacctgttttcatcactatacctttaggagcttttatagacccttttccccccaataacccatgagattttgattccgtagatacatggtacatcttttcatgtacgtatttgtatctgtgctttatacataaaaaaagagctagccttattcaatatagggttaagaatagctaagtaaaacttaagtttaaagttaaaatttaggctgggtatggtggctcaagcctgtaatcccagcactttgggaagcagaggcaggaggatcacttgagtctaggaatttgagaccagcaacatagcgagaccctatctctacaagaataaataaatgaaataaaattagctgggcatggtggcgtgttcctgtagtcctagctactcaggaggctgagttgggaggattgcttgtacccaggagttcaaggctgcagtgagctacgatagtgccactgcactcctggctggacaacagaatgagaccctatctcttacaaaaaaaaaaaaaaaggttaaaatttaaaaattactaggcattccactgtatttgctaagtaactatgtaatttattcacgtaggtgaattctaatgtgtcaaattacatatataagttaacaatttatgctgagtgcagtggctcatgcctgtaatcccagaactttggggccaaggtgggtggatcacctgacgtcaggagttcaagaccagcctggccaacatggtgaaaccccatctcaaaaaaaaaaaaaaaaaaaaaaatacaaaaaattagctgggcatagtggcaggcacctgtaatcccagctactcgggaggctgaggcaggagaatctgggaggaggcttgaatccaggaaggagaggttgtagtgagccaagattgcactattgtactccatcctgggcaacaagagtgaaactgtctcagaaaaaagttaacaatttatataaatatatgctaataatagagtaattaaattttaaaaaatcattcaaaagtattgttttcgcaaaaatatttttcaaatgtaaaacaactgaaaaaattaagctaatttttaaaaaattagttaacttttatttacttttgcttgatatgagaaaatgccttttaacttagctggtagatactcatttagatattgttgacttttgggggagggcttgccataattatagattgaataacttgtagaattaaataataaaatataaacggtttttattgaattctcaaagcttaattggtcggagaataaaacttaacatccacaagatagccaacaagcttgcaggccacctctcccagtatgactttgagcaatcaattgaaagaaaatcctctaaccactgccatctatttgccatagttttacagcagtgatcttgcatacatatcatataccttccatgacgttgatgtcagtggtacttaggtgatacccaggaaaatccaatgagagaaattaaatactaaggaataagattttatcagatggaattgagctttagaaaggctacaaattcaacatttttttctctctcacccataaaatttatttgggggtaagtacttcatagcttttcagacttaatctatagaatgtttcaacaacaaagacaatctttattagtctctattaacaggaatggatttttgaggcatcaataattaaaagtgagctttgccttcttttgacctatcttggtgctcctgtgtgtcaaggaaaattagattacttttgtcccccattatttctgaaccagtttcattttttaaacagcttcaggcgctgcttcagatttggcctaaactgcccccccgggaggccctagagcttctggatttcaactatccagaccagtacgttcgagaatatgctgtaggctgcctgcgacagatgaggtatcttctgcaggtggttttctttggggcaaggaataacttgggtgggtttgggatgagggtgtctccttgatgtctcataagaaagaaaagggctcagaattattcacagttcaaagcatttgctcatgtactcctgccagctccccaactcaatgtttatactagaaaaaaaaaaccaaaagcatgctaggtcagaaggtcctcaagatcaccctcaggtttgatgactcactgggaggactcagaactcagcacatagtcacttacagatataatttattgcagcaaaaggatacagagcaaaatttaaagagggaaaaaggttcatggggtgaagtcatgaggaaaacaggcatacataagcttgtaagagttcttttccagtgaagtcaccccaaacacttttatttctatcaggagtgagttgtgataatacaagtctgcaagggaagcttgttagagacttcgtggccacggtttttacgggcagctatcacataagcaccctctgcctagcatgtaccagatttctatactcccagcagtaaagtggatatacaacataaaccattatttgcacaaatagtttaggtgcagtgagccactcttatcaattagggagggtggtgggaatcctgaaatcttaattcccagatgctagccatgggccaatcctataagcaggcttgttagaggatagcagccaagcctgctgtgttacctcttttcttcacacagtctatccaccctccagaattaagaaatgttaatttttgtcatgggtttaaaatatatatatatatatatatatatataatatatatatatatatatatatatatatattttaagcaaatacattacagttaaagttgaagtcctcatagtttccttatccagtcttgattacttctcttccttctcagaggcaaaccattatcatgaatttggtgtgtatgcttctatatcacatttttctgtttcatatatatctatgaaaatatagacatggaattattattacacaaatgtgtcttgccatatgcattagtttatatcatgctttttaaaaatttggccagatggctgggtgtggtggcttatgcctgtaatccctgcactttgggaggctgaggcaggcagatcacttgaggtcaggagtttgagaccagcctggccaacatggtgaaaccccatctctactaaaaatacaaaaaattagccaggcgtggtggccggtgcctgtaatctcagctactcaggaggctgaggcagaagaatcacttgaacccaggaggcagaggttgcagtgggcagagatcgtaccactgcactccagcctggttgacagagcgagactccgtctccaaaaaaaaataataataattcagccagctgtggtggctcacacctataatcccatcactttgggagacaaacgcaggcagatcgatgagcccaggagtttgagaccagccttggcaacatggttaagccccgtctctaccaaaaatacagagacattagctgggcgtggaggtgcgcacctgtggtcccagctacttgggcggctgaggtaggaggatcacttgagccctggaggcggaggttgcaggagctgagatggtgccactacactccagcctgggtgacagagtgagaccctgtctcaaaaaataaaatacaaatacataaataaataaaaattcaacatcaggtttttgaggttagtctctcccattatgtttaaatgtcatttattcctttcactactgtgtaatattctgtcatagggatatatcttatttaattcattccctattaaggaatatttaagtttctccacatttccctattataaataatgcttcagtgaacatgtttgtacagtctcccttggatggtgcatttgtgagaatctatgagattcactgaagaaatgactgtctcagacaatgaagtttatccattttctttctaggttcaaaagtgaggcttatgtactttatggtttttgaaacataaaagcccacaaaatagtgtggatactatgatccttttttctttttaaaatcgtgtatgttttaagctgtgtaatagccaaaagtaattacacagactcaccaatagtgcttacttctggggagtgaaattagaaatgtgagagaagaggaaacagcttcctattcctatactttctattttttacactatttataggttatatagtgggcatgaattttacaataaacctaatcaaaattgtgttatagatagttttaaaaaatgaattcccagttgcttcaccatctgcttaagtttgcattggagacctgttgtggaggggccacctggttctccttgggctgagccaagtgtttttcttaaacgcattgatccctctgaggagacggcagtgatccgtgtattccgtgtagctaattctggtggtttttctattgtgaaatttctggttatgagtttttggttttggtatatagtgccctgggtttcagtcccagatatctgccttagactactaattccttaaccatttattacccaatactgtggagagtaagtggagcacttggggcacttgggcttcataccttatactgctggagttgcctctgataggagtgtgtttacaggtagaatggtttggagattgacacaaaatagagaaccactaaccttaattaattgagctcagttaattacaatgttatctgttatattatttcaatgatcaattcccacttataaatgtattcactttctcatccttcaaactatttgaagttaagattttaattgtacattggttatctgggacaacttaaccctaataacagcaaaggaaaataaattgtgaaagtactgatggaatttttattttaaaaatgattgttttactaagcacaaattttttagcatgatcagaaatcagtattaaagtacctaatatttttggtaactcttagctgactgaaaaatacagtcatgaattttaacaatctgtagtagtccattttcacaccattataaagaattacctgagactgggtaatttataaaggaaagatgtttaattgactcacagttccacatggctagggaggcctcacaaaacttaaaattatggtagaaggcgaaggagaagcaagtaccatcttcacaaggtggcaggaaaagggaaagagcaggggaaaccacctcttatgaagccatcagatctcatgagaactcactcactgtcatgagactagcatggagggccacattgattcagtcacctcccaccaggatgctcctttgacatgtgggaattatagggattataatttgaggtgagatttgagtagggacaaaagccagaccatatcacaatctaattcatttgattaaaatatctctagtatctgttctttgaccctcttgactcccttttccccatctgaaatcttcagctttttttgtgatattgtaacagtggtacagtgaaggaaagcatgtaacaagcctggcccaaaagaaccattgtgtttcaacaagttcacatttgatagtttgataccaagggatctttttctggcacaggttgtttggttactcactgtgtcttttgtttctttcagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtaagtcttttatattttactttgagcccaccaggtgctttagtaactataaacaagcataatatatttaatagaaaaatagctgctttagtttttttctgaaccgtttataacatttatatggttttggtgccttctcctgtttcttgataccagcactcttgatttttatgatttgagatttgacaaagtaattcagttatccaagacccttatgtgtccctccatgcctgcttgatttcttcatttcttccttcctttcttttttttttttttgtgtgtgttttctacctgcttgatttttaactgaaattaataatgtattgctattttccagtaaagtgtacttattgtcttaatatatttgggctcaatgcagacctatttatttcatctagaaagttgtgggtggtactgtcattactagtgttattgagtgaaggtaaaggtatactataatgacagcaattttattcaatttctttattaagtaggtaatttccagaaatacacgaaccttacttcaccaagttcatataagagtaaaatcaggaatgagaactaaagttattcctttgttttctaaggaaattgtattaatagatttctcatttctgactctgtactcagacattttttttccctcccaatctggacttcatagtactgaaactaatgcttgtcagaaaaaaaaactaccttttttctttctttctctctttctccttccttccttttcttttctttttcttcttttcttcttttttcttttctttgctgagcttctcaaaggcaataagctctataatgttgtgctcttaattttagttttatttctgaatatggttttcttattcatatatttttttccactcttttttttactttcttgtgttgttctagaaccttttcttatttttaacttgtcttttctcattcattcagtcttagtttttaaacctctcagggaataacaaaataagtattccttcctttttcaaatatgtacatcactttttaagtaagaaaaaaattggaatagatgctaatcagggcattagtcaattgtttaataccagtcagatttcatagatacctgtttcagcctattgtctttaaattggtaagattgccttacccgtacaaaagcaaatcaggtaagatgtacacattttagacttcttggaataaagaattaactaattatagaatatcatagcttttgaactttgaagtattaactaactatagaatatcatagcttttgaactttgaagtattaactaattatagaatatcatagcttttgaactttgaagtattaactaattatagaatatcatagcttttgaactttgaagtttaacaaattggaaagttgacccatgtcactaataattatgcacaaagtagccaggcgtggtggctcatgcctgttcccagcactttgggaggccaaggtggatggatcacttgaggccaggagtttagaccagcctggccacatggcaaaaccctgtctctactaaaaatgcaaaattagccaggcatggtggcgcatgcctataatcccagctactcgggaggctgaggcaggagaatcgcaagtatgaaggggctggccaccccatccacattcgagccagaaatggggaggggagggaaggggagggaccagcatttccttctaagtccaggactcattttttgtgcacatcacttcatcttgcatcctgttggctagaacctagtcacctagcgacatctagctacacttttttattttaggcaagcttgaacccggtgggtggagattgcagtgagccgagatcacaccagtgcacaccagcctgggcaacagagtgagactctcaaaaaaggaaggaagggaggaaggaaataataatgcacacaatgaccttgccatcataagtttattttttgtagaataaagaagtcagtatttattcggtgatctgaagtgtttgataaacaaactgttcagatatcattaactttctgcaggtcagaagtgcacattcctgctgtctcagtacaatttggtgtcatccttgaagcatactgccggggaagtgtggggcacatgaaagtgctttctaagcaggtatcagcttgttttatttattcattttttctttttttgacagacaacgtttaaagcatgaatatcagcttgttttaatcttcatgttcaatttggtacttggtgtttgatcagttttatcaaatgccatttctcccaccacattatttcatagaagtctcagtaacagacaacctgatgaatacattcttttgtcaaaatttaagtcaaaaaatgaagtttcaatgaacttagcacaaaaatattaactgaatgctacctgaaaaataattactcggcattcctaatatattctatattaatcccaaagtgctaagaaatgcagatgtgaaccaccacacccagccccacccttttttttttttttttttttttgtgacagagtctcgctctgttgcccaggctggagtgcaatggcactatcttggctcactgcgacctccgcctcccgggttcaagcgattctcctgcctcagcctcccgagtagctgggactacaggcatgcgccaccatgcccagctaatattttgtatttttagtagagacagggtttcactgtgttggccaagctggtcttgaactcctgacctcgtgatccgcccgcctcggcctcccaaagtgctgggattacatgtgtgagccaccgtacctggctgccccaccctatttttatatcagattcctaatttccagttaaactactcttttctaattcatttgcattgccagaagaactctcataggcttccattaggtgtttttaatatttaggatttttcatgatgttaaaaactttttctgatcccttccttttgaaaagcccattaatgattgtaataatagctaatgtttattcatcacttattatgggtcatttattcttaacaacaacatggaatcaatattattaatcctctgaattttatagaaccctgaaatatatctcacatctctgcctatttcccttgtgttcatggctaccatcctagtccaagctactattctttttcactggacttcttcattaactatctaaattgtaccccttgtttcccttcctacatctcccccaacattctatacacagaagataaagtgacattttaaaaatgtagactgtggccagatgcagtggctcacacctgaaaacccagcactttgaaaggctaaggtgggaggatcacttaagcccagaagtttgagactaacctgcacaacatagtgagacccatctctagaaaaaattagaaggtggcttgcaactgtagtcccagctacttgagaggccgaggtgggaggattgcttgagcccaggaatttgaggttgcagtgagctatgatttgattgtaccactacaccctagcctgggcaacagagcaagaccctgtctcaaaaaaagaagtagattgtattacatcatttcccttttaaaatcccttcaataatttttcattgcactatgagtaaaattcaaattttctgccaaagcctgttaggccatacttagtcataacttgcttattgtcatcatataaccattttccacactgcatattttctgggagcctcagcttgatgttaaagacaataaaaggatgatatatgtatgaacaaattattctaactcctgtttttttttttttttgattgatgaattgtgagaggaagactttaccctgtacatagctgttcttgttattactataaacttacaaaaggacaaggtgttgaaacacttaaagtattagacttatgtccatggggtattcaggacactgttccaggaagtgtggatatcaacacaattagagatggagcatgaaaactttcaactgtacagacatggaagaagtttcaaatttcacatacttgtaaaaagttcctgtttgcttagcccagtttttatctggttgccttgtcaccagtgtttgtacagctcctgaaactgttgagaagtagagtgatctgtggttttaacagatggctaacttggtaagtttcagccatctcaattttatcatcaagctgcataggtccttcctagtttcctgtgagcaaggtctcagcctctgtggaaactgcatgcttgaattcatctccctacatagtcttagtggtttccttgcatagaagcagaatttaaaaatgaaaacatgttataaattaaatctcttgttcatggaatttcaagccacattgtttatatttgtgatagacatattttatatgcttgttacggtatactttttaattctatttttaacatttgttttttccagttttaatgatatacttgtaaaataagctgctccttctttatgcgtggctgaagttgttatgaattttatgtactgtgacataaaagaccctcagttattaaataataaagttgaattttatttgttgttattatttatttatttattttattttttgtgatggagtctcactctgtcacccaggctggagtacagtggcatgatcttggctcactacaacctctgccttccagattcaagtgattctcctgcctcagcctccctagtagctgtgattacaggtgtgcgccaccacgcttggctaatttttgtatttttagtagagaggaggtttcaccatattggccaggctggtcttgaactcctgacctcaagtgatccgcccacttcagcttcccaaaatactgggattacaggcatgagccactgcacctgaccctgatttatttattttttgagacatagtctcactgtgttgcccaggctggagagtgtagtggtacgatcttggctcactgcagcctccagctcccaggttccagtgattctcctgcctcagcctcctgagtagctgggattacaggtgcacaccaccgtgtctggctaatttttgtatttttagtagatagggggtttctccatgttggccaggctggtcttgaactcctggcctcaactcatccacttgcctcagtttcccaaagtgctgggattacagacgtgagccatcacacccagcctaaagttgaattttaaacataatggttttgatttagttggccattgttgatacaccttgtactacttgcataagtttttttttttacttgcataagttttgatagccatagttattataaaaacaagtaatttagatttgaataacaaatagcatgtctatattcacactttattataaaataattcgttctagctatgctgttaatggaaatagaatatattgagatatcatacaagagtgatgacaagaagtagatattaaggttgaatagcaagaacctcagagttacttctacataggtttttctctaatactaggaagttggccaaatggactggtttaggttagtgatgtctcaaattctactatacaatgaattgcagaattttgagtagtttaagtttcatatttatcttctttctttctttctttttttttttttttttttttttttttgagacagtttctcactctcttacccaggctggagtgctgcagtggcttaatcttggctcactgcaacctccacctccaaggttaaagcgattcttatgcctcagcctcccaagtagctgggattacaggcaagtgccaccatgcccagcaaatttttgtatttctttttgtagagatagggtttcgccatgttgcccaggctagtctcaaactcctgacctcaagtgatccagctgcctcagcctcccaaagtgctgggccacatttatcttcttaagtacccatagtgcgcacctggcccacatttatcttaagtacccataatctaagtctgcttttctcgaatttgtaagattttgtttaagaaaaggtttaaagaaagtttgaaaatgatgctataacaactgttaaaaataagtttattgtatgtaaaatgcttttcgtaagtcagacactatttttacttcagctggttatgtgtgtttatggttatgtgtatatgttgggagcaggtgttattgattgatatgatcacatgatattatattacttttagtcaaatgaatttttggtgtggggaacttatttttcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctagtaagtgactgtgctttgcgcagtgaatctcctatgaatagcaagcagaaagtcactgccttatgggagtagtaggaccagctgtcagcctcaggaagtagaatataattaaggaaggaaaatcttaaaagttctccgaggctatgcttatattcaataggatgtatgcttatcagctaaacttaccagtggatttagtgaaagttattacaaatgaatttatatttcaattatatgtaattaaatttattttctatattactgatttttaagagttgacaatcctaataagcaaaatgttgcaaactgtagtaaattatttactgattgattttcctattttaaaataagatcttgtcttgagtgaatttggcaacttatttctcactttctcattccctacaaaagtaataatggaaaataatagtctgtattcagtatattatcagtattcaaatgaatcccttgttaagaaatcaagaatggtctcaaaatagttctaattttaatccaatgatttgttctaattttttattcactaaatgtaataatgtaaagttaagcaaataaaaggaaacgagagaaggaatgttaagtggagaaggtgagaagggccaatcttaggttttgagtccagcctatctggcattagtatatgccacccaaggctgtcctcatggttgcttttctaccaagtgggactcttctaagtctgactcttctgcagacctgacaggaataggtgaggagttttcccaagcctagtatatagtggtaaaattataatcttctgtatcattacactgaagttgactaattttccccacttgatttcagtgttgaaaagtgcaaatacatggattccaaaatgaagcctttgtggctggtatacaataacaaggtatttggtgaggattcagttggagtgatttttaaaaatggtgatggtaagtactgagatttttaacatcaaatttcttagaatttttcatttgttgccattttgctttatctgaaaggtgatgtgtagtgtaagtgtgtaacaatttgcagccaggaaggtagctattaatggtcctaaagtcaagttgaacatgtcctaaatgctttttttttccccctcttataaaatgatttataccattcacttaaatatactgtcctaatgaaccttcttttatttccccctacaaaatacaaaacgcgcctactcctttgattaaaaagcttatgaaatacaagatattatttttacttttttttttttttttttgagacagggtctcactgtcacccagcctggagtgcaatggcacgatcttggctcactgaaacctccacctcccaggcccaagtgatcatcctacctcagcccccagagtagctggaactacaggcacacaccaccacacctggttcactttttgtattttttgtaaagatggggtttcaccatgttgaccagggtggtattgaactcctgagctcaagtgattcacccaccccggcctttcaaagtgctgggattacaagcatgagccaccgtgcccaggcaaggatattttcagtaatatattcatacatcttgtttcagtgatagcaatattgattttgctgccatagttttgtattttgatgaaagtacctaacagacccaaaatgtgtaaaggaaatgcctctgaagtaatcataccagccaataggcagtggtgacttgttagttatgtgactacaaacaaggcacagaaaactgattgagcttcaggtttttcatatccttgagaattatagcatctgtatgtcagggttattaaaaggaattgagataacataagcaaatgtgcttatcagaatatgtgcttacaacttaaaaagaactcatagggttttgctaaacatttaatgtcacttgaccatacaaatgtcattatgtggatgtcactagtttcatgtgctctcttccctgaaaatacccttagacatgataataaattgaaccattacagttttgtgacctcgtgatgcagttacttacgtgattcttaagaactctccgtatagtggtaaaagcaagcaagaaggaaaaaattaaccatgtaattaatgtaatacacatacagtgtaatacaaacagtattacagcatacaattagtacccctgaacccatgtgttatcctctcggacctctagtaagtgactgtgctttgcgcagtgaatctcctgtgaatagcaagcagaaagtcactgccttatgggagtagtagggccagctgtcagcctcgggaggtagaatataatcaaggaaggaaaatcttaaaagttctccgaagctatgcttatattcaataggatgtaacttacacatggcaaacaatttaaaaaatcttttaatttaatgtctgaaataatgtcacagggacatgctatccaaagagtgtaatatttgttataaaattagtgaaaatattagcacagagtttgttaatgtttttagttaattctgagttagtcttgaattaatgagttacagggcataaaaggaaaagcacttgtaatgaagcagtttgttttcccttagatttacgacaggatatgttgacactccaaatgttgcgcttgatggatttactctggaaagaagctggtttggatcttcggtgagatctagtctttttttttttttcagtctaatgtcttcccatagcaaaaatatctagaatttcttgttaattccttccctcttgttcttatttttagttgttgttcataataatatttatatagcactttagaatgtactttcaaatatgttgtcttgcctaaactttttcagtttaaaactacacatgttactgaaattccagaaagaaggaataggtttgaactttaataaggtttggacagacagccagaattacattccaacctatggtgttgaaagatgtactgtgggtcatggcaatgacaaggccagagaaagtcctgtgcctttttatacttagtccagggacattgatttctctacctaccaagggaaaagagaggaaaatgtttaggtgcattctcaggtttttagtttgccaccatcaataggggtagatagtgagcggaagaggtttgtggtgtcgtgacagaaaaaaggaaacataaaatcaagcctcagactgggaatcgtattcacaatgaacagaacaaggggtaaatatttaaagagcccatagaagtgaacataaggaaaagatgtgaaaaggcattttataaaaagtataaaaacaaactaataggcatgttggcacacacctgtaatcccagcactttgggagaccaaagcgggccgatcacttgaggtcaggagtttgagaccagcctggcccacatggtgaaaccctgtctcttctaaaaatacaaaagttagccaggcgtggagcacatgcccgtactcccagctactctggtggctgaggcatgagaatcgcttaaacccgggaagtggaggttgcagggaacagagattgcaccactacactccagcctggatgacaaagtgagactctgtctcaaaaaaaaaaaaaaaaaaaaaaactaacatgaaaattgtcagttccaattaagaagtacagattataagaacaattgggccgtgcatggtggctcactcctgtaatcctagccctttgggaggccgaggcaggtggattgcctgaggtcccgagttcacgaccagcctggccaacatggtgaaacccagctctactaaaaatacaaaaaattagtaggttgtggtggcaggagcctgtaatcccagctactcgggaggctgaggcaggagaattgcttgaacctgagaggcggaagttgcggtgagcgagatcgtgccactgcattccagtcagggcaacaagagcgaaactttgtctcaaaaaattaaaaaaaaaaaagaacaactggatatcctaacaaagattttcttaaatgataatccagtctagggtgctattgaagcaacaaaaacacaggtatttttatatactattataaattaatataaaccttaatgtatgaagttaatttatactctttatatccagtatttccacaatttactttaaaattggaattgtagacagagatttatacacaaagatatagtccagttcatcagtgttttcaaatttattaccacatatttttttataacatcctcttgtaattttaaaatctgtgctatgctgtgtctaatatttttcttcttcctcttttttttttttgagacagtctcgctctgtcacccaggctggagtgcagtgacacaatctcggctcaggggcagcctcgacctcccaggctccagcgattctcctgcctcagcctccctcatagctgggattacaggcacccaccaccacgcccggctaatttttgtatttttagtagagatgggatttcgccatgttccccaggctggtcttcaactcctgacctcaggtgatctgcccgccttggcctcccaaagtgctgggattacaggcgtgagtcgccgccccctgtcttttcttctttttatatgcagctattgtcagttattattagagatttgcttccttattagtatggtttcagctgggcttctaattttgatgatttttttgcttcctactttatcagttattacttttttttttttttttttacttttgtgtttattctgttctcattttttaaaatgaactcttggctgggtgcagtggcttacgcctgtaatcccagcactttgggaagccaaggtggatcactttcgctcaggagtttgagaccagcctgggcaacatggtgaaaccctgtctctacaataataataataataataataataataataattagccaggcatgttggcatgtgcctatagtcccagctacttgggagctgaggagggaggatttcttgagcccaggaggtcaaggctgcagtgagccaagatcacgctactgcacttcagcttgtgtgacaaagtgagaccctaatctcaaaaaagaaaaaaaaagaactcttaacttttaaaatggaaatatttatgtactttcataatatatcaaacagtatataaattctaaatatttcataatttctatttttatcttattgactcctgaactatttaaaattacagctggatacagtggctcttgcttgtaatcctaatattttggaaggccaaggtgagaggatcgcttgaacccgggagttcaagactatcctgggcaacagagcaagaccctagctcagtaaataaatagataaataaataaataaaatttaatttccaaaggcatacttttttgttctctttatgatttctaattttattgtgttgttattgtatcaagtatatgttcagatctatattctcattaaacttcagttttgatttgtcacttcgtaggtatgttacaagctcctattataattgacatttgtcattgcctgcctgaaatcttatcagtttttgtttatcttgatcttatatttgttttttctttttttgtttgtttgtttgttttttgagtcagagtcttactctgtcacccaggctggagtgtagtggcaggatctcagctcactgcaatctctgcctcctgggttcaagcaattctcatacctcagcctcccgagtagctgggattacaggcacgggtcaccaggcttggttaatttttgtatttttagtagagacgaggtttcaccatgttggccaggctggtctcgaactactggcctcaagcattgatcttatatttgtaaatctatacaaggtttgatttcttttagcttctgtgccctcctttatcattaagaaatatgcctcttaatccctagtaattttgttttagtctgttttgtccaaaattgacatttgtataccagcttattttggttagtatttacctttgtatcttttatttttaacttttatttcattttatattatatttgtctcctgtaaatagcatatagttgaatttttttgtgaggatggatttactccaatatgaatgtattttattaggaaattttaattgtttattgtgattactatatacttatttatttctactatcttattgtatgttttatatttacatccttgtttttgtcctttttctcatttatttccttttattggattgataggggttttaaattttcattttccctttctataaaatactttttaaattcttacttattaaaaaaattttttttagagatagagtctcactgttacccacgcttgagtgcactggcatgatcatagctcactgctgccacaaactccttggtaacacaatcctagctcactgcagccacaaactcctgggtagcagaatcatagctcactacagtcacaaactcctgggtaccagcaatcctctcacctcagcttcttgagtagctaggactacaggcacatgccaccatgcctgtaatcccaagcactttgggatttaaaattttttttgagagacagagtctcactatgttgctctctctggtctcaaactcctggcctcaagcgatcctcccacctcagtcttacaagtatctgggattacagacatatgccaccatacccagctcttatatagaatctttatatactatattatttattttagggaatattcttaagtttttaaactgcatatttgatttaacaagttttttttgtttgaaacgggagtttccctcttgttgcccaggccagagtgcaatggcacgatctcagctcactgcaacctccgcctcccaggttcaagtgattctcctgcctcagcctcccgagtagctgggattataggaatgtgccaccatgcctggctaattttgtagttttagtaagacggggtttctccatgttggtcaggctggtcttgaactcccgacttcaggtgatccgcccgccttggcctcccaaagtattgggattacaggcatgagtcaccgcgcccagccagatttaacaaattccaaaattaatccataacttagccctcttcttgatcattataggtactttaggataaattctaccacttatattttaactaatatttaacaactccttatattattcgttacagtgaatttttactagaatttcttgtatacaattttaaatatttcttcattcaccattgctttttgtaccatactccctcactccgggttttgtctgaaaatgaatttatattaccctcaatcttgagtaaggctgggcacggtggctcacgcctgtaacccagcactttgagaggccaaggtgggtggatcacctgagatcagtagttcaagaccagcctgacaaacatggtgataccccgtctctactaaaaatacaaaattagtgaggcatggtggcacatccctgtaatcccagctactggggaggctgaggcaggagaatctcttgaacccaggaaggggaggttgcagtgagcggagatggcaccattgcatactccagcctgggcaacaagagcgaagctccatctcaaaaaaaaaaaaaaaatcttgcataatagtttagctgggtatggagtttttgtttactattattgggatacagtataattgtcatatcacaattcactggtttagagtgtacatttcagtggttatatgcattttctgagttgtgcaaccatcaccacaattaattttacaacatttttatcaacccttcaaaaaccctgcactccttagctgttacccccaaccccctccctgaaaccactccaattctaggcaaccactaattaatggtctatagatgtaccttttttggacattttatataaatggaaacacaatatggggcctttgtcactggcttctttctctaagcgtaatggcttcaaagtgtattcatgttttaacagtaaccagtatttcatttcattgtcaaacaatattcttttgcaaggatgtgccacattttatttatccatacatcagttaatgaatattttggttggtttcactattttgctattacaataactgctataaaactatacatagataaatgtacacagttaatgctataaacatttgtgtacaacttttgagtcaatctgtgttttaaattcttttggtaaatacctaggattaaaattactggaactgatgttaactttatgttcaactttttgagaaactatcaaactgtttcccacacagctgcatcattttacattccaaccagcaatgtacaaaggttccaatttctcttcattctcaccaacacttgttattgtccatctttttttattatagccaccctagtaggtttgaggtgttatctcattgtggatttaatttgcattttcccaatgactaatgttgttgagcagcttttcatgtgcttgttggttatttctataccttttttggtgaaatgtccatttagatcctctgctcatttgtaaattgggttatttgtctttttattgttaagttataagaattctttatatattttatatactagacccttcttagataaattatttgcaaatatgtttttctggttgtttgttcactttaatttttaaatagtgtgtgtggtaggaatccaactttattcttttccatttagatgtatagttgtctcagcaccatttgttgaaaagattattctttcttcattgaattatcttggcatctatgtcaaaaatcaattgattgtacatgtgaaggttttttcctgaactctaagttcaattctatatgtctgtccctatgtatagttttgattactgtaaattaataataagttttgaaaccaggaagaatgaatcctccaacctttgttctttctctcttttcatttatctgggattgtgttaatttttcctttgtttctgaataagaattttgctacttgataggttttctttcagcatgtctaatatgtcatcccactttcttctggcttccctggtttctcatgagaaatcagctgttaatcttatttaagatccttgtaagtgatgagtcacatctctcttgttcctttcaagattctctttatttttggttcttgacagttcgattataatatgcctacttctattagagtttattctactttgaattaattgagcatcctggacatatatattattgtttttcataaaatttggggagtttccagccataattttttcatatattttttctgcctctctctctcatctccttcttaaacgccattatgcatttattgctttgcttggtggtgttctacaggtctctaaggctctgttcttttttcttcattattttttcttttgtttctctgattggataattgacctatccacaagtttgccaattttttattatgctcatatctgctgttgtgtctacctggtgaattttaaaatttcagttattgcccttttcaactctggaatttctgtttgattcatttaaataatatctatctattgatagtcttcctttgttgatacatcattctcacagttgttttgttttgttttgttttgagatagggtcttgtgctgtcgcccaggctggagtgcagtggcgcggtctcggctcactgacacctccacctcccaggttcaaacgattctccacctcagcctcccaagtagctgggataatgacaagcggccactacaactcctggctaatttttgtacttttagtggagacagggtttcatcacgttggccaggctggtcttgaactcctgacctcaggtgatccacctgccttggcctcccaaagtgctgggattacaggtgtgagccaccgcccccaaccttatagttctttaaacatggtttcctttagttctttgaacatgtttaaaatagggatttttaaatctttgtgtaataagttgaaaatttgattttcctgaaggacggtttcattgaatgcatttttcctgtatgtgtgccatgcttttttgtttctttgtatgtcacatactttttgccaaaaactgttcactttaaataattttacaactctgaaactcagattccttctcccttcaggatttgtcgttgtggctgtttgtttattttagtgacttttttgaactaattatgtaaagtttatattttttgtcatgtgtggtcactgatgtctttacttagtttattggtcagctaatggttgacctgattttcttaaatgcctggaatccacccctcttccagtctgctgaggcactttatgcacatgttgggtcatgccttcaacagtcagcctggtggttcagaactgtgccttagccctaactttctgctttcacaaagcctcaaagttagccatagttgagagccagggctttgtaagctctttcctttgcatgtacacagacctgggaatccacaatagtatccatgcacacggccttctagattcctaccagtaattttggagcttttcagtgcaccatatggacatgtaattacctaccttttccttttaagctttcagttagcttgttggttcccccaactgttatttacccccaagacagctacaatgttaaacagatgcctctgagtatttttgagaaactccccaggaaaaaggcagttcatgctaggtgaggtctgagtcaggtcaaataaacatagtattgtaagtgggatcttcctggaaactaccagagaggccaaagaatgacagttctgtgggaatcaggctttgaaggagctccaacttcatttttctttcctctagtggctgtcagacatgcattcaccatgattgtgggctatttgttgtcaaggctaccacataactgggaagggggttgggactaggccatggtaaaacaaaacagattcacgttggggtgtgtgtgtgtgtatgtgtgtgtgtacgtgtgtgtgtgttttaaataaacacttattggattgctgcaagcctttgttttattttcagaactctaaaatagttgatttcaacaatttttgtcagtattcttgttgcttttatggagaagtagatattcagagtttgatatcatttggctatagaagtttgaaatccaaattgactgctttcctcagaagccttgaggatattattcatttgtcttctagtctcggtttttaaaaagtctgttctcggtctggttatcggttctttgtaagtaatgtcttttttacaccttagtgcatcaaaaagtttctctttgcctttgtctgcagtacaatctgtgcgtgtgtatttcttttatttcttttttttatcaccattttcattgtgccttttcaaagaagtcacatcttttagtttctgaaaactttgaacatttccttcagtattgcagttctcccactctcattgtctttttctgcagctctagtagatttatattaaactttcctgttctctcctttatgtctcttaaccttccatattttctatcttttcatatcttatcattataacagttttactcaagtctctgtgtgctctggcgttgagaccaggctgagtcttttcatatctttatgtgactttcttagtaatttcctattcttttccagttcattatctctgcaacaatgtttactctcctgtattgtattttttttctgcttagactttctattctttttcatctctttctctctctctcttttttttttttttttttttcaacggagtctcactctgtcacccaggctggagtgcagtggcacgatcttggctaactgcaatctccacctcccaggttcaagcgattctcctgcctcagcctccccagtagctgggattacaggaacccaccaccacgcccggctaatttttgtatttttagtagaggcagggtttcaccatgttggccaggctggtcttgaactgttgacctcaggtgatccgcctggctccatctcccaggtcaaagtgctgggattacaggcgtgagccaccacgcccagcctaaagtctctttcagattgttcttttttagttcttgggatattactttttcatttatctgcgtgactttattcatttccttatatagttaataatactcagttttgaattcattattgatggataattatgttttctgtaaaggtcctttgctccctgggttgtgaatggatctctaaaaatgagtttgtattttgtttgagctgttgccaaaggcctgtacacacaatcagccagtttttatgttaactccctgccttcagaccatcacacctcatagatagtttatatttagatctcataagagagtgtgggaaggcttgaagttttgcacttacatgaaactttttttttttcttgcctacccagtttctggggtagatgggaaactttcatgccacatcatctgatcaatgaaaagatatttcgagttccagtcctcccagacctcagttttgtgtagtgtgggatatgatgaggttcctcttcaaataatctgatcaatcttttgttcgttaatttatagaacccccccactttttttctcctttttctccttttttttcctttttgcctttgttagatccccaggcacaccacagtaccaagcgttatcagtaccagctcacattcctttccttatttagaaagaggactaactttctagctcattacagacaccccttcccctttctctccactttttcttcatgtgcccaccctatctaaaaaaattcagatgtttagccaaccaggattagtttagattgtacaacccaaccccagccaatggggaaagaatgcagaggcaggacttgcgtcaggaataaaggctgtcgtgcccctttgttcaggtgtgctctcatggcaactggccaaggaggcacccctctacgcagaagtaaaattgctttgctaagaatcctttgttcaagtgttcagtttccttaggattttgagtgttattcctaacagttctttgtcgggtccagatcctacctcatgggcctaagtccgtgactgtttttggtgggcattgaaatgtcagccaagtctaacttcctgagccactgctgtgagaaatctctatttttggaacctagaggtctttttttctttcttttttaaccacacctatttataaaacctttggacttcatcatttttttaatgtgatttagtatctgcaacaaccttagtctacaaggttgctggaaacggttagacgtgtgatcgactttgttcctgcaagattataatatctcctgattaatttcttaagtttcagttatagtctgttattatgaaacatatgtgtatatatatttttaaaacttgcaacccttgctgtttattgactgaaccaggcattgtattaagttcttctcgtaagtaatatcgtataggcttacatatctatggggctatgttatttctttttaacacattaaaaattaaaatgctagaggttttaaacaaaggttacagaaatattaaatggcagagctaaattcaaatccaggactgtcagactctaaattaatgcctgtttattattttaccagtctggctaagtgagaaaataatgtggtaagacatgtctagtactactctttgtttatcagagtataatggtgcctaaaatacctaaatttccttttttttaaaaaaagaaataattttttatttttaggtttttccaagttacactttccagtagtgtaaaggtagaaagagcaatttgggattgtagctgtgattagaataaagaaaagagatcataattcatctaaaaaggacactgtggctactacaggtgacagatttttttcttttaaattaggaggaatttctaatgcagctgtgtaaaaatagaattagtagctttgaataggtagctagtttttcaaacactcataaggtatactgcatagataagaggaataggtcattagaataaactgtctgcttgaggaccataaacccagttggacctgggctacctgtttttgtaaatgaaattttattggcacacagccacttggttacatattatgtatggctgcttttgtgctgcaactgcagagttgagtgtttagtctgtagtgcctaaaatatttattatctggctcattctgggaagagtttaccaactcctcctatataaagtaagcccccaggaatatgtttttacttgactgatcccacaaaaaaggagggaaactttaagctgaagtttagtaactcatttgttctttccaaggttagcacagaagctacacagtggtctcctttgctaattagtagattcaggccatatcatgagcttcatttagttatgaaaagctaagctaaagactgtttcctggcattcttagttccatcagcctaattgaaaaccccaaccaagttattctctcttagttttgattttatttatctaaatgtaaagcacatttagcatcaaatgaagttcattgtgacctcagacaatgggaggcacccacatgtgggagtgctggaaataaacctagtgtctagctgatgggaagcattgtgcgaagaaaaaggaacttgtctgtccagtgagatctttgctgactttttgtactttgaccccatgtttttaaaaaatgaaggactttaatttttttttaagttcatttccaaactggtacctttttctcaccaaaccttttttactgtttctataaatatatgtgctccaatgtttctattttgtttgttttttctttcggccagctgtttaggttaaagtgggtcatgtagcacacactcttttaaggtcaatcccaaatcttgaggtaccttctgtacattactgttttagtacttgtaacagtgccatgtttgcatgaatgaaaatacataatgctcattttcatttttctatgacgttccaaaatactcttttgatacctttcatgtcagcttagatcatttataagacattgatgtgttaggactccctgacctcctttggtgaagaagtaataagcaaatcttataggctggctacatataaacctatctggccgtgggtagatttgccagtcctctgcacacccccactctaccccaacaaatacatgtgaaatcaattttttgacagttgcctccattaagacttcatatctgaattacactaatggagtttacattttacatccccccccccttttttttttttttttttgagacagggtctcactgtatcaccccagctggagtgcagtagcacaatcatggttcacggcaacctcaactccttgggctcaggtgatcttccatctcagcctcctgagtagctgccacaggcacctgtcatcacacctggctaatttttttactttttgtagagacaaagtttcaccatgttgcccaggctggtcttaaactccttgactcaagcagtccgcccaccttggcctcccaaagtgctaggattacaggcgtgagccaccgcacctggcctacttcccttttaagagacctatacaaaagttatttaatgatagtggtgtcagcatctcagagggttggaggaagaaggtggaaataatgcaagcattaggtaaaagatttaaacttttctcctttggaagccatggctaaggtactactcagactttggtcattgtgtcagagtcagaatcagagataagaaagataaataccacataatatcactcataagtagaagctaaataatatatacacatagaagcagggtgtgggttgatgggtagtggggacttagagggatggcatgggtggttgatggcaggttgcttggtgagtacaatgtgtgttgctacagtgatggatgcactgaaggccctgacttcaccacagtgcaatatatcaatgtagcaaaattgtacttctaccccatgaatatatacaagttgtaaaacaaatttttaaagccagataacttgctatatacctgtttagagtaaggatatggagctgccatccccgtgttgtagaatttatttcatttttaaatgtttgatttagtgtgaaaggtaacagattgctacttcagtcagagagtctgagaaaggagggtaaacattactgaaattgtagtcttggcctttgtaagaagtgtagaagttgagtgcagagggtacctaggtgagatgattagggctccaagagtttgtccccagcttgacttctgtcaaactctctgagaaggatgttttttccttctcattgtgaacattctaccctcaaggcactgaaagctttcatcgttgcctgcttttgaaaaggaagttattggacttctgcctaccttggctgcaactggagtgagaggagatgcaggaaagtgagaaagtgcactttaacctggcagtgtttgctttacatgtgttatgtcatgataagaataaggggtctcattaaaaacattaatgctgcattaggagaatgcttcattctcttattttgtattttgacagttctgcccccaacctcattttgctagaactagaaaagtgcttttattattatttttttctgagatggagttttgctcttattgcccaggctggagtgcaatggtgcaatctcagctcgctgtaacctccgcctcctgggttcaagcaattctcctgcctcagcctcctgagtagctgggattacaggtgcctgccaccatgcctggctaattttttgtatttttagtagacacagggtttcagcttgttggccaggctggtctcgaacccctgatctcaggtgatccacctgcctcggccacccaaagtgctgggattacaggcatgagccaccgtgcccggatgaaaagtgcttttaaaaaagcataccccgtctctactaaaaatacaaaaaaaaaaattagccagacatggtggcaggcgcctgtagtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcttagtagttactcaattttagatttatctgattgtgatacatgctaacacactcatatactccctcctccccacaacacacacacagcctctctttgtcgctcataaagtccttcggaagctttctcagtgcttttaggagtatgacagaagtccttacatggccaacaggaacctgcatggtcttttcaccacttactgtgtcttcctcatctttctgttgtgctcccccttgtgctctcctccagccctgctgtcattcctccacatggaagtctttttttttttttttttttttgagacagagtctcgctctgtcgccaggctggagtgcagtggcgcaatctcggcttactgcaacctccgcctcctgggttcaagcgattctcctgcctcagccccccaagtagctgggactataggagcacaccaccacgtccagctaatttttgtatttttagtagagacagggtttcaccatgttggccagatctgctgacctggtcgtgatctcctgaccttgtgatccacccacgttggtctcccaaagtgctgggattacaggtgtgagccaccgcacccggccaggaagtcttttttgactcctgccatgttctcctggcacttcttccttatacagagatcacacatgcacattgtacatttgctcagtgagtgtagggactgctgctctggttttcttgtttgtttgttgcttatttctgtatcaccaggatctaacacaatgcttggttagctgtacccgagtatttactgagtgcatgaattccatccattgtattttctgtagctacctgatctttatttgaacctttcaagatatctcattccattttggtgttcttattataatagaaattagagaaaatatttgcaaccaaaatgagaaaaaggtaatattaatatacaaagagctcatataagttactgaagaaaatgtctaaagccctaataaataggcaaagaatgtaaatagctaagtcacaaaagaaatcttagaatgcttaaaagatccaggtgcaatggttcatgcctgtaatcccaacactttaggaggccaaggcagtaggatcacttgaagccaggagttacaagcttagcaacaaagcaagacctcatctctacaaaaaacaaaaaaataaaaaaactagccaggcgtagtggcactcacctgtagtcccagctattctagagccaagggagggaggattgccttgagcccagggatttgacgctatggtgagctatgatcgtgtcactgcactcagcctgggcaataaagagacacactgactcttaaaaaaaatggccaaaagagatctgagaataattatctttactaggcatcaaataagtgcaaatcaaagcaaactgccacctattaattgagcaaaacatttaattgataatctatttttcagaatgtattggtctagttagaatatcaattcttacctttctgacagatgactagtcctttgtaaatacccagtcacctcttttcagttaaagttgctgtctccaaggagtttgcaatctaattggggaggtaaaatctcaactcaagaaatgagaagtcagcatgaaaacccattgatgtcgtattgcttttgctgctctgatgtggtggctcacacctgtaatcccagcactttgggaggctggggtgagaggatcacttgaacccaggagttcaagagcagcctgggtaacatggccaaaccctgtgtcaaaaaaagtttttaaaaattagcccggcgtggtggcacatgcctgtagtcccagctactcaggaggctgaggtgagaggatggctggaggctggcaagtagaggctgtaatgaactgagatggtgccaccagaaggacggagtttcccttaaccaagataatatgtatagtggctagtctggcacatggcacttactgggtattccataaagagtagtttatttccccaaaatgtagagtaagagtgaaagactttgatccaatgtacttctgtccacctacacaagcaaatagaatgtttcaccagaataattagacaaaaaattttatatgtaattggcacattggaatccttgtaaattactccttctgttggccaagagatttactcctttggtggaacttgtgtttttccatatgacaataatatagtaatggcaagtatatcaataataataaaactttttttaaaaagtaaagggaaaatcttaccaaattaatgtttcattttaaggaaaatatgactctatgcccatttttttccttccaggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctgggttagtttattctgtttaattatcatttttctgtacaaacagccaaacaaatactgtatgctcccaatagaagtcagcagtgtgttagaggaaatattagtgttttttatctattgcttcatttcttgttagaacaaaatgacacatagcccttcgtaaagtcttgtaaatggtgaatgttgaattctactttatctaaatcaaattttggagccccgcagtaaagttacaatctatgaatttaagtatttaaagataacatactgaagcctttgttcaagtgcatcagcttctctaattatgtgaatatatgaacttaagtgagtttttaatgagttggtagattgtgatttctccaaactaaaaaatgcaatgtttggaattatggctatggtgttagaaaagcactaatatataggaaataaaagaacttcacagtgtgagggggaaatggtctgcaagtatttttggctaaagacttcagagtcagacacattttatcgagaacttgtaatatgcaaatcagtttccaaattttgatcttaaggccttgtctccagggaatctctattacttacttctaattgaaatcagtgacttaaatgtttgaaactgcagtgcttaactcttaaacatgaaattgtagtcagtctttggtcaaaactaactaaaatgttcccaacccctagcatgatctagcaaagccatggtctcttctaagtactgtgaacatgagtctactcacagccccaccgaaacacagctcccaggacgtttgaatatctaaggcccagttatttaatgtctttgaaggcagctctctcagcccagcccctgtgaagaccacccacactccccttggctgatccacatgttctctcatacggttttggcagctctgtgttctcctcacaattaaaaaggaaacagaggtatggtttgggtctcactctacacgcttggaggctgaaaaccttttttgcttctgttcttttctcttgttcagggatgacctggaccgagccattgaggaatttacactgtcctgtgctggctactgtgtagcttcttatgtccttgggattggtgacagacatagtgacaacatcatggtcaaaaaaactggccaggtgagctgctcctcaggatctgccaagggccttagtaatgctatttcttatgtatagcataatctcttgtgcaactcagccagattcttttgtgattcttagtgtcatatctttgtctttacttcaatttctcactacctctcgtttcatatatagtctactacatgtattcatttgtttgcttgcttgatggtaagcatttatttgtttaaaaaattactaaaggctgtgtgtggtggctcacgcctgtaatcccagcactttgggatcccgagccggccggattacctgaggtcaggagtttgagaccagcctggtcaacatggcgaaaccccgtctctactaaaaatataaaaattagccaggcatggtggcaggcgcctgtaatcccagctacttgggagactgaggcaggagaatcacttgaacctgggaggcggaggttgcagtgagccgagatcgcctcactgtgctccagcctgggcaacaagagtgaaactccatctcaaaaaaaaattattgaaaaaatttttgtagttaaagtggcctgttcttcaatataagaaatagtatttgggatacatttgtacctaacagaaggagcggataatgtactggatgtattaaatttaaagattaccaatgctattcatatcctttgcccactttttgatggggttgtttgtttttttcttgtaaatttgtttgagttcattgtagattctggacattagccatttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaagttttcttctagggtttttatggttttaggtctaacgtttaagtctttaatccaaaagaagacatttatgcagccaacagacacatgaaaaaatgctcatcatcactggccatcagagaaatgcaaatcaaaaccacagtgggataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatataccatggaatactatgcagccataaaaaaggatgagttcatgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaaggacgagttaatgggtacagcacaccagcatggcacatgtatacatatgtaactaaccggcacattgtgcacatgtaccctaaaacttaaaattaaaaaaaaaaaaaagattaccaatgctaaaaaaaaaaagttgggatgaaccccacttgagttattttctcttttagaacatcatacctaattatatatgggagaagggagaacagtcgtgtgagtaatagcattctggggtacctagggaatctagaccatgttgtttataaagtacttaagttttcaaatgaaaatttcatttttcagagtgacatatttgtaaacactttttatgttaagcaaaaacagatgagatatcttagataatttttcagtttagcccccctaggaattcccacattagaggcatactagaatgaaaatctctctgggtcactgtgtgaactttggttctatgagggacccacagttttgtatctccttggaaatctggattagttctggcttgggctttgagagttgatgtggaatgaatttgtaatgcactataatacatgaatgcaccatgtacgattgaggaatctcgtgtccatacttaaaaggagtcccttggacttccgtccaatcacattaaacacttagatttatctccattttcttcttttacacctctaaaacaataataaggaattaagaaatatataaactcaagaagtcaaagatgataggaaaataggccacagtgggtgaaacctattaccagacttcggggtgatagaaagtgagatagagaagtggcagtgacttagcagaactgagaaaatagaaagtcagtacttgtaaaggggtacgcaagtcccataaaagctctggaatcagaggcaccatgtatactgttcaaggagggatacagaaagaggctgaaacagaactagttggcagcttatatatggaacagttaggcactcaagtccccttccctatgccaagaaggagacagatttattctctgaagaaactggttctgactcaagcacacttatttctacagagactacaagaaagggtcccatattaaaaatggagatggagtgaaagtcggcgtagtaaatggtacaatctgcagccacttccacttgctttattctaagaacagtggcagccagatgtatagttgaccctcatcaaaagactaggtgattctattctagaaatctgattggttccattgaaaagtcctgcagatctgacagttgagatttctccctagtttctatacaaggaagtccaccaatcaacaagcaagcctaccatgtacatagaattttcattcagctttttagtgattcattgttaaatatgaatggtcagctaaggattaatatacttttaaaaaatgacaaaaattgaatatgtttatcatgtacgacatattgttttgaagtatgtcttcattgtggacttgataaattgagctgacctgtgtgttacctcacatacttatctttttttgtgatgataacatttaaaacctagtctttcagcagttttcaggaatacaatatattgttgttaactatagttgccatgttgtaagacagatctgttgaacttattcctcctaagtgaaattttgtattatttgaccagtatctccccagcacctgcagccaccattctactctctactggattagcagacatttaagggaaacctctaccatgaaagatagaaaccaaataagcaaaatagggaagaaaagaaaagaactctgggaaaacagggtaactgcagtaaacagagggtgattttaaaaatcaaagcaaaaaaatatattgtatctttaaagtaataataggattctgttttttacaatcagcacatagaggtcttgaaaattagaaataggaacaaacaaaaagttaaaatagaaatagtgtaaatattttgtggcaggcatagttgtaagtgctttatatataatctaatgccttcaggcctgatgacaaccttatagagtggcggcaatagccccattttacaagtgaggatattaaggcaacagagagtagacatatcaggattttaaccctgggagtttggctcatattctttttttttaatccaccatgccttaatatctccaaaaaatatgataaatagagagaagatccagaaacaatagagactcagtccagggaggtatactctcagcctaatggatattccagaaagaaggagaatggcgtgaacctgggaggtggagcttgcagtaagctgaaatcacgccactgcactctagcctgggcgacagagcgagactccgtctcaaaaaaaaaaaaaaaaaaaaaaaaagaagaggaaagaagggcacttactaagcaaataatatactaagacatttcccagagccaatgttcatgaatatccagtcaaaatagcacaaaaattttctgagaacggaagaaaaacacccttactaagtacctgcactatgaaatttcagtgcatcagacgtaaagagaaagtcttaaaactttcacagagacacagcaggccacataccagagtttagaagtcaaaatgacttggctcctcaatagctacattggcaattataagacagtgcacgttagccttcataattttgagggaaaatgatttctaacctaaaattcgataaccaaacttttttttttttttctgagacggagacttgctctgtcgcccaggctggagtgcagtggcgtgatcccggctcactgcagcctccgcctcctgggttcaagtgattctcctgcctcagcctccccaggcagctgggggaccacaggcatgcgccaccacgcccagtcaagtataaagggtagaatgaagacatttttccaacttgcagggtcacaaaacttgtcactcctctgcatcttttctcagaggctgccagaataaggacatctaccaaaacaagtgcctaaaccaataattatcaagtggggtgatttttcactcaggggacatttgttaatatatgaaaacagttttagttgtcataactggggggtggggtagtccagtggatagaggccagggatgctgctaaacacccatacaggacagaaccccatatcaaagaattatatggcctatgtcagtgtgtgccagtattgagaaaccctggtctcaaccaaaagagaatgtgatgtgggacacaaaacgggctccaaatgggagaagaggaaagggaaggcccaggatgatggctctgcagcaacaccggagaacaaccagcccagctagaaaccagtagattacctgactgtctggaaaacagttttgaaaatgatttgtagatttgttgttgtttgatttgtagatttttaaggagagtttgggaagaattaatgctaaggtcatagaacactaagctaaatgaatgaatgaatacatgcgtacagttttctaaaggaaaaaaggtgaacatgtgaaaaataaaaacactgaatattgatgtaaccagaaattatgacataatgtgccacagtgtgtagcattatgttagcataaaagtactaaatctttatcttccataataagaatagtaatatacaattagggagcaaaaataaatataaacatattatttagaaaaatggaggcagacaccaggaaaaacacctagtgagaagagtaagaagttacctctaaagagtagcactcaatgtggggagctagtagggcaaggatgtacttttttgttgttgttgttgttgttgagacagggtcttactctgtcacccaggcaagagcgtagtggcatcatcatggcccattgcagcctcgacctcctaggctcaagcaattcccccacctcacccccctgagtagctgggaccacaggtgtgtgccactatgcctgactaattttttccttcatttgtagagatggggtctcgctatgttgcctaggctggccttgaactcctggtttcaagtgatcctcctgcctcagcttcccaaagtgctgggattgcagacatgagccaccacaaccaacctgtactcttttcttgttatgttttatagaactatttgactttttaaaaatcagacattttaattctttggatgtatttttctttctaaagcgtctccttttccactagatatctacagtttaatatcagggttatttattattgattgtaaaagtcttaagagtgttagatatggtctcttctcacctggctcagtgggctataaacagagggagaagggctcagatgtggatgggtatagttcctgggggtctaggactatggaggttttgcctttatatttggaacccaccagaaaaatgaaggaaattaaatcccatttgttttccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggtgagtactgcccttgtgccaaggctgaacacttctaacattttcttatctgaccaggtggaccagcatttcttagctgagatatatttggatctgggagatattcagtctgattataggaagcttttgggggaatttgcctgtcagattattgtgctggttcagaaattcccagataggagaaacagaatgctagaaatttaaaataattattatattttattccaataatatactaccttttacctgtttcagaacattctctgaaactattaagacagttgataggaagatgctgaaaagacatctgctgtcattgtgtatggagtacagtaagggaactagaattcagggcaaattttttaatctctgatctattactggctacctacatgttcccaagcataatacttgtctttttgcctttgtatcatcttaaaatggggacaaaaatatgaaattaagggctactatgatggttagagacatatcatgtaaccaacacatacttaacaaatcattgtcactatcctttatagttctgtttgggtttctgcagaatatacctcagtgggtctagttttctctttggcaaaataaggggatacgattggatggtcctcagcctggcgcggtaggtcatgcctgtaatctcagcactttgggaggccaaggcacacagatcactggaggtcggagtttgagaccagcctgaccaacatggtgaaaccccgtctctactaaaaatacaaaaagtagccaggtgtggtggcacacgcctgtaatctcagctactcaggaggctgaggcagaattgcttgaacctgggaggcagaagttgcagtgagccaagatcacgccactgcactccagcctgggagacagagcaaggttccatctcaaaaaaaaaacattggatgatcttcttgagggaccatcttgaagaggagagagagggaaggcaggatgacaggaaggagcaaaagcactgacactgattgaggggacttttaaaaaattagtttctggaatcagaccacaaatatagaacccagaagtatgttcagaaatccttgtggattataattataactgatttaataatcagttcttgtgtctcatagaattaaaaagtctagattattattaaaaatgtaatagcctttcgtcatagaatttctatttagttttgtttttgaaaaatatatctgtgatgttagagagattgattgttttatgtagattttagtcctgggacaattttcgcagaagtaaaaatcagaaatgaacctttagttcagtaggaattttcttattctaatagaaagtctagctgtgttttcttaatttcctgtatgaaatgtgctctctcccctctaacactgtgctcatgtggtttgctgcatcacccaaaggttccgccagtgttgtgaggatgcatatctgattttacgacggcatgggaatctcttcatcactctctttgcgctgatgttgactgcagggcttcctgaactcacatcagtcaaagatatacagtatcttaaggtataaaaccacttttccttctctcttggactttgtgggcattgagctcagttttagctgcctgttttattcaagtggctgaaggaagtagaacaaagtcatttcctctaagatggttcttagccaggagggaaagaatctgggaagtacataaaggaggaattttgtagagtagcttgtaacccagaagattttcccatcagtagaaggggcgtaaagaagactggtattgggctgtagccttcttactcacattactgaaagaccgcagatcaggagcgggttgccaccttgattttccacagtctgcctttttcttgccaggatcttagtaggtcttgagtcatcttactggatttgggtggtagtggcaagcagctgtgcatcctgcagtaattataaattattttcatcttcaaaaaccttttggaagaagtcatattatctccctatcttggggttctgcctcctgcagatgatatttaaataagaacatgaagcatgctgcctgatggtggctggggaggcacaaccaatccagcctcctgcagactttgatatttgcacatctctactaaagttatataaaatcatattttcccccttccattttaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaatgggtgagcctcttctttatgggtagactgggcctttggaacttggcactggaactccaagaaatggccaagtcagtagacaaaccaacctcaggaataggctaaggcttattatggcctcttccctgacttctccccttgtttcccagcctcatcaggcatggtataggaggccccctggactttggtgggagcctgaggtaaggagccatgcatatgggaggtgtcctgaagtctgggtagttacttggcactgagccaaggccagactctgctgctttggagctcttgttcatggggcagatgctggagcagtccagttccttggaaataactcagctgaggatgggagttggcccctgaattcctcatttccagggctggtgtagactcactgagacttccaggaatagaactatggaaggacaggtttgttcagagatctttgtctagtagccacccaccatttcatgaaccaggccgcaggtcagtggtttggagaatggtgaacactgccaggaagaaatggataccattctttccagaggggtctcctcagccaaaaggagggccttgataaatacatgccaaatcagtgaagttcaagtcaactgtttttcccatatgggca

SEQ ID NO: 17193 - DNA, 26210 bp, Human
agttggaagtgaccaaggaatggccagttcactgcttaagcctttgaccaatgctccattctggtaagtcaggataacaagaaagcccaaagcatggctggccctggtgggatgccttacagaacctgggccaggccccatccatccttgcgaggtgtcttattgcaccttcaggttggaaggactgggataggttgccctgagtgcccagccaagatgagccctgggctggctagggagggacacagagccagtgcttgtgtgaacaactgatgacctaaccatccagagccagacaaagaagcagtgggaaacaagggcctagagctggctctcaaccagggctggtttacccagcacccacaccccagtgcctttgacaatgtctggcgacatctttgtgtctgggtgccactgggatctaatgggtagaggccagggatgccactaaatatcctacagtacacaggacaggctcctgtaacaaagacttatgtggcctagaatgtcagtagcacagagattaagaaacaaatcctagtctagggaaagagggtgagaagcgctgaaatccaagttgctgcctgggaggaagctgtctctaccctgaggaagaggctccttttcctaattcagcctgcactgtgagaacacatgtgagccccagggaggcaccctggggaaggtggtgctagaggggaagcaaatgttatctgctgtcacttaggctgtgatttgtgcaaaaagcgatttaaaagaggtagacaaaaagagggtcaaaaagtcagcccatgtgattatgtcatctacttggtggcaaatgcagttaaaccacaatgacatacccacgcaggtgacaaaggagatgtgatcaaagattttcattgcagtactgcttttaatagtgaaagatcagaaacaatatagtttgtccatcaggggacaagctggataagcaatggaatactccgtaaaataatggggatactttctatgtacagctatggaaaagtctccagaatatattaagtgaataaagcaaagtccagaacaccgtggagtacagtgctgccattaggtgaaacgggaggaaacattaataaacagtatattgcttacatttgcataaagcagcagtggatctcaaagttgattgtgcatcagaatcacccagaaggcttttttagccacatgcacttcaaataacatcaactattttacttatttatttatttatttattgagccagagtctcactctgtcgcccaggctggagtgtagtggcacgatctcggctcactacaacctcctcctcccgggttcaagctattctcctgcctcagcctcccgagtagttgggactacaggcgcccgcgaccacgcccggctaattttttgtatttttagtagagacgaggttttaccgtgttgcccaggctggtgtcgaattcctgacctcaggtgatccgcccgcctcggcctcccaaagtgctgggattacaggcgtgagccgccgtgcccggcatcctttcttttattttcgggagagacgtggaaagtgccccaattttctcgcccgtagttgaacctcccagctttcctgaccccagccaccaccggcgcgaggctttagacaaaggcctgtaagtggcctctttccttaatcacgccagcacaaaccccaggagattgtttcccaactcccgagtggctgctgagtgtgagaagttaatggcgtttgaaggaaatccccagcagccgaagagttcggccaacaaagcaaacgtcccgtctccggtctcctcttcctttgtaggggaaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcggtaagcgctgcccgctgcgccctgggcgccccgccgagcagctccgggccgctccctagagccctcccgagacgctgcctgcctgcctccatcccggcgagccgcggtccggtgcccccggacgccagaaagggcgtcctcggccaccgctcccagggcagcccccaggctgcagattggagaattcggggttgttaggttaaccggtggcaaatgtctgctcgttggccctggaggtgggtaatttcattagtaaatctggggcttggtttgctactttttgtttttaaacggttaacataagagcagaaaactttgttgggggcggcaggggaggcacaggcaggctgtgcgcagagacaacgcaaagccagcgggaaccctaacagtgttcgcgggcggagagggctcctggggccccgctaccttgggaacggttctctgagtttccctgccaactctctggcgctctctctctccccgttcaacccccaccgcagacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatggtgaggattcgcgtccacctggtgtctcctgcccagggggcctgaccaagggctgggctagttcatccgagaggggcaagggcctgagggactgaaaactcttcccactctcagcccccatggtgggcagcaccaactcatgaagcatcctgctctatctacactggaaggtgatggttatgaaggctgccatgtgctgtgtctccactgcgttcaggcactctgcccggtgctttatgcacatgacttcacctaagcctcacacagcctttgagggagatatgaatatgcccattttacagatgaagaaacagtctcaaagagatgaagtaacatgtccagagtagcacagctagggagggtctggagttcaaagcatgtctgttgatgccgttctctggctgactgggctggtggagggtaaaagaaaagaaaggaggaaagaaaaaagaaacacaggtaacccctttgaagtgtaaactttcagtatgacttagtgtgaagtcactccaggaagctgggggccccttgatctctgctggaagccccctgatctgcccatccttgccccagagctgggatttggctcctggccatcccctgccccaccctgtcatccaatgcctactgagcattctttgaactttgcagctgacacctattcagtaagtcagggcccctccagcccagaccagaggaaacagcagtgggggaagagggagggccaagagctcccttccacaagggtgggaaactcctgacccaggacatcccaattagtactgccacagcagatgccggaaggccagccccaggcctccatcaacattatctggttgctgggaggtcaaggtactcttgttctccctttatagtcttgggttcagaagtggcttatgttcatcccaggagccaccttgcttattgatggggtcctcacccaccacctcccaccatttaccaagggtctttaccgctggtctgctgtgtgtccagcactgtgctagtcatcttacagcacagcacagtgagggagggataagtaaccccatgttatgcagtgactgaggctcagacagaggaagagacttgtaagagatgagacttgagccctgggccttctgatgttgaagcccacagtcctgctttctgccagcttctctgctggtagtctgtgcagaaacaagatagctgaggtctgttaggattgtagttgaagggatgcccatgtctgggaataggcatctggagcctggatgactcatccccccaccttgtctattcatctgaaggcagtcaggattggtatctgagtctgctgtttggaatgatgggaaagagggggtagtcagcagggagtggccttggaaggaccactaatgggagaaaacaccattgttgcagagaaatgtcaggttgtgcctttaaaaatctcaaggactcttaatctgcaggaaagactcacaataggaaaggagaccttcagatggcatctgcctttctcattactgcccaagacctgctccccggcacactgcatggaactttgctccttaagaataatccttacccccactcactattgtggaactcacagatcacatcgaacctttattttgggtcaccacaaatctggcatgtgctggcttgtactaattatcttcactctttccttcctttcttcatccattaacacatgaaacatttattgatcacctagtaatactagcaaatgcagtactcatcaagtgcttactgtcatgccagatgctattcaaacgttacattagctgacttaatcttcacaacaccctttcaagcctcattttacagataagaaaaccactgcaggatttcttgctgtgtgaccttggggaagtgcagagggaggattttagttaaccactgccctgaacatactgcttccctcacgggctggtcaccacggcaggcacaggacagcagagcatgtcacaggccctgatgtccaggaaagcaaagtctttgcagtggaggcaggcacaccaacactcgcaacacagtgtggcaaagaaaagcacagggtgggagtgaggggatggggactacccagagaaggggatcccagaagaatttctgaaagaggtgacttctgtgcttcattgtaaaataaagcagggaggtagaagggagggttttggatacaaaggaaaggacaagggccaccttttcttctcactacagcatcagcgtcaatcgagcatcaagcagtagtcgagcagaccgtgcagattcagccactggacgaatccagtgaaactggtctaggatgcatggttactatcactgccccaggactcagggatgcccactctcaagtagatagccattcgctcacctgttgtggcctgttgggagatggaacagcctgtctgctctgctcaagccttcgcctagccccatgcagtacagaaaagcccttctctctgggctggccgctgggtggtatgctgctttggactgccggaaggacatggctggatgggggtaggatgatagaattagagcagctgtcaggcctgagacttgtgaatggaggggagctgggtacccagaggccaccagctgggctctctgagggccgccaggggtcctggacaaggtggttgccaaagatcactttcactgctaccccctctgcctcacacactgggcacccatcagccaggagcagtggcccagaggagtttgttcccagcatattacaggagtcccattctcacttgggatcggtcattcgtctatttttttcattcctctctggacaccacaagcatctcatggtgcttccactatctttgcaacccctgtgtcaatgagacaaatcacacacgattcctgccctcatggagttcagtgtaaggaggaggcaaattgaagcagccaatcacgacgtagtggacactgtgctgatacaggcagagaagcactccctgctcggtctgagaggtcagggaacgctcccacaggaattggagtctgaactgtggcttataggatagacaggaagtagccaggcaaacagaaaggggttgaaagaaaggccacggccgaaagctgtcccacaccaagccctgggcttggccctggggtcgcagaggcaacaaggccttctggacacccaggccagtggaggagacaggcacatcttcaggccattacagctcaatgcatgatgggagcacggtgggctggggagcatacagctgggagtaggaaagcagtggtcagggaaagtcccagaggaggcgacagctgagaggggccttaaaggactaattagggcagatgtggagaaaaggataagagctttccagtaagcgggaaccacatgtacaaaggcccagggtcagaaaagcctggctgggagggagtttcagaggtgagagaggagcagtctgcgaagacttcagcatgcctggagtgcaagatgtggctgggagagaagagagccaggagaacctggcagggagacttgatgtgaccctgacaggcctctgtgagtccttgctgggagaggtgtggccaggctgacatccctccccaaagggcagaggctctcactggctgagagatctctgatcctgcctcttttccatgggaaccttatctgtattctagaactgcagccagagggtgaaacccagcctgcagatgtgttttgtttggcctgtacaatgtttgaaaagcttcagagtcagttgccaataattgccaaagattgtaagatttcacagaaaatccgtatttctggctgttcttaacaaaaacaacaagaaaaggaaaggccctggaaacactgggcacctgtttattcctgcactgcgtggatccctggaatatgttgcagctgctccctttagatgttacatttcctagtttaccacagtcttcagcccatcctgttacctgaagtcaaggatcaaatggccatttgtcgctgtttgcactgtgggttcctttagagctgtggatcccaaagcagaggcagcagcagcagcagcagcatcacagggaacctcttagaaatacagattatctggccacacccctggcctactgaatcagaaactctgggagtggggccagctatctgtggttcaataagccctccaggtggttctgatgcaactaaagcttaagaatcactgctctggagtaaagaaacatactctgttcctgtgtctctataaaaaaatggaaaactgtaaaattaggtgtacagggccatgggcatgtagagggccagtttggcccatcacctgagtcctatggacattgcagtccatgcccagaaccacctgaaacagctctgtgttctctccccaggtggaggggtggagggactcagatctgggcggctctgcatcactaggctcacatttccagtctgatctaatcagattttatgtgaccacaaacagcaggcactattttggtagagatatacaaagtctgggctcagctgaacagacacagggcttttctccattgcttcctgcatgcctttgtccataaaaatgtgcgatcaggcccagcaaggaaccagcagcatttgttgaatataacacatatgtgctttggcagggtgggagctcttgagaaaggaaggtgctctgacttcagatagtgttttctcactcccgaggaagcgagcgcctcaaaatgatttggttctttgtctcgaagtccccccagcatgagcaggttttgtgggagaagactgagcctcggccaggaatcacagccgtgagcctggctctgcgggggtggcagaagggccatttgtcatccccgtgtccaggtcatgtttttcctgtaggagatggctttgttcactcggggaacaggcgcctccccctgtggctggagcctcagcttcatatccatcgttgaacttaggatgacccctccacagggcctgccttctgctcccagccctccgcccctctgtcgctttctttgtttttattataaaaggaaaatattcaaatagcacaagaaagtatgggctgaaaagggccccttcccccacttggcctgattcccacttggtggatctgtccggaaatcttcctcagacttataattgatctatctattgattaggcagttggccaaggtctctatctaaaaccaaaagaaagaaaggaaaagaaaaaaaggaatccacttctctacatatttttttaactcagtgatatttcttacacatttttccatatcagcacttacagattttctaagttcttttttaaccgtctatgtttcctttccttccctcccttgacttccttacttacatccttctatttctccacccatccatccatccatctaattatatatggtaatacatgaaatccaacaaagtactgttgacactttggtttaaactcttgccagctttctgatcctattcttgacccattaaagagattttttgatttgttttaaaaaacacacacacacacacgcacacacaatgccactggctaaattaactccctgggctgcagcgctgagaatgccgttggatgtgggagcctctgagagctgcccctgcccagatcaggcacccggcattcagctgggccctttccaggctagaaacacaggatctctttcatgtcttagctaaagttctccgacctttgaaatcggtgtcagcagcgtgcttttgaggattacaaaaagaagaattaaagcaacccaaataaaattcacaaagtagctttcaaaaatcacactgctttgttgggttttgggttttgttaggcaggaacaaaggaaaataacatgtactgaatctttactaagtgccatgcctgccccaattgctttttgtactttttctcctttggtccccacaacaaatgctgttcagtaagtatcattatactcatttcacagatgagaatctgaggctcaaagaagtgaagtgcctttttagcccaaggtcacccttgggctagctggtggcagaggaagaattctaattagtctgtttataaagctctctaccccaaggtctcccacagagctttgctgaaggccagcacctcagttccttattgtgagccttctcacagtctgaaggtaaacccaggcagttttgacaaggcctaggatgagtgaaaggagcaccggtattagagtcagaacatctatttgaattcttctcgattatctgacagcggccttaaatgattagacacactgcctttgttttcatatctgcaaaacgggcatcataattgctgctcagcgtgtctcacaaggcaaagctgaggaccatagagatagtacagggcacatgagcttgggaagccacaatactatgtgagaacagggccagggcctgtgatacccgagactgaggggcatggcataatcacttatgatggccaggtatttactgaatgaattacagctgtttgtttttctgaccaacattgttcctccacctcccacccaagagaagcactgttttctttatggtgggaattactcctcctcaaccttttgggtcctggtggggctgcaaatcatagtaccctgtctcttctgggaagagcaccttctgctagggtgatcacagtgtcccgtggcctgtcacatacttgtgtatgtggcccaagctgggccagtcaccatttcctgggagttaatttaggaaccctgagagacaggtgagttctattccgttaaaggttgatgagctgttatgatgtaagcttggtgttctctgaggccagtccccttaccccaccttccttagctgcatggaaaaatccaattgaaggaaagtaaaagatgaggccaatagagacagagagaatgcaacattagagggttactagagttcctgacgcaccattcctagattttccatgtacttcaaccaatacattttttttctttcaccttaagttatgtgaattggtttcctgccacttgcatctgaaaacatcctaagacattcaaactccagatatcaagcgttaagacccacataagtagttagagcagtggttctcaaatttgagcatgccttacccctagaatttctcattctgaaagtctggggtgaggcttgagaacttgtttttctaacaggttcctggatgatgctgatgctgttggttcaaggaccatgcttttgataactactaacaaagaaaaacaaggaagcaggctggcctgtgcctagtttcctgtgatttttctcatcatgattcaatgtaataagcctgtgctggggtaaaatgtgcctagttctaggggatgaatgagaataggtaggtgtagctccatcccaggatcagggtagtgggggatgaagactgcctggggacctcaatcttgcagcagcccacagtggtttgcaattgagggtccaagtaagtgataccaatagtgtgtgcagctggacaggtgtgaggtacaacagagcaattaggagctttgactttgagatggacctggatttgaatcctggttctgccgtacagctgtttccttggcaagggtactttatccctctgagcttcaatgtgctcatttgtaaaaggagccaagggtaatacccacctaatggagttatgtgagaattaaatatggtgatgaattatttctgtttcctgttgctgtgtaacaaaccactctgaaacttagtaccctaactcaacaatatttattttgttcacaaatctgcaatttggacagggctcagtggggatgccttgtccctgctgcctgccctgccagtggggaggtagaggatccactttccagatggctaacccacacttactctctgctgggtgcctgggcttcctcactacgtggcaggtagtttccaagaatgcaaacaccatagggtgccagctacctttaatacagggattagtgcgttcttcctttcttccttcctcttcccaccccttccctctttcttccctctgtctttcctgaactgagggtccaaggatagcataggaatactctgggaaagaatggtataaacaagatgggtgtgaaggtggggatggcatggaacccagtctccaaaacctacctttgccagctttacagtggaactggtcctgcactaagaaaataaaaaataataataataatcttctcacaatgtgcaataaatcagaaaatcatcttactctttgactcagggatcccacttatgggattatattccaggaaaatcactctatttgtacaaaggtatctgttagtcactctgtgataataattctcaacaacccacagaagcataaccactatctcagggcctactatgcggcaggccctgccctgtcattttatgtttatttaatctcctaacaatcctggataggaggtgctactctcccattttacagacagggagccaaaggtcctgcccaggttcacattactgattaaccatagatttgtgatctcacttcggatgtctctgattccctactttgtatggtttttatagaacaggctgtctcctgctggtatacctaaatatcaaataactatgggtggttagaaagactggctttttaattccatagaccactatgtagccgtgtaaatgatcactatgaagataaatgaaaagtttttataggcattcagtcaccaagttccatagattctgcttcttaacgtctcttcctgtttttcttcattcccactgctctgaatatctcgtgccagtaataataataacaattaacatctctcgtgcttactgtgtgccaggctcagcgctttccatggattatttcatttaattactgcagtatcttcacattcatctccattttaccatgctcaacacttcagcccatccctccctttctaaaaagggaatctgatcatgctactccccagctcaaaattcccaagggcttcccagtgctgatgggtaaaagccagatggcactcaggctcttcagatcatggccctgcctgtctctccagccctattccttccctcactccttatgcttggccccatcccatcatttgtcagtgccttcacttgccatcctctttgcatccctctactcacttctctgaggtatttctttgcctcttcctctaggaggagaattacccactggtcaagacccagcccaggcttatctgctctgttgatcccatcctgattccccatcccaccactgtgcccttcctttgccttgcagcctctctcttcaggtgctgcttttagggcacctgtgatgctagttaatgtgtctgagattctacacagcagcagccacaccatcatgggctcagtgggctccaatgtgttcattaaatgaatgttaagtgaaaatagcagaacctcagaaacataaatggtagtcattgaccatatcactgcaagatgcaattgccatttaataatagctcatgtttattaggtattccatgtgctaaaaattcttctaagcactttccatgcattaattcttttaatcctcacaataattctatgatgaagatgccaaaattcttcctatattatacatgaagaaaatgactcagtctgactgagttgtaactggttctgctctagagctagaccagccggaccagccagactgtcatctttgggatctcatttctgccccttacaaagtgggtggccttatgcaagctacttcacttctctgtgcctttacttgtctgcgaaatggggataattatgaaataggggatacctgctttgtggtgaggattagatgaacggtgtgtgggaaaacccacagtgcaaactgccccatcagtatgagctgttattattaatcctctcacactgacctgtgacctccagaagacaaattctgggggtggtcacatgtatgaagggatacctggcaaaccagagaagagctagcaggattatgagagtggaggctggcctgaaaaggcacctgcctctccatacccgcagggaacaggatggactaggccaagagcagagaggaattattgcttactgcacattttgtgtgtcctgcactgaaataggtccttgaaaccccttgtttcatttcatcctgatggctctgctctgtggctgggctcactagccccattttgcagatgaggaagtgaaggctcagagaggtggagtaaattgctttggtcacccagcaagaacaaggtgagaacctgcagttcaggtctgcctctacccaaggctatcattgggtccctcctgaatgcccagcttggcaggcaggcagctgtcccatgactgagccagaccaggcccgcagcctgccaggtgatattcaatggccataatattcatgccagcaaaatgttcatgtgggaacagtaggcagaccatgggctcagagctaggcagaggggatttaaaccatgtcttatactattcctagttgcgtgcctttgcatatagagcctaagcactctgagccttagagactcagggtcaaatcactccaatggttaacccctttctataaggcttacctgtgaggaagaaacagccacattgctcagagaaagcgtggtgttcactgcaagagtgccactagaatgctttctgctattcattcattcattcaacaaatggtaatgcacattttctctgccatggattctaacatgggggctggtatcctgcagtgaataaaaggatcccagaccccaaggagttcttcatcaagagatcctgacatgctcactcttccctggttacctggttactgatctagcacctcttatcttctgggagctatttatttctatttgccttgagatatatatatatatctatttatatatatatatattttatatatatatataaaatagaggccagagattcccatggaagggatgaggccttcagtgcccctcctaagcactctctgacaggatgtcccctctcttattcttattctcccaccctacccccaacttccacacccctgcctttgctggtggaactaataacacaccaattgcttgtactggccccaggtagcagatccagcacggcctgccaggtaagcaagcatctggattttccatggcaccaggtttggccagctggagcacgaagacatactgtgaggaagaagagaggctgtgagcaatctccccagtaaattctgggtcagaggtacagggtcagccttcatggggaaggtcaacccacagagttaagctgggcaaaacctatgtagaaacttccctcatgcagaccctgctgtccctgattttcctgcaactgcctgggcttgttccctttgcctgggactcccttgttcctcttcttcctctttccacttttttttttcttttttttttgaaacggagtttcactcttgttttccaggctggagtgcaatcgcgtgatctcagctcactgtaacctctgcctcccgggttcaagcaattctcctgcctcagcctcccaagtagctgggattacagtcacacgccaccacacctggataattttgtatttttggtagagacagggtttcactatgttggtcaggctggtctcaaactcctgagctcaggtgatccatctgcctcagcctcccaaaatgctgggattacaagtgtgagccactacacctggttcttctttccactgtttgctaactcccatggtgttttctggcatcacttccagcattatttctagccttacctcttccaggaagccttccctgatgggcctctgtctctaccttaaaggctgtcgaggtgccttctgacttccataacctccagcatttgtctaccagtacttaccattctgctggaattctctgtcttcttaccttcttctcagataatctgtgagccctcaagagcaggccactgaccttacttccctctctccagcacctacagctggtgcataggaggtgtgaaacccatgattgctgaatgccgttcccttgcacagaaccacgtggtgaattcctattgctcagtcaagggtcagtttaaagcagggaactgcagagcacagtcatcaagagcatgagctctagagccaaatctcatctccccacttcacggctgggtgaacttcaggcctcagtctccacatttgtaaaatgatgagaagcatacctgctctaggaggttgtcaggagtcaactggtatgacatatactttgcctagtaccctgcccagcacataatgttgggcattatcattatcataacaacacatgttgctatgatattgattatggtgactgataatgacagcaatgctatcactcccaccagggagccttccctgaccccccaggctgggttgcgggccgtcatccctcccagcatatagcacagaggtgtcattgccttctctccaggctgagctaccccatgacagagcttctgtgcagcccagccttagggccaccctaagtgctaggtccctgggatgaatgagtgcagttccacagggccctgtgaccttctccagtcctgttcccacctccttatccaggaccttggccttgagcactccaatggtttaaactgactctaggaactttctgaattgtttaaggaaaaataactataacatgtcaagtttattagtcttaacattttctcattttgtcttaataattgtgttatcatttgctgttagctttttcatggtattagaattgcattctttcatgctcacaaaagctttgttgtggctatactatttatagtgattgctttgaacatctattatgtctctaattactcgttcacattttaaggccttattaatttagttttaatctgcttttagagtgaaactggcttttcctcttgaatgtgctgacttttgattccagccccccaggaatggatcagagaagaggagccgctacccacccactcatcagcctggcctcaggggcagctcatggactttttagccagagagaaccgggttcaagttatggctcaagccctaaccccttggtgatgggctggttacttatagaagcctaatttttatcagctctaaagcttgaagatttagtgaaacattgtggaaagctcccagcacagtacctggcacctggcaggttctctgtcatctcccctacttttccctcctgatcacttatttaacacaagcaccagatgctgaaaaccctctaattgtcccaggaacacacataccctcaaagggagaagcacactttcaaatcaaactccaggatttgcatcttttagcaatttacattatgcggagaaagtatctactcactgtctggttttgaaattttaccccaaatcgaaagagcatgggttttggtgtcagacctgggtcggtcctggctctggcctttgcaggcagtatcaccacgggcaaggcttcacctctcataacctggctgtggaaccacagaaacaacagaattcagtcccagccctccagaggtggatccgtaaacagagggactactagggctgggtggagggctgtgagtgatccaacatcccctgctcttgagagtggtgttttggcatgggagtgttaatgaatgtcacaagtttcttgataccaaatagagttcctaccatttgcaggtcataccggtcactgccaagagatggcttatttagtgggaattgtctggcactcctagtataagtcacctaagtggggcaagtgggccttgaaacatccctgggagacactcactcaggctgcctgtgggagctgggctttttgtgtcactctcccatgcagcagtgacggctggggtttctaagtggtcagaggagctggaaaatggcttctgaagtaacagtcccttgtcatagtggtacaaagatgtcttcattcatctgttggcacatgtctctgggtaaactgccggcaaggccaaagtgatgggggttattattagtttttaatagaaaagttagactggcttcactttccaaccagcttccctagttccagcccatttgcagacttttgggtggtctgtgggatgaaaatttcttgtgaggaggtgagctgaagatggccatccctcctggttgctcttggattgtctgggcttcatttctaaggtggtcccagagcccatgtgggggttgggggaagcagcattgtctagcccctttggtttgtacccatgttcaccccacccccacagccacctgccttttctgtgggacttgaaaagcatcaggaatatcttcctacctgaaattcttccattagaccctgattaattggattaatctaggaaaccagattaaatgaccatttaacgaccctttcagatctggctgaatccttgtccccgaatgttcactgctcctgatctagcaaagacagctggctgctgacttcaaagggaggtcatggaataagttattgggtcctagggaaagttgttttcataagttctactttgtgtcacaagaaaatgaattatcattgtttgttaggcattcaccttccaacattacttatttccttttccctgtcatttgtgtttaagtgatagtccccctccttggctccacacctcctttttctgttcttatgacaaatcagattctctttgaaataactagtctattcccacaagataaaaaacttaaaatgaaaaatccagtcccaccaaaagttaacatggggagagtgggagaattaaatcacactgctgagccatcccagctatcagtgggggtcttcaaacagatcttctgcttaaacaaagaccagttaacatataaaggaagcaggcatcgtggtgctcagcaggcagcccctgcaggtctcctcatggatcccagtatcctagaaagagaaggagcttccaaaaccttggccatgatgaatagcatgtcagtcactgcttcacaaatctccaactcttaaaaaaaaggctttcattattgttcaacattgacaaggaaacccatctttatctaagctctgggcatcatgattaccattacctagtgcctcctatatgccagccctatgcattttctgtatattttctcaaatcctcagaacaacctggtgaagtaggtgctttgtttatctaatgccatgtaaccagcccaaaacttaataggttaaaacaacaaccttatattctcatgattctgttggttaattgtgcagttcagctgcctgtggctgtgttcagctgaaagctcagttggggcgcctcagctcttctccaagtggcttctttcccatcctccagggcttctccttgtgccctttctctttggcagaatatcctggactgccttaacatatagcagctgggtttcaagaggggaagattccaagaggacaagcccccagcatacaagtgtttataaaggcactacttccatcacgcttgttcatgtctcactagccagagctagtcacgtggccaaaccaagccgatgtaggaagagacttcacaggggtttgaatatcatgagactcgggagtcaccagtggaagagtctaccacagtaggtatcgtttagccttcttttgcagttgagggcacagagactcagagaggttaatccagttgcccaatgtcatccaacatagtcaggaacagaggacccagctctctctgataccatgttctttgctgcccatactaagtcaacctgatataggttgaggtggtatagtaggaggcgggcagggaccaggagccaagtataaatggccagtaagcttccaggattctttaacccagagtacaacctgaccaattccctggcccacctgcccgcctggatggttctacccaacagcacaggcagcaaagacaggcactgaaaacatgctccaggccacagtctgggtttttcagtctgatattctggccccatctccccaccaccccccaacaaccttgttcctcctctccttaactccaggatagtcttctacaacactggcttgttgtcatttctccctcatcacctcctacccctttcatcctttttcactctgcctagaatgcccctcccatttttagaaactcctttgaggccatgacagcctgggcacttctctgtggggacctctacaggcagaaatctttaagacctctttctgactcccagcacccatacccccacaatggttggaatgaacttaagggtgttcctccaggagtctgctcagagtcttagcacaatgtccatgtgtttttctgcagcccccaatgattttagccaccatctcgtgggcacctggcaggtgccctgccctagactgggaaacaagtgggcaccaagtcatgcaaagcccgtgctccagcccagattctttctctcatttactaggtgaccagagaaagtcatggaacctctctgagctcagccacccctctacatccaatacagacaagaataatctctgctttgtccaactcctagcactttaggaggccaaggcaggtggatcacctgaggtcaaagaaaataatctctgctttgtccagtatcagagtcaacagaagcttggggttaagaaaggctttctgggagactgatgcagtatgcatgtgatagggatccttccctttaagaagcctggtttgtagggctctcagaaaggctcctctacaccccaacagacttctgctctctctatccctcaatctgtcaagctgcctgaaattctgccatctgtcattcttttgggctaaggtattattattgtttatatccagatggcccctgttaaaagatgccagcgatctggaaatggtaacacagtagccccaggagcaaaagcatgctttaccattaataaacatctctctcatggtcattctctgaccctggtgttggaaggtaaataggtgtgagctttctggagataaagttggcaatactcatcaaaagctttacaaatatgcacactctttgatgcaacaattcctcctctggaaatttcttctaagggaacaatgtgttcaaaactatgtatacaaagaagtcttatttatagtagcacagaattataaataaataacttaaatgtccaaaataggtaattggctaaataacagtatgtatgtacaatcaaatactatcagggactgttttgtgggcctgtgacaaaggcagtccatcagggccccaggctcagaaagcccctcacttggtttaatgctctgctgtcaccagcttaaaaatcttaatgattttgagcaaagaatccctcattttcattttgtggtggaccacacacacactatgtagctacttcctagaatattacgtagcaattaaaataatgcttatggagaatatttgttgaaatgggaagttgcttcaattaaatgaagaaatgaggatatgaaaccataaatgatgcaatcctaattttgtataaaacagaaacatgtagatagatagatagatataaaaaaaaaagagtggatggaaatttaccatacattgtaacatatacaatgttagagcaattatctcttttttttttttttttaagacggaattttgctcttgttgcccaggctggaatgcgatgacattatctcagctcactgcaacctccacctcccgggttcaagcaattctcctgccttagcctcccaagtagctggaattacaggcatgcaccaccacgcccagctaattttgtattttcagtaaagaagtagagacggggttttaccatgttgatcaggctggtctcgaactcctgaccccaggtgatccacctgcctcagcctcctaaagtgctaggattacaggtatgagccaccacgcctggcctagagtaatcatctctaaagaaacaaaactacatgtatcatttttattaccattttcttcttcggtgtttttttttttaattttccaatacaaagactatgactatacttcctgactaatatttccagaagaggcaaaaatgtatgtcatagctgaaaacaagcaattgtctcttgtgcctctgagtgaatccggaacccttcatatgcacagtagccttctggataaacacatgaagagaagatcagttgatgaggaaaccaagtgttcttatgagcttcttgaagctgaggactgatttctgggtccccacttccctctacaggcctgggatggaaggagcacggataagtgaatgggtgtcctgtcttatttatggcatgaggtcatgagtagtctttacccatgacatgtctcaccacacattaaccacactatgttttgcgttctctctagcctgggactagactgtgccccgagtgaatttctggatcagagagaggatctgccccccaagtccttttatgccccatttctctctggagcagagagcagacttactcctatgcaaagctgggggagcacatgtggctccacctgcctccctcgtgcatgtgtcgcattgcaggcttcaccccaacagcagggggcagtagtgatcagcaggcccaggtgggaggcctggggtggggaggtcctcctgcagggagtggccccactaacgccacacccatctcccataagtctcctctcccaaatcctttattcggctgttgctgactgtcctgactcagctgagcatggcaaggaacacaaggatcctagaaccttagctctctacattcaaggcctgagttaatgtccccatgtgacagatgagagcacaggggccctgaaaagggaaggatttgctgagagccacacagtgagcaaggggcaaacagagtgctgagcactactgtggggaggccaggctcataacacagaactgccccatatgggacggctattcaaaagaaggtgggcagccccaaatatgagtgatgcccactgcactttctgtgtgcccacatctgcgacatgtgtcccagtctagggcacactcatggctatgctgggatgacaggaccaccttgcctctgaagtccaacacttttttcagccccgtgttgctaggtgggccttttctgctccactaagactgaaatctccccaggacacaggctgggcctcctcctcctgcctgtcttcccttcagcatgcccagcacatggcagggctcacagtgctcagggaagatgtgggggctcaaatgtggggtgtagagggtgtcacagtgctcatctgtgctctgccaagcccaggctgggctgtgggatcttcctcgccttcctcctcagttccctggtgccctcctgatgagctcctaagtgtacttcccgctgtcccacctcaggccttcaccgggtggtgggctactgggagctcttctccacagcgcctcctttcctctccttcagctccattcttctctccttagagcccagccctagtgaatcccactccctggactctcacctgggctcccacagcctctggcctgtaaccctggtgaccatgaacgcttcaagaagcaatttagtccattggggtggggaccttcagagccccacagatctgtgttcagacctggttcttctactgaacaacatgggtgaacttggcaagtcccttaagctgatctgtgaaaaggagatgctaatccctgctcacgtggataggcatgaggcttcagagacagcacagagagtgcctggcagagcaggtaggcagctaacagctgccatttgtaccttcactgggttatttatatctaaggtcattctccctgtgagatgaagagcgctttgagggcaggggtggggtctttttggtatcccaggacttagcataggttgaaacaatgaatggatgaatgaagtgtctggggatggtcagggtacactctgagaagtctgcccctcaccataagattctggaaaacatccttcacccctcacacccagctgtgctcagccctcaggccctcctctccaccttagccccattctcagtgcttgcaatgacagccccactccaatgactttttccctcctaattacccttttaaataaaatttatgaaggttttcataaattttaaaactgatttacacactttaataaaagcatgtgatggacagggagtattaggctgcagattttctacaatgaaattgacgtgagcacatcccagattatcaagtttgggagctgccccctcccccagcctccaggagctccccgcttgctcaggattgacaaatgtgtctctttcttggcagacaacagtgagctgggacggagacaagctccagtgtgtgcagaagggtgagaaggaggggcgtggctggacccagtggatcgagggtgatgagctgcacctggtaggttcctgggctgggtcaggccgggtccccagaggccctggtcattgttgaggtccagatggaccttggaaaaaggcaccatggatgggccttggttctgttctaaagcttctcttccaagggcctggaaaagatgcctgggtgactttaaaaaccaagcaatgtattttcaaggtctaggctgacccaatcatctaatcagagggaagaggtgaggagttatatccattaagcatcagcaatgagctaagcccttttgcattctataactctattctctcagaataggaatatggctcttattttagagatgaggacctgggggctctgaaagattagattacatgtccaaattgcacatctagaaagtggcagaacaaacatttgctcccaaatgatgtatatattcaccatgccaaattgtataggccaaagccaagaaggattctctaagcttctctaagatatgatctcaatctgggtcagcgggaggtgattcgggaggggaagcgtcaaggggtcctgttggtcagctctgagccacatccattcctctcagccagctctgtctgtagggtgctgcagagcactccactatacagtttaactgtctttccaaacaattggttacttaaaccaactcttggggaaaaataacagccaatgagtatttttagagttcttgccgtaagtgtgactctgctctggccaatgaccaacatctgcttttgtttcaggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaacgtctgtttgggggaagtttcactgcccactgtgctcactttttctccagggcttctgaggccagcttctcctagtgccacccatgggcagagtggataaattcagccacatgtcctgaaattgcaccgtgtttctctccagaggcacaggcttgggtctagaatgggaggtgggagagtggcctgacattcaatcatttgtgtatcaagtagctaccatgttatgtatctaattgtggccaaagtatagtgagtgccacaaaagcaggagaagataccttccaccctagagatccaaccaacagagaatgtctatataactgcacagtacaccaaggagatgcttcatcattatttgtgaatgaaatggaactggacagaattttaagcccaaagcataaaattacttaaacataagtaattacctattggatttaatttcagagatgtcatgagatgtcaccaccctcagaccatccaccccatctacgggctggtatcagccctttcttttcactgttgtagatgaagcagaacttgcaattccccctaaaagagacagagcagcctcacgttcacactaaagtgtaggagattgctagctgcacctttgcataaagaaacacaaacaggagtgaggatgtgagagatcgtggatagggaaaacaattggaaaagagaagacacatggaggactccctttgtgaatctgacaatatgcccagactatgccctactccttgacaagagttaggagtcagaacagctgagtaaaaatcccaacttcagcactcacagggcaacaccacactcctctggacttcacttctccagtcagaaaaccacaaaacgaacctgcctcacctactgcacaggtgggttgtgaaacttgtaacctgcaaagcactggaccagtagttctcagacctggctaaatgttagaaccacttggagagttttcaaaattccatatgcacaggccactccctacaaccaattacatctaaatgtttcaaaataccaggcatactatgttgtttgcttattttttgagcgggtcttattccgctgcccaggctggaatgcagtggcacgatcttgacttgctgcaacttccatctcctaggctcaagcaatcctcctgcctcagcctcccaagtagctgggactacaggtgtgtgccatgatgcctggctaatttttgtattttttgtatagatggggtttcaccatgttgcccagtctggtcttgaactcctgggctcaagcaatcctgcctcagccttccagaatgctgggattacaggtgtaagcctttgcaccggccactacttatgtttttaaggttcccccaggtgattttaatatgcaactggagttgaaaactggtgccctagaccagtttcagggttctcaactggggggtcagtcagtgctcattccacccccagggttagagatatttagcgatatctggagacacactttatttcacaacttgggtgcagggcactattagcatctattggttagtggctacggatactgctaaacatcctattatgcacaggaaagctctcacaacaaataattatcccacccaaaatgtcaatagtcgtgacattgagaaaccctgcctcacacaaatgtaagaaatgcttttttttattataggaatcatttccctagcctagacaaggaaatgaaaactcaaaattgcataacattctgtagacccctgcaccgttgtggccctggtctctgtccctgaggttggaaaactcaaaggtaaagagtcttataaagaccattcattcatcacacacatatttaatgaagatctattatgtgccaggcactaatcttcttgggcatgcagaaatgtttgaaacaccgcaagttcccatcccatcccaggtattgcaacttccatcacacctccacccccaatgcataaaagcctcacccaacagttaagttctgatggaggactcaaaatt

SEQ ID NO: 17194 - DNA, 16003 bp, Human
gattgtcaaatgcatctgaggcatgcagaggaagtgctgggcacacagctagtgggaatacctcagcgtaagtggccaggagatgccaggaatctccactatttcccttccagtgtgccagcctctgggttttacaggcgcatgtaattgcagtacctctgtgcacatttccctactgcctagaatgactttcttgactatccatgatatataaaacacagataccgaattgttcccttacctcttcctctaggttcaagttaatatgttattggttgccttctataatatgttatctcattgcctttcccaacaagcctttgagataagtattaggtccattttatagacaaagagactgaggctcagcgagtaacttggccaacaagttgctcccactgctcaacagcaaatgagcggtgggaccaaaattcaagcctgtgtctgtttaacttcaagcctgtgaatgtactaaccggtgccctgtgccagctagtactttgctacagtcataacctagactgaagtgatagccatgcccctaaaactccatgctgtggtgacagcactgagcagtgtccaagaaggcttgacttctaggcctgtctctgccactcacaaactttataagggaataaagtacatagcaaggtccgcctagagttagtagcagttctgacaaagctgtaatttgtcaatattccgtcacccaacccaggaatgctcatttttaaggtatttgactgaaacagttgagcattgcccttcatatagtttaaaacagtggtttcagaaccactttcctccagaccatgggtgctctgcaaggtgaatggagttgtttcagaatgtttcaataatcatccctacctcattcgtaagtggcatgtaatttttgcaatcggaagattttcataaaccctggatactaacctagactggtttctatatcagatggtggcttatttaacataaaattatgcattttactatttcatggtggatatatcaatatgttgtggtcttttcccaatgaacactttgattttcaggggttctggaccctgaacatgggttaaaccagtggttctcaaggtgtggtcttagcgccagcagcatctgcttcccctggaaactttctagaaatgcatattctcaggccctcatgcctgctgaatcagacactctgggggtgggactcagccgtctgttgtagcagtgcttccaggttatcctgacagtcactcaaattttagaaccactaggttctctatatgggagagagtagtctttgaacttggaaaacaagagaagctaaacccctacagcaagggctggtgaccaggtcgttgccagaacctgaaagttcgcctctgtattaccgttcctgtccctaacccaagtccttcagttctgggtgctccagcacacactgctttgtgctgcagtgatacaaatgtatggctcatctccccagctggcggggaggcatttaacacactgacttaataaatatttattgagtaaaagtatttgctcctaggaagcgggatccaggtaagccctttttttctctctcaactgcttctagcccagtgctctttatgtagtaagcactaaataaacaactgctagatgttgatccagaaagtcacattccttctctaagctttaagtttctcatcttaaaaataagaggattgtatcagatggcttgccttaggtctctttcagctccagagccccaaataccctatggttctctatttagagatgttcttccccacagactgccatagaactcctgtaatttacttagtatttgcttgacagtatggagaagaaaggggagaatcaagattttatttaaaaaaaaagtagctagaatgtgtatatggttcacaaaggtaacaagaattattgacattctttcttctcttttttcttcctcttccttctcttttcctccttctcttccccctgcttctctcccttcttatagatgtgtcaccagcagttggtcatctcttggttttccctggtttttctggcatctcccctcgtggccatatgggaactgaagaaagatggtaaccagcctctcattattctctgtggaggccccacttctaagccaggactcttgggcagccactggtgggaaatcaaactgaaatgggcaaccatgcactgggtcctctagagaaagccatcactctgggaaaatgcaatgccatatctctcttttctactttgatggtatctatattgtttggttttcacattggatgacattggtacactatggtggggaaagacatatgatatatgatatggtggggaaagacatatgacatatgatattttccaatattactaaaaactgtttcacacaattaaaattccaaagtagaggatttgcaaagtataacaactgtgttcgtttctcattccaccacatgatactgccccctcagttggcactgtgatgacttacctctgaccaagcactttggaggaagcataggattcagactcacattgacttgggttcaagtcctaggtctgtcaatgactggttatgtgactttaagctgggtcacctctaatcctgaatttcctcaactgtaaactggatgttacaaagtggatgcctaccacgtgggttatttagtgggttaatgaatgcagaatacaactcgacagatagtaaagtgaaagtaaatgtcagctagtattactattttggttgtttaaaatatctttcatgattcaagagatactttttattatcccaatgatcagtaaaaattattagtagactaatagaatagttaatggtaaaataaggagttctgcccatccttctagtatctcacactcagtaaatgtgcattctgaccgttggctgtacctgaaagaccctcagatttttatcactgaagccaacatcataatgttggcgattactatctttaattgtataataataatagttaatgtttattgagtgcactgtctcacttaattctcacaagagccatatgaagtagagactgtctgtatcccattttacagatgttggaaactgaggccagagagattaagtaacttgcccaatgtcacatacctggtaagggtggaacagggacttgatcccaattctgtcttgcttcaaagctggtgcacttaaatttgtgaaaacgtttttacaaggacatgaagtaattttttcccaggtctttggagagctgaataagaggaaatggacataaattaaggatgaaaatatttcagctgatgatcagaaataatcttttgatattctagaaagtaccatcttgaaatgggtacctgaaagaaatctgggaccactcctctcttctcaagaattttaggaagacagaatccagccaccccttctccatgagaatttgagagatttagacactctcttaagtaaaggcaaaggcctgagccaggggtatatggcagatcccttccaaccctgggattgttagcgagctcaggaaccttggtcctggcatatttgaccccttagtgacttctgatttggtaaaccacagaaattccagaaaatcagtgtgagaaactctccgaggtgtgacttaggagggcagacgatgcagtgaggctaagtgccaggttcttgatgctcctcttcagctttcctcctgcagctgttttccctgctgttgagcaaacatcttctagggcttccgagcctcagttgggacaggaaagtaaccatgctcttcaggtgtcagggggacaaaaaaaaaaccaagaaaaagccaaaagtgccacatggttttacatcagcacagctaatcatttccccagagttggaccccaaatgcttttgacctcttatttttgttatccattcagtccttataatccaattgatgtaaagtgaaaactttatattctacaatgctttacatccagaggccaataacgagaaccaccatttataaagcatgtaagggcactgtgtatgagcttatataatccacatatccaccttctaaagcaagggctaatatttttctcattttaaagatgatgacactgaggcttacagtagttgaatgtcttgccaaaggccacaagactggagcaagggctagagctgcttctaaatccaggcctctgccactccaaaatgcaggctctcaaccactgtgactcataaacttgagcaggcatcagcaccatctggagagcttaagaaccatataactaaatccatcccaaggtttctgattcagcagctgagaatttgcatttctgatctattccaaggtgatgctgctgatggtgtttcatcgatcatgctttgggaactactacattaaacaattctattcaattaataatttatgcatggattaaaaaaatgaatgaagctttgctatgacacactctgaaatactatactaagccattcctcaaaggccagtttagacactagcattaggcatcccttgcaaagcccaagagacaaaaggtctgagctgtagcccttgtacttctgacttgctgtgaccatgcttagatcgttggcctcagtacgcttcttcattaaatgggaagactaagctctactggactgcttcataagagtgtaagatagctaaaaataataataataataataataatgcagagagaatgaaaatctccactggtgatttaaaacagagggaacgaaatccttaaatatccatggaaaattgttaagagagtttctctgtacagttggctgactcctcagtctataagtaacgataactaacaccgaatttactgtgtggcagacactgtgctaagtactttacgtgctttttttttttttcatttaatcctcagtcaaatgtaaggcagatactgttattattatcattttacagatgaggaaactgaggctcatgataatgaaataccttgttccaaatcccccagctggttagtggagacaggatgacagtcttggttcgttgttctcgacaccctgagcttttaaccactatgttactctgctgaatattgtgccctgccgtattctctatgaaactgaaattgtgctggaagtttctctcccccagacctttggcaaagagtcttgtgctgtttgcagtttttggtatattaaggtgtttccaatctgctaaataatcaaaggttactattaaaggcagccttccagtcaatgagtcgatggcagctataaaactctttgtttctcttttccatgaccttgagcccaagcagggtctcatgccttgagatcatctcagcaagcatttgccaaatacttgttgtaaacaaggttgtgtttaggcaatggggatgcccgaagggttaataaaacacagtcccagagttcctggagcttacagcctggttctccactttatgtgcattccagtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaaggtaattctatacccttggatagtatcaattttctctttcgctcataagagttaaaaacaacaacaacaacaaattgaaaagccaagtcatggtgagtgtaatgaattaacatcaagtctcttattgatgttaattgatgttaacctccattttcctttgctttcctggaccctttgggttatcaaccatcaaaatctcatattaagggagtttcatgatcagtctgaatgcttagcctcatgttttctttaaataatggtgatattatttaatggctaatggaaattaaccgatagtgtatcactctgcactggggtgatagccttcaaaaaatgaatgcctctgccaggcatgttaggtgtgtagtgtactctgcagaatcaacaccccactgggatactcccaatccttatggagctacccaagaggcaacgcatggaagaacttcaccctgtaccatctggtgatctgtgattcatcacaatcaaaacctttctgcaaaaaactcctaaatattgaatttttgtttttttcaaatccagaacccaaaaataagacctttctaagatgcgaggccaagaattattctggacgtttcacctgctggtggctgacgacaatcagtactgatttgacattcagtgtcaaaagcagcagagggtgagtgaaactgctctggtttctcagcatttttctagaactatttcattaagaaattaagggcaacctctcagtgacctatcagttaatgataatgggaaaagcaaagtcaaacccgtgttttttcaaccgcccttccttgtctacattgaagaaagaacatggagattttagccgattgcttgaataaatgtatgtgttggggcaggatattattgggaactgagaatagtctctgctgtgtttgaacccactcatccaaattgcctggccatgcttcctgaagcctcatagcaccaaagaaagggataaacggagaattcaaagctacaaatgacttgctgaaattgcaccttgagtcaaaaataaaaacaagagctccagggcgtagatcttaggggccctgaagcagactccaaaactcgatgaggcctcccgaaattttcccagggccacctcaactccttttacttctgctgacaccactaatctgaagttcgctgttggtccaatgcacctggactttccgtaagaaagcaacttccataaatacaagacctatgtgttaacccccatgtggcttactttaatcatcaccgaagcaaaccccaggtgatcatcctgactttaccattatttcactgagtaaattaagcattggggtctcactttttcatctttaaaaggaaaatgcttactaaagaaatgtttctccaagtgcataaagacataatcagcagaggaatggttaaataaaacatggtacactatactcttgcttaatgtgcagtcattgaagtggataacccaacccatatgttttgtcatggagagctccccataatatgttcagaggggaaaaggatggttacataatcatatgtatacaatttgatcctagttcataaaaataaaatctatatgtataagtaaaatatatatagtggatatatataatgtagagatgtatataacatggattatatatataatgtgtgtatacatatgtgtgtgtgtgtgtgtgtatatatatatatatatatataaaatgtgtatacaattatcttgaatattcattgaaaaagttctggccaggcacagtggctcacacctgaaatcctaactctttgggaggctgagacagaatgattgcttgaggccaggagttcaagaccagcctaggcaacacagtgagaccccatctcagaaaatattaaaaataaaaaaattaggtgggtgtggtggcacacacctgtagtcccagctacttgggaggcagagggaggggatcacttgagcctaggagtttgaggctacagtggggtctgattccaccacttcactccagcctgggtggcagagcaaaaccctgtctcttaaaaaaaaaaagagagagagagagagaaagaaaaagaaaaaggaaggtctggaaggatacaacaagctattattagtacttaaacctgtggagagcagttaaggatgaaggagacatacacttctttcctttatatggatctttatcatctttacttttataattagtgtgtactgatttgtgtattgattttataattaaaatgggaaaaaatgaatttaagtttttaacaagggggtttaataatcagagattctagatctaaaacaaacaaaaacttccatattcatttagtccagagacatgtaagtgctcttgaatttaagctttttctcctggggagggcagtttcttaccctctgggtagaaatcagcccagttggagaaactgtgtcctcagacaacagttgaggccttacctgccttactggctacaatcactaggaactctctccccaatgtgtaacacaggctaatttctgtctttgacttcagctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcagtgagttttggatgattatatgtgctccataaggaaagatactatttgtcacgtgttcacaatgccccatgcactgtggggtaggtggttgacaagcatcatctcttttattctgcatccaaaaacaaaatacgatgtagatactgttatctgcattttaaggaagaggaaattgagtcttagaaaagttaagcaacttgccccagatctcagatcttacagctagccgttcaaatccagatccactccactacagctgctctttactgcactttgattcagctgccagatagtttccatgatgaatcccagagcctaatcaagcataatattcatattcagaaccagggcttccttactaatggcaattattcccaaccaatccttccttagcatttgaaaagggacttctttcttagaatataaacccttccaaaatggacatctttttttttaattggcagatagggatttcaccataagtcatttcctttactatttattcattgaccaggcagcatgataaagtgtaatagaaccagagaacttgcttcaaaacttatggagggtttgtacttggtgggtggggtctagttcacatagggtggccaaggaaggcctctctgaggaggtgacatttagctgacaccaaaaggaaagatgtcagttgtgttaagagcagagggaagcatatgtgcgaagcacctgctaggagccgtgatctttgtgtggagcagtgccaggcctacagagcccaaccacacaccctagcatgtctctgcctcctcttatctagaagacctaattgaggaaggagtctttgtgaaactcactgctgtatccttcatgcacagtccagtggctggaacataatgggcgctcagtattcatggaataaacaagcaaattgagcatagagacaattgactgtaactgctccaagacatgtccgcaccaaaagctatgaaaagacaaaagaaagggcagtaaatagaaaatctatcatctcatccccagggagaggctcagcttagttccatgttcagtgcaaagtgagggattagcacagacagggtggtccttcaatgcatggcccataaccattaaagcagaggtcttctcactgtgcggtcccatctgattgttcagtgatgaggattctgagcatctctcagatcctgcaatacatgtggatctgagatgtggccattgataatgactgccttcccgaggcaccagcgtgagcacctgcggcagaggtgcctcacatttgccagccaggtgctcacagaagttaagtaactatccagtggactcacagctgatcaaaggtgcaagtgagatcataagccaaaaccactgaactccaaagccttattaggaaaataaagcatgtttatcctcttccacagtcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaaggtaagaagtgattcaggtgcagtatattccttggtcagttttacggaggcccaccataaagtgagaagatgaatgatgataataacaatgacatccatgtatcacttaacaacagggatacattctgagaaattcatctttaggcagctatatcattgtgcaaacatatatggtgtacccacacaaacctagatggtatagcctactacgcttctaggctttatggtatagcctattgctcctaggctgcaaacctgtacagcatgttcctgtactgaatactgtaggcaattacaacacaatggtttgtatatctaaacagaaaagatatagcaaaaatacaatattataacaatataggaccactggtcatatatgtgatccttctttgactgaaatgttattatgtgatgcataattacttttcttagcacttttctatgtgtctagagctgtgccaagggttttccatgtttatttcacttaatctacaaaattaacgcaacaaaggtagctgatgttattcttgtttttttacccccttttttgtggaaaagaggctttccttttttccagaaactgtggcaaggtaaagtaaagctgtagctgatgcaggaattttgtgtaggtgttagcagcactgccctcactacgtgctcattggacagtagcccaaccccaagaaaaggatggttggtagccagtagtattatcatcatttcacaagtgattgaagactcagagaggttaagtgactttaccaaggtcacccagctaggaaatgacataaccaagacataaactcaatctgccagacagaaaggccatgcacctaaccactccactacctctgatgttggtcattgatcttggcactcagaattagtcctgatagaggagacctgggctccagaagcctaaaattgttgtttcaactgagtgcatgtaatgaatgatagaacaggcaagagatatcgcccccaaaatggatagctcctggctgttccagatattataaaattattttactaaacagaatgtctacacttatagaggctaagatattggcttcccagcttcctcgccttacagcagaattcctttgcctgttgcaaggttccagaggcccttttgtaccgccccagactcctttcaccccacttttaaaatcactggacaaagccctaattcagcatagcatttagcatgtggtagaaattcagtgagctagttactctctgggaaaataattaggtagggaggctatcctggaatagatatttacctaaatattattttacatcttggcaagtactttccctatttaagatctgtatgactaataggtgatattgagtgcttcctatgtgctaaagacttgctaagagtttaacgtgatttttaccttgaactataattctatgaagtaggcattattgttatccctatttataagtgaggaaacagacacagagaacctaagacattttcctgaagttacacagctattaagtagcagtgccagaatttgaaggcaagttttctgatgaaatgatcaggatatggtatttctcaatatctcagggatggctagagcaaatctgtctctctctcaccatcagctcaggactgggtgagtggccatggggtcttgaggcaaggcaattgtgctagaaagatgaaagctgggccaaacgatttctccctcaagggcttacaaagtacaaaagctgcacctacatgtggagtgtctgccagtaggtggtgcaagttctatgcacacccctgtgaattgcaagcacagtgccctaagaccaagatgggcttgttttgggagagtatgcattgcagaaacaggctcagcttaccctgtgactatgttgccaaggggtcttcacagctttccttctcttttgcagaaagatagagtcttcacggacaagacctcagccacgttcatctgccgcaaaaatgccagcattagcgtgcgggcccaggaccgctactatagctcatcttggagcgaatgggcatctgtgccctgcagttaggtgagcaggccctcaaaggccagcccaggcctgcactctcagtgcacctggatgcagggatatgattgggggctgtgttggagaggaaagggggatggagtggccagcacccagttgccagaatcagaaacatacatttattcactaacagatatttatttggtgcctttgttatgtaggacactgtgctggccacagggatattgcaggaaagaaaacagaccggggttctggcctcctaaagagaaaggcaaagaaaagagagaggtagccaggaggcagagcatggaggacttgcaagcttgcaggactcagaatcttgttctgggggccccgggccctgaaacccactgaagggttttcagcaaggaagtaacacaatcagatattattttaagaaaaccctcaagaaagcctctggcaagcatggtgccagccaaattccaggccacataaggaaggcctgggccttctggcatgaaatccctgaaacccagttgcccaggatcatatgttgtgagaaataagaagagacattgctgttacaatgtcaccccacatcaacttttggcattctcttccaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccatgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatcatattttgggcattctcagctgatttgagtactctgcttgcaagtctaccaggggtgcattttttcccctatcatttaagcattgccctttcttgaagtgatcccattccaaattttgcagagttgctctttccccttatagtatttccaaagtcagtgtcttcctgagctcaggggatgtccctgtaatctgacaaggaaggatcctttgcaagggcactgaactgcattgtgccttttttaggggtggaagctctcacttattccaccctctatcctggaatcgactctactggtatcccaagaatcatgaaataaaactctaacctggtacagccatggacatctcagctcttaggtccagctctagtatttattgagagtttgccgtatatatggacatgtgctagccctcagggttgggaagtttcaaaaagccttgcattgtgtctcccaaacagtgcccactcctaacactgcttataaggcaggatgaaaagttaacttcactatcattacacgctaaaatgttcaggatatatggtagcctggggtgagaatgaaaaagaaggatctgtgtaacccagcaccatccaggaagactcatcagagaagagagggtgccaactttgggctaaagaatgggcagggcctgcaaattccccttggtgcttcccatggaaggaggagatggtgggatcagagggaatgcagtccaatttcctgctatcccaaaaatccaagtgtgcacattcaggcttccttgcaatggcagggtaattataataggggtgtttgtttacattcctgattttcagtgtcccctggagccctatgccactctgctcctggcctggaggaatggtgggtggcttctgtcattctttgccaacctttggagcatatggtcccgtgttataagcccacacttgacagcatatggttgttaataacaagtgtttgtccccctacagggtctttcatctgcagttaccaaagtacttaacggacatttaatgaacaacactaaccagatttttaaaaaataaataactaatcacatttcataagcactgagaactgggacctttccccaaatttctggccagcctggggcagaggtgagatgttctggctcccaccatgcccagtgcttttgcgacatgacctcttagcattcgattaatttcagtgcatgcaatgcagagtttttcttctttaaagatagtctccaggactgtcctttttattgtaaatctagccactacaaaatgtactaaatgtctaagccaaagatcttaggactgggaatcagaggagcagactccagtcccaactatggttacataacagacttgtgaccttgagcagggtgttggaaacagcctgctggttttccaatcaatactcattcccaactgttttctccccgatgccctcttcagctctaaatgttggtaagtttagcgaccactttttcagccacctttgttgcccagcaaagccaaaacactgagttctggccaatgagatataagaaaattctgctgggagggttgctgagaagctttggcttttctgatgaaagacagagccatgtctagcatcaccctttccttccatcctcctctcttgagcagaaaaaaatctcgagaagcttcagaggacaccttgtgcccagtatgaaagccatcatgcaaaaactcaagctagagacttcaggctaggcgctgtggctcatgcctgtaatcccagcactttgggagactgaggtgggcagatcacctaaggtcaggagttcaagaccagcctggtcaacatggtgaaaccccgtctctaccaaaaaagtacaaacattagctgggcatggtggtacactcctataatcccagctacttgggaggctgaggcaggagaatcacttgaacttaggaggcagagtttgcagtaagcagagatcacacaattgcactccagcctgggcaacagagtgagactttg

SEQ ID NO: 17195 - DNA, 129658 bp, Human
  misc_feature (1)...(129658): n = A,T,C or G
accgggcgcagtggcttacacccagcactttgggaggctgacacggatggatcacttgagcccagaagttcaagaccagcctgggcaacatggcaaaaccccatctctaccaaaaatacaaaaattaactggacatggtggcgcgcacctgtagtcccagctacttaggaggctgacatgggaggatagcttgagcccaggaagttgaagctgcagtgagctgagatcgtgccactgcactccagcctaggcaacagagcaagactgtcaaaaaaaaaaaaaaaaaaaaaaagaaagaaagaaagagaagaaacagaaacaggtttaggaaggttgagtaacttgcccaaatgtaaaaggggtagaaacaggctctatgtctgattctaaaaagggatgcctttaaaaataagggggaaaaaaccctgtaacacgttgatactctttaaatgagaataattttaacaagggcaatgacagagaatggaaaggaaggaagagatttcagcagagtcagaaggatgtggcaactgaaaacagcattgggacaagggataagaaaaagtcaaagtttctggcctgagtaacagtataagatgtgaactcagatttggaaagggagacaggaaattaagttttggacttatgtttgaaatgacagcaaaacattcatataagaggaagtggttcactttatccaacaagtgtaaagatcacatggggaaatagaagtcacctgcaacacaggcagaactggaagcttcgctggccaggtccatgttaaactctgaccattctctggggctgtccagcctttgcacaggcggcgcgtttgtcttcagttttcaggtttccccgtcctatttcttatctcccagtgcctctggccttttctgtgtctccctccagaatgagctggagctctcttcatcttgacctttgtgtagtctctgaggtctgaggccatcactatgtctgaccctcaaaaaatatttgttgactgactggcttattcctgttgttgccctggaaaagaattaccctgcccgattaagtcacagtttcttccttcttagggcagcgtagttaacaacctcaacaccaggaaattgtcttcctcatcacataccagggtattattcatgcagtttactcactgtaaagagttcccttgaaataaagctaacaattagtcaaagatttacacatttcctagggtcagtcaactttttaacaaagccaacttttagtagtggtggcggtggcgggggggagcccttctttgctttttctgttcctgaaatacaaaagtgatggtaaatgcttcagaatttctctatgagagggtctcaggcactgcactcacgctggagttgggggtggctggtccttttcttgaaccaggttttgcagagaattggtcctagtaaagagtatttgtgtgggaggagtttggcttgctggcggggagtatttggataatactggaagagcctcaaatgcatctcttgcctccttttgaataagatacttttgaggtccacccacctgccaaattccattctattttcttcccacagggagtttccctgattgggaagggcctgtatttcccgcgagcgttaggagatgtgcaggtctattcattgggggagcccaattcccgggaggatttagggatcacgggagggccggggcgttctcctggtggggattttaaggccgctcagagccacgactgggagctacccttagccagcgccccaagccgggagtacggttctctgcagggtagcccggctcgggggtggcgaaggcggtgaatggagacccggggggggcgggggcggggccgcggcgggcggggcggggcggggcgagtcgggccgaggcccgggggcggggccaggcgcgcggctggcctgggcctaggccgctgctgggctccgcctcgcccggctacgcaggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtaagcgggggctgggctgaggggacgccctggcggcgctgggcgcgaggctgagggggcggcgggttcgcggcggtggcggcgccgagctgcgctgggatcgcgggcccgggagggggcctgggccgggcgcggttgaggctggaagggggtgtgttggggggcggcgtcgcctcgacggggcggcgtgggccggggctgctgctctccggagggagtgggagctggagatgggcctggggtgggagagcccgggctgcgccggcgtgaggggctcggtcgtggggagcggcctggacgcggggacgctggagtccggggcgcggccgggggcgcggtccgggggcgtgaggagcttccggccgccctcagactcaggccttcgcgcggctgcgggcgctggggagtggccccgcggtgggagccgagcagtaattatacggaggcgcggcccgaggaggtggcgggctgggaagtggggctggcccgaggggagggggctgttcgtttcctgggctcggcgagcctgggagaggttgaaaaaggcgccctgagctgcaggaaacgggccgccctggggcccgagtggctaccgcgcggtctgttcgcgggtgagcgccccgggaggagctcggcgggacacctgtacttgccccacctcgctgcggccgggacttgaatcgagggacggcgtgacaggcgggactaaaggcaggatgtagtggcttcctgtgagcaggtctcaaaacacaatcacccagcccgcactcagcccgcttaattcccttccttctcatgcgtgtaattgctactttagtgagcgagcctaccagttgactaaatacgaaattttgctcagagttgtccgagcattactgtggacagattatttgagttctgtcatttgaacattttagttttaaaaacgaccttttggtgtcaggttgccattttttttttcacagtggtttatttagatgaagtgctttttgttttctgtttgtaagagagatcaataacatttatttttgcatttgtcgaaaattagcattattttcttcatgcagtattctcagattggaaacatgcttcatgtttcttataaataaccctcaattatgagggcgtacttttcactttgaagaaaattgacttgcattaaagtggctaacaattctttcctgggcaggatgtaaaattttcctctcctctaataccagtactgttgagctcacattctcccacttttcctcttttcaggtggttcacgtatttgggattttatgaaacctcagaagcagacatgttaacttttcttatctttttattccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttattttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaactacatatacacatgtcttggaattgagggttagggtttccagaaggacttagttgtcctgtgcttttgtctgccccatgccaaagaccactaagaacagttttgtaagtgaaacttgggtctacacgttaaaaaaaagaaaaacaaaaaaccactttgtttctatggtttaaagcaaccctggcttggaaattgatcatccagctgctgggaatgatattactgctttaaccacagttgaagtattctatctgttatcctagtcagtttcttgctttttaaattgcttatcttatagctcaggttatggagtgtctgctttctagaaaaaaaaaatgtatttgtatacttatatacagaagctctcttcccatttctttgtcctccttttaaatgatgtaatccacagttggttgacattcagaaccttgtgaagagatgctgttttctgtttccctgaaactaacatgtgggttttgtagggtggggactgaggggttggaagagtcattagcaggtgtcaaggtcacagaaatgagatggtggtggttctgacaagatattaagcagcttggggagggtgtaaccgtgtcagcttttctcttcaccacagtaggaaaccttggaagaaagcctgatagtgcccactaggagatgtgctggcagattttatactactgattgagagcctcttttctggagagttagagatctgtaggggctgaaaattagcctgaagaaattttcttatttctggacttgcataggacttttaaactgcacatcaccccagtgaaaagtgaggatggattggtttatgtatcttgaatgttcaagagataatagtccataaccttctttagggatttcattcctgtaattatttccccttatacttcacaaggtgaaatatctgtcagttggacagatatttgtctcttggacaagaggaaacttaacaaaaagtggtaaccaaaaaggtggaggtcacaaaataacaacatgagacctcaatatatataaaggatgaagccccaataccccttttttgcttgagtgtacttttttttttttttttgccggggggctggggaggagggaagaagggacatgcaaatatgtttcaggtgttttatatgcgctcaaacgaacccagggaattcgagatccatctataagacaaaatattgtcagcaaccctggatttgctgcagtttgcgctaggaaaccatgacagttctgaattgtctgcttccttaaactttttcaagaggtgagtttggttgtttgatatcctaaggttgtcatatgaacccttgataaaggaaattaggggtgtactcgactccattcttcggtctgcactcctgtgtagcgagtagcaagtatgctagaacacctgaaacacatttgcatgctccctcctcccctcaaaaaaaaaaaaaaaaaaaaaaccgtattcaaacagaaaagagggattggggcttcctcctttatgtatcttcaggcttcatgctgttatttggtgacctcctttttgattagcacttgttaagtttcctcttatccaattacattagattgtaaaaatgttgcggagagcacccatgccaccatatgtgtgggcttatctactcaaggaataccagatcaataagagagccaaatgggaaaattttgtgtgaattttcagatgtgtggtacagtgcgagatctgtgggactatgtgttccaaaactcacttagtttctctggtgtcttcagaccaagaatagcctagggttatttgacagagtagggaagatctatagggtatggttaagtgcttgagcttagaggctgggtgaaaaagttagttacctgggtttgaatcttcacctaatttccaacttttgttaatgtctttgggccttcatattctcatatataaaatggggatagtaaaaatacctatctcacgggttgttatgaggtttaaataagcctccctccctactctgcccctcctcatctctgcctgctctttctcactccccaggatctgggtcatacaccgaccatctcttaggaaggagtaaagtaggagataaaaactaatcttcatctgatgttcttgtccaacgtatactggagtttccaggtgtacaaagctgattaaaatctgaagacctatattcttctttaaacgttgttaattaatcttcatatggcgttagccagctcacttatcttgaagcttaccttccgcatcttttaaatgggaatgatgcttttccactatccattgtatacaggttgttccctctgcttgggattgtctttcttctttactccaccccatctttatgtcaggaagctcctactcatccctcaaaagcctgctctatgtgatctccttcccaaaaccttctgagacacttccagtgccatctctggccagcatctctgctgctggggaacacaattccttgctcatttccttattatagcacatttcatagaaatcatttgttcacttctcctgttagattgtgagctctttcaagatagaattgattcttgttcatttttaaaaaatcatcccagtgtcagcacaatgcctagaacagaataggcctttagaatatgccctacctcacaatgttatcctgtggataattactagatatgaaaggattttataaattatatacctaaaaaaactagaaggtgttagtattaagagaaaactgtatgagtctgcatcaggaagttcatccctttcaaaatcacagtgcccactaagcttaggtttgaattgatgccaaagttgccttgttaggaaaaagattaaatttttcttaatgctctgattacttattattagggcatttgaatattgttactaattggtcctggagcttggaaaagaaaatctcatattcatactttacacattaagtgttttaatttgacatgacaggtttgaataaaaccgtctatttaattctgtgaagtataaatgaaaacattttattgactatccagtaaagttgagtggaagagattaaaaagggtgtattcatgctaagagttcatttttatcagatatttgaaatgagatgatgagttatttaggatggaggaagaatccatctttcagatggatagaaactggggagaaaagggttctttgtaaaagttcacagagcagtctgctaatcatttgctctgtggaagacgggaggtaaacctcagtgagttcatagagttgtttttttaaaacttagaactctttgaatagatccttaagtgactaatatagccagaataaaaccatcattttatcctttaatcatagctgctaatcctatttccttgttaatgtgctttatgaaattatttgacaataatatcagattacatgtttttgctactaataaagttctattctcttttgagaactgcaaacaaaatgttgtatagtcatatattcatgtaagttaagctttttatgtgtattaagacatttttatggcatctctttaggtttgtatgtaattttagttatcaaaaacccctatctaaagtgataaacattaaaagtttgtatcagtacacatacagagaaccataaatgacaaatttgttttcctgtcattaatgacaatgactttgggcaaattctttaaccttgctgagcccgtatttccttacttgtaaaattagaggtttggatatggtctttaacatcccttctaccattttgattattgctttttaacttgaaccatttgctttaaggcagtacatcagatgctttattttagtgtttaaatgtatttagtacacttgttttgcatgattcactgttttaaaaatatttaagatttattagataagagcgtttgaattctaaattttttttctgtgactgttaattaattcagcagcacgtaatacatatcgaagggtctgttaagagacgctaacccactggactgaaatgggcctaagctgtgaatcggatgaaagatcctattttatcctaaagtctatactaagcaatagctgtttttagacatctgtattcttagacaattatagaaatttaaagctggaaggtagagaacatgaaggtagagaaaataaaggttcttacccttcattttacaaatgaagaatctaacagagacagcaagtgtcacacagttgatggcctgttcggcactagtccactattatcaaagttctttctagaatgctatatgagattaacttattactatgaatgttgcaaatgtactacatttaatacacagagattatactacttatctgtttatatattgagaggtggtaagattttcactgtgccgtctacacactcttaactgttccttcttaagaactttgtgaagtggttaggattagtgatgaaactatggttatgacctaggtggagattgaacctggatgtttagttacttgtgccatggtctacctcagctattttcagttctgactgtctgtcaccatcacctgtgaactaaaaaaattatgatgcccagactgtaccccagacctactaagtcagaatttctggtttcaaaagttccatagggggtgatgttgggcagctaggatagtgaatttctgcttttgtcacaaatagattagccacataccctacctaaatgatggcaacctgctgtgctatcatttaaaaggtatcagtagaaaggttggtatagttacagtgagattttagtttgtttgcatatatatttgatgtattaattctatttgattagataatatgaacacttggtacaaaattcaagaggtacaaaacagtatatacattgaaaagtattccttcctttcattatcttctagccattccctcccaagaagcaagcattaccaatttgttatatcctttttgttgtgtgttcttccagaaattaagcatttacaaacataaatttatgtgcactaatatattccttccaccaacatacaaattatagcaaaatatatacatttttctgtatcttgcttttttacacttaacaacatagcttgaagattttttcacattcacataaagagagatctgccttattttttaaacaactgcataatatttcatcatttggctgtaccacagtttatttagccagtcccctattagttgacacttaggttgtaaacagtcattgctattacagacattactacaatgaataaccttgtaagcatgtcatttttaatatgagtgtctttttgtaggatacatttctagatagatgttaaattgatgaattgaaggatatgtgcatttttattttggaaagacaatgctaaactatagcaatttaagctctcaccagcaatgtatgactgcctatttctttatacccacgtagggtgtattttaaaacttcttaatctttactggtctatgaaataaaaaggaacatttaatttgtagttttaatttgcacttttaaatgagagtgaggattgctctgtcaccagggcacgatcttggctcactgcaacctccgcctcccgggttcaagcgattctcctgcctcagcctcccgagtagctgggattacaggcatgtgccaccacgcccagctaatttttgtatttttggtagagacggggtttcaccatgttggccaggatggtctcgatctcctgatctcgtgatctgcctgcttcagcctcccaaagtgctgggattacagccgtgaaccactgcgcctggccctaatttttaaattttaaatttttctaaggcttgaaattaagttataggatctcttcatatttttaagagccattttttttgatgtgctatgtgaactggtctatttcttttgtccttttttttctggtgagttacagtcttcttgatttgtgagaaaatgctttatgctgtaaggaagttagctattattttaaaacctgtgcaaagatttaaaaaatctgtatactttggctgatgcctgaatttattcttaagttgattgtgagatccagtgagggcagtcagttgtaagtttcatctacttatataacgtctgatggttgagaaattgagaaagaactgcttgaggaaaggtaagtgaagacttataaacaaaagttaaaagacaatagattgggagaaaatatttgcagtgtatccttcagacaaaggaaatgtgtataacactgaattctttgccaggcactgttttaaagcactttatgcgtattaactaatttaatccttacagtaactctaaaaataccattattatccccattttacacattatgaggaaacagatacacaatagctaagctaagtaaattgaccaaggttagatggctggtgaatggtggagctatcaatcagactgggcagattggctctagagtccatcctgttaactcttaacctactgtgctattatgcctctctatttattatgtccagattatataaataattcatacagacttaaaaacaagaggccattagaaaaataaaggatacgaataggcatctcacaggaaaggaaatacaaatgtccagtaaacatgaaaatattggtaaagtaaaaattaatcagggaaataaaattttaaaacatcaatttacaaaaaaaggaaagtttatctcagtctttggtgagggtttagggaaataagtattttcctcattgttgttgtgagtttaaattgataaagcaatgttggagagcattttggctatatctgttaagaatttaaatgtctatacaccatgcatttttacttctacctatttgccctgcatcaacagttgtacatttagagaagaggcatatacaaagatattcaatgttgccttgttggtaaaacagaataattggagacgacttaaatgtacatcggtaggaaaatggataatatgttcatacacgtattctatagcaactaaaaagaatgaggtatatctatgttatgaaaggaaagaactccaggatgtcttgttgggtaaaaacagcaagttgtagaataatatgtgtagtatcctgtgtattgttttaaatctcaaaacattttacttttctgcatgtagatggataaatacataaaaagaggtctgaacagttgtacagataacagtgattgcctcaatggtggataaagggagttagccggtgctgggaaaactggctaggcatgtgtagaaagctgaaactggaacccttccttacaccttgtacaaaaattaattcaagatggattaaagacttaaatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctcattaaactaaagagcttctgcacagcaaaaaaaactaccatcagagtgaacaggcaacctacagaatgggagaaaaattttgcaatctactcatctgacaaagggttaatatccagaatctacaaagaactcaaacaaatttacaagaaaaaaacaaccccatgaaaaagtgggtgaaggatatgaacagacacttctcaaaagaagacatttatgcagccaacagacatatgaaataatggttatcatcactggccatcagagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatagggagtatatttatatattatattatcaaaagtaactatttatataaatgaacttgatacagtattaatcttaagctgtgccagtctctgttgctctactttggaagactatcctatctgcaaaacaagagtaatcaaatgttaggttttgtaacattttgagtgctatagaagaaataaagtcaacttttctgttaagtttttttggtaacttttgatataatttcaaacttacaaattgtaagaataggctgaggagggtggatggcttgagctcaggagtttgagaccagcctgggccacatggcaaaactccgtttctacaaacgaaaaaaaaaaaaaaatgccaggcatagtggtgtgtgtcttcagccctagctattaatacttggaatgctgaggccagagaatcacttgagcccaggaggttgaggctgcggtgagctgaggtcgcaccactgcactccagcctgggtgacaaagtgagaccctgtctcaaaaaaaaaaaaaaagtagaaataatacagcaaattcttatatactttgcctgtttgactaattgtttatgttagaaaaactttttaaaattttaatacattgtttcagagaaatgtggtaaaaagggtctgaaaattttggatcctttaaaatatgacatttgtgtgagtggtacagaattttagttttgaattttacagttttatataaaatattcttggtagatggggtgaactaatgtttattgagtatttcctggtttccagatgttgtgttaggatactttgcaaaatatttcatgtaatccaatttcatgaagaagattgttattcctattttagagaagaagcaacagacagaggttatttgctcaggattgtaagggagcagagccaagttttcagaaagtctttatgttaccaaagcccacatccctttctctacaaagctgcctgtgagatgatatattggaaggaattgatgaatacatttatgttgtcaagaagttgataattactcctaaattggctatggtctaatgtagtggatattcaataaaattatgatgtttgaatgccataagaatttatcttctggcctgttttgggggttcatgaatgtaattattttagctgcctaactgcttatgtgggtttgtatgtacttttgagtggttcttggatatgtgtacacacatacatacacacacacagatatacacatacacacctttatatgctcatgggtgtaacttctttatgtgtctaggtgtcttttttttgtggagggggggcgaagatcaatatgaatcctattttggccccctggatgctgtcaccagaaataacagccatatcccatatatagcctgtccatgtagccctgagttctgccagcacctggctttttgccttccttttgtttgtcataccaggctctcttggtcaccttggtagccttgctaagcttcttgtagctataggtaccattggcttagcccagaagagattcctgccatatgtacttcagagtttggtttgccacttgaggaaggggtctgtagggagcttgtagatcagcacacattcaaaactgaaaccggaagtgggcaaggcaaaccacaggaagatcctgcccgcaacttggtgacgtatctatataacccatagacacttcctggcaataccttgtgaaacttgccttttcgtgtatagtagtttcctaacttcttgttctagattaagcttcagtgaaaagtgattaatatgatagcagtgtagataactgtatgatagttattgtgcacatgacttccatgcagcaactagccccgattatgttctgtagactttatcactgaggagttgcagtggtatttatgcgtttactttgactttgtcttgtcactagccattgtcttacttatgtgtaattgtacttatatatagttcaggttttatacccacaaaaacccttgtgatataataccactatacaggattgccttatttatgtggaattgtacttatatatagttcaggttttatagccacacacacacacacgaaaaaacagttctttgcttcactgagtctcggctagccacccaaactgtgtcatattcctagagtcctgtgcccactcaagtgtttgctcactggtactacctcattttatcatagtgccttgttcttaggcagaaccagatttctggtaggagttatttaatgtgttgattttttttttgagacggagtctccctctgtcaccaggctggagtgcagtggtgcgatctcagctcactgcaacctccacctcccaggttcgacaattctcctgcctcagcctcccgattagctgggactgcaggtgcacgccaccacatccagctaatttttgtgtttttagtagaggcggcatttcgccatgttagccaggatggtctcgatctcctgacccgcccacctcggcctcccaaagtgctgggattacaggcatgagccaccgtgcctggccaatgtgttgtttttttaaagattaccaatcgagtgggattatagactcttggattattttacagatacaagtcatttgccaggagtgaggaaaattgcttgacaactgagttatctcaccatgttaatttatgcattggaaaactctgcttagtggtagatattccagcagtcaccatatgcctattggtactatttctcattctctgtctgattaatgtcacaaatgtgtaactttccagtggtgttttcaagatgacagttaaggagccactaaggaaggaaataacagctacataacttttttcttttcagtagttcttgacagtcccccctcctttttttgtttttgtttcttcataccctgcagcaatctgatgtactctgaagggggtaaatttgagactctttggaaggtcatgtgtgataaagacagttcttctcttcctttctccattcagaactgttaaagataaatcaatgggagtgtttttttcttgtgtaagatttattatatacaaaatattttttaagtgtgtgaaaactgattaaatgataaaggctaaggtagcatgtttaaagcatggttttctgctacttttctactaatcacttaacctctctgagcctcagcttccttgtctacaaattaggaatagtagttttactaatcatatagcatagttgtgaaaaggttaaatgactcggtatactgcctggcattttgtgctcagttaagtgttggttctaacatgagcagtagtgatactcataaagtatcttttcatagttttcttaatggataacttatttgatagaaatgtactggagtattcatacttacatgtatatccagttcttgtagtgttcatcaggttaaactggcaataagtgttaatatctgaaagcattagaaatcagtgttactctgtgctttttaaatttcaagtgttgtctctcagattttatttttttattttttattttttttgtctctcagattttagagctatagagaacctagaagattaactggctaaggagttgcaaactcaaatatacacagaccaggtataatgcagtaaagcccagcagagattattatgatttagtaagatacacctgtctgcagtttccactcaaaatcattttgccagattttgattattaaagagaaaccagaaatacaaatttatttattgttagctctcagtttctagatggtcacaaattattttttaaatttggtgcaggccaaacaaatctctggctagccaacctcagatttgtatcctcattttagagatgtggagcttgaggtataaaggttggacgtgtttccatgtatttcctataatagaaatccattgattctgtaacaaaggactcattttaaacaatgacctcctctgttatacccagttgttatattacaggttatttttggtcaggagctaatggcttggatgaagggaattgtatatagatgctaatttttaagaatgtctagccaagaaagggcactaatagttactatccattgaatatttactctgtcttaggcattgtgccaagcgctttaccttagttaatgctcacaacaatcttgaagcattatagttacctctttttacataagaggttgagagtaaggacatacagatagttaaatgcaaagttcatgttgaaacgcagatgtctgcctctgtaatgcattcatttaacttgctatactatactagtactgtatatgtttttataattatgcataccttttatcatattgcaaaaattgaaattaaactttagaagaaaatttcaaagaccttatgatatattaccattatatagggttgtcttatttatatggaattagattggcacaacagcattttaattttactctaaactagtcaataccagagactatatcatatttttaaatgtgcattagattcattctttctcactcttttttttttgttgttgttgtgaatgtaaatgacaaaatgtgcatattttatatcttttcatctcctgaagttctactgttctgtttaggttgatatttctattactggttgagcattccaaatttcaaagtccaaaattccaaatgctccaggatgcaaaactgagcaccaacatgattctcaaaggaaatactcattggagcatttcagattttcagatttgggatgcacaactggtaagtatatataatgcaacatttcaaaatgtaaaaacatttgaaatctgaaatacttctggtcctaagcatttcagataagggatattcgatctgtattagaacattatgtcctgagtcattcaagccagttaatgccaaattctgtggattctgtctccatagtagctcttctattttttctttcctcctatctccctttgttaccttaatgtaggctcttcagactatcagagtacttttcctgaagtatgaaccacacagaaacttttagcgacccttgttgcctactgaataaagttaaaccttagcttggcattttaggttctctgtttgatactagctgtcctttataatcttttccctctcattcccccttcatctctctttatgctttagtcagtttatactattcactgcctcctcgatggtgctcttcttgttgccaccctccagaacttgttcatgttatgccttcctcctggaacgttatcctccgatccccaatttctgtattttgaaaatatatatcattcagaagagttattgtgaagattaagtaaaataatatatatgaagtcaatgaaaaatctgtgtaatacatgtattaatttattcagtaagtggtagctattattatgatttggctttctgtcaccccaaataatccttaactttggatcatcttgtccaggaccctggctctttgcagtttttctaggggattaatcccactgggacccatgttggcgcctacccttgtacttcaggtaacctttgaagcagacctggacctactacatctctttcagatgggaatagtttctcagcacagctgtattcagaaagaccttaagagttgaatagaaagactctaggctttggagtttgatttatgccagataaccttaccagctatgtaactgaatttttttttcttaatttatgaaagggaatagtaatgcttatctcacagggttgtcgtaccgatcaaatgaaacatttgagaaaatatttaacactgtcttggagcatctaactacttaataaatctttatcttcttttctgtcttatccctgtagtgtcctcccctaggacatgaagaaacatacatgcaaaccttcaggtataaatgcatgcacataatcctcaaacatccacataggcacataggtacatactcacatatgtacatactcacatacatgaacagaagcatatacatcagaatctctacctttgatagtagcctgatattggaatttttgtcctagataaaatttatatggtaggatttgaatttactgtctgatgactgttacatggaatcattgatcttgtacatagagagttggctgtttttccatttctgttaatcttaacagttttgatttgatggtgtttatctttcgcgctttaaactatttactttttaacaatatctaaaagctgctgttttctatagttacatgtctctcctcttttttcaggtatttatgcagaagttactttctcaatgaagccttccttgagctacctcatttcttgtggtgcccatacttattagtattaggccatacatttttacttatttatcttatttgttgtcgatctctccatgtgtgttagcctaataaggacacagactttttgtctgttttgctcactgtcatatcctagcagcttagtaggtactcagtaaatatttgaatgtgtgaacttcagcactggtttattttcaaaacgtctctgtattaatacaataaagattctttaagtgcttttggtaactgtatacaggagactttttaaaaaatctttggagtagttgacataaatcaacttaaatgaaatggaaaaaagaagtttacatacaattttatggtttgtgatgtggtattggaacctcttttttgcccatgccaaagttatatacacacgcattgatacttattcagcagctgtttcattatatattttatgctaaggatggtgctaagaattggtccccttcctcaagaagtttatagttcagtgaagagacaaccaaactgcttttgcttggttgtgtctcatctttaccacctcaaaacattagagagccctgaggctcagtcttcaaatttcttttctatatttgctcccattgtgattttgtattgtctcttggttttgtaaattttatgtacttactgatgattctcaaattttttctctatctaggaccctttgtccttggacagattgtctgcacttggatgtataaggcatctcagatttaatattcaatacagtctcttgaatttggtccccaacaagaggctgtgtctctagaaatagcatctctattcatccagctgctcagactaagactcttagaagtcattcttgactactctatttctcacaccctgcagtaaatcctgttggctccatcttcaaaatacatgcccaaatgacccattctctccagacccgtgtctgctctgcccctcccctgacctgcaagttttcgctcattgagattactacagtagcctcctatctagtcacctgcttctacctttcccctctgcactgattttaaaacaaaaaatcttgccatttttatgctgaaaatccttcaaaaccttaccatctgacacacaaaaaaagcctaagactttcccgtgcctgtaagaccttatttaacctgtctcctcccatacccttactccatctcttactatctcctccctctccccactttgcttattgctttgtagccatactgccctccttgccactcctccagtgtgccaaactatcctgtctcagggcctttgcacattttattctttctgcctgtccgtctccttccccagatatctgtatggcttataccctcaatgacttccttcaggtatctgcttaaatattttaattgaaaggccttccctgcttccctatataaaataacattgacctcctccctgtctctaccctctgggcctgccattccctaactctcttaacctgctttgttttcttgaatagcaataaatatttatttcttccatgacaataaatactatatgcttatttaagagtttgtggtatttgtcgtccctgtatatattgtacaacagtttcgtatgggcagagacctgtttttattcactgttatatccccagcacttagaacagtgcctcgtgtgtttaggcacttagtaaatatttgttgagtgaaatgcaacaagtacaaaacaatatgatcactgtagtagagatgcaaggtacagtagaaacacatgggaaagagtgacatgactacataggaattgaggaagactttgcaaagatgcccttaagcagagctctttggagagaaaaacaggtagggcatttcatacaaagaaaatagcattgcagatacacagaggaatgagagaacagtgtgttcaaggaactaaaatatagtactgctacagcataatttgtgggggtaaagatgaactagatgaggttgaacatgtagtagatagcacctgatcatggagggatggagggtttttgtgccagactaaggaattttagattttgtcctgtcaagtgggcagtggtagatagtgtgagccattgaagacttctaagcaagggatgttttatttatatttatttatacgtgtctctgtgtttgtgtgtgtgtgtgtgtgtacgtattaaaaaggtaactagcaacattgtgaaggttgagtatcaaagctaaacacagcattttatttaagatatgtatgatttaggaagatatgatgtagaaaaacaattactatcacatgtgggcgagaggatatttcattttatatttggacaaaatcatggatgtatagtgggaagatgttcttggcatacttgcagtacatttgtgaaagagaagaaatgcacaatggaggattattctgtttgtctttgaaaatccaccctttaagaaagaagactttaaaaaattagttaacagttatgttgtaagtcgtaatgtacactagaaaagtgcttaaggagtaccagttatgaatcaacaagaaaagatgttacagaataaaataaattgtgcttgaatgtcaacctcctttcttcgtagaggaacagttggttgtcattgatatacctcctgatcttgatttattgttgaaggaaatagtgacagttgtacacacaatcaaatctatactgtttgctgtgggaacaatgtatctgcctttgtaggacaaatgtctgcttttgcatattgcaggactccgcatgcacagaatttttgaaatgagggatgaactataaaaacatttcttcctttcattcaaatgcaagtaaaaaccatttttattatttcagctggcttgcttgtgtcatatcttagcaatatattgaatttcttgaatactttattcttattaatttagggtcaaactatgatttgtgaatttaaggataaaatagaggcacccaaaatggtgcacacgatttgaatgttaagaatttggatttggcactcccagccaggcatggtagctcacgcctataatcccagcactttgggaggccaaggcaggcagatctcttgaacccaggagttcaagaccagcctgggcaacatggcaaaaccctgcctctccataaaatacaaagcaaattagtcaggcatggtggtatgtgtctgtagtcccagctactcgggaggctgaggtgacagaatcacgtgagtccaggaaggcgaggctgcagtgagccatgattgtgccactgcactccagcgtgggcgacagagcgagaccctgtctcaaaaaaaaaaaaaaaaagaaaaagaaaaaagaatttggcattccaaattcatgaaaatatgaatactgtattattgaatatatttttaaaattttatccaaatgctacagaagatgaagaaatattttgtgaaggtagatacaactatatatggagttaagatccatttcccaagttaaaggattccctttttaagtgtgctgctattcaactcactatctgatggaacaatgaaaataattttcagtgaaaaattgcttggtaatttctgtgtccatgtttgatccagatagccacgtgtagccggtggatttacccaaccatgatgaccagtaactcaaagtgggattttctaatttgttggaaacaaaggttagaaaagaattgagattaggtgacagcatcaactctagttagtttaagcagaaagagctttaataaaaaaattttaagtggcttacaaaattgttgacaaggctgaagaaacagactctagatctagaaaaagccatgttgcatctaggccaccaagagagttattgcctcttttaggatcagaaagacttttgcagaattgtgaaactgtaacttttagatgcctgtcttagaaccttaccacctctgccatgatcaggagtctactactgttaggaaatagccattagcaagcagccaccttcctcagtaagccgttgttgttgctggccctagagccaagccctgcctaccacaacctgtactgcagaatggatgccttgtgcctttcttaatattcatgaaatctgtgactgaatactaggacttcaacaaatactgctgtgaacatgaacatctccatgacaatgtttgctagtaaaacaacccaaactcaacctcccttctcttctgtccttgaaatttctagtgagtgcatctggttggtggaacttaaatcacatttacaactgtagccacaagagaggctgggaaatgtattttttaactttctcttctctgcagcacaggaagacatacactgaaggaggttgaaatggatgtgaacagtaatctaccatatttactgcaggtttagaacctggttctccttaaggctggctgtcattaaacgggctatagataagttgagaaagtttataaataataccgtcaaacaatgttgagaaactcatttgtttctttgtatatttttattgttttataatgactacattaaaaaaaaaactagaatttgtccttcacctctatgatgaattaagtggtctgtggataccgaaagtttcctcacgtttaagatgtggttagtggataaaaagaccaaaagagggagtataagaaaaaccctcatacaaggttacctgagctgaggaaaggttagtgttgtcaaataatgaagagtggtcaaataaggtgggactgaaaagcagtgttacgatttgggcacttaatattagtggttttttgggttttttttttctttctttactattgagacagggtcttgctcttttgtcccaggctggagtgcagtggcagctcactgcaactcccatcccctgggctcaagccatcctcacacctcagcctcccaagtagctgggaccacaggcatgcaccaccacgcctggctaattttttgtatttttagtagagatgagatctcaccatgttgccaaggctggtttcaaaatcctgttctcaagcagtttgcccaccttggcctcccaaagtgttgggattacaggcatgaccactgcgcccagcctgttagtgttcttcaaggttctaaacaagaagtagagaagtaggataagagggcaagttgcaggtttaggctgtgagttgaagggagcacttgaaaggagagattatagaataagttttcaagaaatttggcaatggattttttttttttttggtccaaggcgcatgctcatttatataccagaattggctagagttcatgaggccctgaacaaatatcacacacaagcaagtacagtcttccaaagttcttcacttttgtctttttgtgtagcttgatgtaaagtgtggctcttaacatattctctttatgcttagagatataataggcacaatattacttttattatatctgtaaccattacttcctttttgattatgttgtttataaagtgccaattaatcactactatagtttggagttacagtatctgacttaacatatttgtacaattgattgttgagccgggcattgattagatgaattaactttcaacaaagtttatttgaacttcagtcattggtggatatttaagaagtacagattatgataactgcttttataggaaaggatgcttggtacattttttcatatgacatagatcttacatttttatttattctggataaatatctgataatgtcaggttcattggattcttcaaaataacctcattgtctctctcttaagagggagagggaagtagaatatgtgtaaatttatataatgttgttttctcaaaactgcacctatgtgaatgaaacagaaacatgttcagggacagttagtgtttcaaattctcccaattagatatggagcatatttattatggagcatatttattaagtagaaaattattatggtctaattccaaattttttatattttaggtcctatattgcgacctagttggactttcgtttaaaaaaaagtctaaattatgcagaagggagacgtcaaagaaaaaggagagactgaagaacaagaaggctgaaagtaatgaaaatagaattgctagacagtgtcctggagggacaagagggaatggggtagagagagcacaggtaaatggatgagctttggatgagaagaggaataactagtctttggaggaagaggaaaatggatgaataccggttcagatatagattatttgtcttagtgacctggtttatttgtaaggactaacccattttaggcagttaattaaattaatcatttaaaaggtgagattcctcaattctgacttgagatggacctaaatttgtttattctgtttaagtagtaactttatttttttagtgacagatttaagaagtatcttactggtactattccattggttttcttattttaattttataaataatgtgtttactgagtttttttataggtgcttcttaggtttctaatagacttctctaaaatatattggtttaaatggcctttaaagttgataagcagaaagatacttgagtttatctagtccaaaccttcatcaggaaagctgtgattgagtgatttgtctgaagtcatacagccacttagtagcagagtaagagaggaatattggttttatggttcttggggtaatgctgtttcccttatgccaactgattgcataagggaactagtgtactgatttcagcgcccatacttgtgtatgtcctttgagctagagtatcaaaggacttcaaaacttcaaaactagactttttaggttatttaatattccttcaacaaatgtttctcagctgtctaccgtatgacagtcactgtttaagatcttgaagatcaacaagttcttgggcctcaagaatgagggaaccaaaaaataaacactgaattaaaaatgaacagaaatttagataatcatcagtgctatcaaagaaacaaaatggagaaatagaatatggtagcagaactatgtgctttagatagaatagtcaaggaagatttctctgagttagtgatatttgagctgagactgaatgataaggcactcgccattgaagatatctaggagtgtagcattccagacaaaagccctaaacttgaacatggtgtggcacagttgatgaatgaaaaaaactaaacactgaccggggttgggggaatggaaggagaagagatcagagagaccattaagtagggctttgtagactgtggtatagaaagataattttattctaagtgaaatggtgtggtattggaggaggagagtgagtgagtaacctaaagaatatgtttcaaatatcacactgcttgatggagaatggattgtaggagggccaaaagtggaagcaggggcaccagttaggcaactctcatgtttgttcgaataaaagattgtggtggcttggactcggtgattctggtcaaggcaaagagaactggttggatttgggatttattttggaggtctgctggatttgctaagagactgggtatgggagtttggggaaatagaggatggtgagagtaagagagaaaaatggtagactggggaaagggcacatcttggggaaagaaatcagatggtttttctgggacttgttaaatttgaaatgcctactggatatccaaggagacagttaaatagtcacatctagtgtttgttgaggagaggttagacctggtgttgcagatctgggaggcgttcgcattaacaccatatactgcagagttggcaaagagaaggaagagaaggtggtttggaattgaggcattgcatgtttagaggtagccagggggagaagtcagcagagagccagtgacgtaggagaaaagtcagaaatactgtgttgtggaagccaagagaagagagcattttaaagagggatatttatgttcacttgggttaaatcatgctgccaggccgggtatgatgaaaacagagaagtgaccgttgatttggcaatgtggaaggcattagtgtcctcagctagagcagttttagtggcatggtggggtcagaagctgattggagagggttgaagaatgaatggaaggtaagaagagacaacgactagagatgatgcttttaagaagttttttttccttttctttttgtgtgtttttttaagttgagaaattcccatcatcgtttatatgctgatgggaatgatcgctagagaggaaaattaatggtgatttgggaaagaaagattaattgtggagtaaagtccttgaggtagcactggtggaatgggatagagagcacaagtagagggattaccctttcataggagtggggatgcaattacgtaatataaaaaagggacctcaagccactttacacacagcccctcccttcagtcttaacaatctcctttagaccagcttgatctttctgtaatcactagtgtttttttttttttctgtgccacattaatatgttctttcagattgaagtcatcctatataaggcttagtatgaagcagttgatgatatttaataacaattttaaattttatgccaacaggtgaagcaaaaaatttattgccatatcttggaccccacaaaatgagagattgtttctgtaccataaatttggaccaggaagaagtttatcgtacccaagttgtggaaaaatctttaaggttggtagaaaaaattggtaaattataatttttactatatagattggtaaatattatgcattttccagattataataatcaagaagacaagacagaaacagtgcttgctttcatgtggcttttcattgcctcaaaatgtatcttcctcttaattgttcctaattttatctttgttttctggagaaaagttttttcacatgacaggctaaatattgcctattcgtttgaactttcctcaaagtacatctttattttatttatctaaagaataagttacttaaagttcatagaagttgcttaacttagtagtgcattatcagggaatgaattctcagatagatgtctcatctttgaaagtgtaattgccctttgagagtatcatattaaattctaattcataaaactggaatataccacctctgcaccgtagcaatgtgaacataattctagtgcagagttgtgctgagaatcttgttcagagacaaaagtcaaaataaggaggccgggcgtggtggctcacgcttgtaatcccagcactttgggaggcagacgcgggcagatcacttgaggtcagaatttcgagaccagcttgggcaacatggtgaaaccccgtctctacgaaaaatacaaaaattagttgggcgtggtgctgggtgtctgtaatctcagctacttgggaggctgaggcaggagaatcgcttgaacccaggggtcggaggttgcagtgagccaagattatgccattggactctagcctgggcaacaagagtgaaactccatctcagaaaaaaaaaaaacaacaaaaaaacaaaaaacagggtgtggggtattattggaatgagcatgtggtggatgaaatattgaatgccatgccttatctgaatcatattttaggtcagttgtattttagggatctgttttttttttttatgcctttaaaaaaatatctttcttttacatttgcctttgaagtttccctttatgtctttattttcattttttataattttaaatatctattgaattcttcttagaaaaggtattgtataaaactgaaaatacttgagtagcccaaaaacatttcaaggagtaaacttgaaatctttagtcttaattctcatattgttcttatttggctttagaatgtactttaaacataatatttgaatgtggatgtgatatataaaggaaattctgcatttataattgtttagaaaataatgcaaagagatacatacctacacatgtcttgtctttcatatcatgttttcatatcatatttgactaatagttctttttgcattgatttctatgttgaaattaattagaaggctctagttactttgtgagaccaacttttaaaagtttagtttggttacatttgaagggaaaaatatagtgacaaaagttcaccaggcattttaacaactaaaaagctgaaccaactgttttctagacaagatcagatatgacttctgtaggagtattttactttatatttcagcttctcatttagttatgacatcataaagatactgcatttcatagcgatatttctagagaatctttttgttctttaaactttctcaggaaagaggtacacttgacaaaagaaactatcatttcagagattcgcgtcttcatagaagaatcatagaaggataaatatatcaaaatggcattcttaaaatgaacttataaaaataagctttgcaacatgaggatgggcaaagatttcttgctttgaatgcaagaagcaccactaattataaaagatgaaaattggtaaattagattttatcaaacttagaggctccttttctttaaaagacactgtcaagaaaattaaatggcaagccacacctgggagaaagtattctgacaaaagacttgtatccagaatttatttaaaaacaaaaaccctgataactcaaaagaagaccgatggccatttaaaatatggggagaatacttaaacagatacttcagaaaagatatggccaagagcacatgaaaaggtattggacattgttagtcatcaggaaatcaatttaaaaccatttttgtcactatagattctagaacataatctgcagtgatagaaatcatatcactggttgcctgtaagaatatggtgggagtgattgcagagtcacaagggaactttctggggagataaaaatgttttgtatcttgattataaggtagagattacataggtgtatacatttatcatgttacattcactagaatagctaaagttaaaggctgtcagtaccaagatgtggaacaactggagcattgctgttaggggtgtaaaacagtacaaccactttgaaaacagtttgacagtttcttgtaaattacacattcacctgccttttaactcagcagttgcattctcagtaatcaaaagcatgtgtctagaaaaagctttatataagaatgttcatagcagctttacttttgatagcccaaactggaaacaactcaaataacatcactaggcgaatggatttggaatgcaatggaatactatgcagcaattaaaacagttgaactactatgtacacaacaacatcgaaaaaatctcatagacattaagctgaatgaacaaagctggacatgagtacatactatatgattctatttatgtgagattttaggatagatgtatagtgatagaaaacacatcacaggttggggcaggtatgatggggtaactgaaggagaggcataagagaactttctggggagatagcagtgtcctttattttgattggggtggaagctacacagttgtataaatttatcagaagtcatcaacctctatactttaaattggatttttattgtttgtaacttatagctcaataaaactgatttaaaaataccttgttttaattttttaaaaatattttttaaagttgattttaaaattgcatattttaattttttaaaaatagcttaatttaaaaaaaaattttgaagtagcctttcacataacattggctgttttaggtattatgtattgtaaataatacagctttacacatttctaagacaaggatggtatgaatgacactatcctcacctctcaaatggtccaccttaggtgagcatgaccccaggcagttactgtatcttctatccacaggactgctgaaaagctatttgttcagaactcatactggcaacttagatcccttcagtgttcagcttggtttgtatagaacttagttgaaatttagcattgagaattattttggggcttttcaaattcttttcaatggcattttagtccataatttcattaactttattgaaagtgatattatttggccaggaacattagctcactcctgtaatcccagtactttgggaggctgaggcgggtggatcgcaaggtcaagagattgagaccatcctggccaacatggtgaaaccccatctctactaaaaatacaaaaattagctgggcgtggtggcatgtgcctgtagtcccagctactcgggaggctgaggcaggagaatcgcttgaacctgggagctggaggttgtggtgagctgagatcacgccactggactccagcctggcaacagagcaagactctgtctcaaaaaaaaaaaaaaaaaagtgatattatcattctcagcaaactatcgcaaagacaaaaaaaccaaacaccacatgttctcactcataggtgggaactgaacaatgagaacacttggacacaggaaggggagcatcacacactggggcctgttgtggggtggggggaggggggagggatagcattaggagatatacctaatgtaaatgatgagttaatgggcgcagcacaccaacatggcacatgtatacatatgtaacaaagctgcacgttgtgcacatgtaccctagaacttaaagtataataaaatatatatatattaaaaaaagaaagtgatattatttgagtatttatacaattattattgaaagtgatattaattattatttattttatattatttgaagtaatgagctttccttttctttctagcccatttttcagtgaagaattttactttgagattccaagaactttccagtatttgtctttctatgtttatgataagaatgttttacaaagagatctccgtataggtatgtactattcataattatctttaatcacaatgttaatgtttatattcattcgttctcttagtatagttttgaaaattgcagaataatatatgctcaacatctctgatctttttctgtagactacatgttcatttgtgaaatttcatttttaatttgtatgttcagcttatatgacactttctcagggaggcctttgcagctcccctagtcactatgtcatatgtttttataattcctgatggttccctttccatggtactcattatgcttattcattagttggctgtttcatatctaggttctctagttaaatgtgaaatttaaaagggcagggactctttttttgtttttttttttgacacagaatcttgctctatctcccaggctggactgcagtggtgcgatcttggctcactgcaacctctacttcccaggttaagcgatttctcctgtctcagcctcctgagtagctgggattacaggcgtgtgccaccacgcctagccaatttttgtatttttagtagaaacagggtttcaccatgttggccaggctgatcttaaactcctgcaggaaatccacctgcctcggcctcccagagtgttaggattacaggcatgagccaccacgcctggccgggcagggactctttcttacggagcaccttacacttagtaagtgttgggtaagtatttgtttagtggttcaaataatgtttttatagaaagattgcagttttgatccttccaaagaacatctgttgttgaggtttttctaatagaagtaataattcactttaatctatttatacattttcttcctgtctgtattagtgactgtattagtccattctcacactgccataaagacatacctgagactgggtaatttataaagaatataggtttattggctcacagtttttcaggctgtacaggcttctgcttctggaaggcctcaggaaacctacatgagtgaaaggcaaaggggaagcaagcacatcttcacatggctggcaggagagaggagagttgggatgtgctacacacttttacaataaccagatctcatgagaactcactgtcatgagagcagcaaggggatgtctgcccccatgattcagtcaccttatgccaggcccctcctccaacagtgggattacagtttgccatgacattttcgtggggacacagagtcaaaccatatcggtgaccaataaatatatttctctttttttttgagacggagtgtcactctgtcgcccaggctggagttcagtggcgcgatctcagctcactgcaagctccgcctcctgggttcacgccattctcctgccacagcctcccgaatagctgggactacaggctcccaccaccacgcccgactaattttttttgtatttttagtagagacagggtttcaccatgttagccaggatggtctcgatctcctgacctcgtgatctgcccacctcggcctcccaaagtgctgggattacaggcgtcagccactgctcccggccaataaatatatttcttaaataattgtcagactagagtgtgatctgtgggcatgaactagaacagagctaactggccacatatgtgtcacattcctgatctttgcaccactatctttgtattttaatcataggcagaggtctaatttacatttattctctttctttttagtatcctaaatttcatctccctttccttttttatttgaaatatggtcaagtctcctacagcttaaaaaattaagcattatttggccaggtgcagtggctcatgcctgtaatcctagcactttgggaggccgaggtgggcagnnnnnnnnnnnnnnnnnnnnaaaaaaaaaaaaaaaaaaaaaaaaaaaaaataaattaagcgttgtctttgtcctcttaactaacttctgatgtttctctgtgtttgatattgaactccttaacaaatggtctgtgtcagtcctctgcttgctacttatttcttttaaaatctctataatctggcttctatgtttttttgataaacctttcttgaaatttgccaacatcattttaatcaaataacctttaaaacaatatgtttttcttaattataaaactgttatatgttcttagtatttggtagtgattctctacagaaataactacagttaataatttggtgtatttcttccattctttatttcatacatttgtattactacattttattcagattttttccttttcaattaataccatagtgatcctttccccatatcattaatatttgttaaaactatttgttacataatatcctttatagaaaagtgttttattttaaccacatccttgttggtgaacatttacatttccaaattttgggcatcctcagtggtgttgctatgaacaaatgtcctttggcataaatttttgcatgtctctttttccccaggataaattcctagaagtgaaaatactgagtcaaggggtatgaacatttttatgatttcctctgtaaatttctgtattgcccctctgccccacagagtatcatactaatatggacgacataaatgttgtactaatttacatttcctcaaagatgtcatgggcataaccattttaccaccccctggccattcttgcatattatcattgaaaaaaatttgccaatatgataggtgaaaaataacacattattattttaatgtgtgttttctgattttgaaggaatttgaggaatttttcatatgtttattggtatttacatttttcttctgtgaattgattgctcattcctttgcctatttttcttttggttggagttctaacatttatccttaagccttcttatttttagatatgttaacttttgtcagctatatacataccaaatactctgtctcacaaaaggcattttcttagtttttattgttatctgcctctgtgtcacatttcactctcttgattgcttattcggtttgctgaaagtgaaagaaaagacattttcatggtggtgtatttttttagatgtgtttctccctctgatgccttcttatatgcagactcttctgtttgtagcaaaccgttgattatagatcacccttgaagctgtatcctcaattcagtttaacatttaccaaacacttctccgtggcacacaaaggttgggacttttaagatgagtaagactcgttgctcatcagagaggcagacttctagtctaatactaatatattaatactaatatattagggtctgtgctggagatatgaacagaatacttagaatagtagggagaacagctcattttatttggtaggggaataacagagactacataggtaggaaaaagaagaacaatttcttttctttttctttttctcttttttttttttttttttttgagatggagtcttgctctgttgcccaggctggagtgcagtgacatgatctccgttcactgcaacctccacctcctgggttcaagcgattctcctgccttagcctccaagtagctgggattacaggcatgcaacaccacacccagctaatttttgtatttttagtagagacagggtttcaccatgtcagccaggctggtctcgaactcctgacctcgtgatctgcctgccttggcctcccaaagtgctgggattacaggtatgagccaccacgccccaccaggaagaacagtttcaaggtgacagggattggcagaagcagagggggaagaatgaatcatgtttgtggtgtacctgctggaggagggtgatagaagctgaggatataaattgggaccaaactgatgaaccctagaaaccattcttaattccaaaagctaaggaacttggactttattctgtagacagtggttttgaaccttttgagaatgtatgtaactatatataactggagtgtgtgtgtgtgtgtgtgttataatatacatgcatttgtactgctagaaacagaagaatctgcatattgtattatatgatatacagttatatatagttacatacacatatatatatatgcacacacatatatacacatacacttatatacacagatatatatacacacacagttatatacacacgcagatattatatattctaatttaaatatgtaatctatatacatcgagtttgtagtactgttgtaggccataagaagttgttgatttggaatagggagcggttagaggcaggaagaccaacaggtatgctgttttcaaatgaaatgagttagggcagttgcagtggaaatacagatgagggaatgtacttcaggggtttcaaatagggcatagggaccaagatgaacaggagatgtgaaaaggagaagagtttaaaatggtcttgtttgtatggctgtcattaaattagataaagaacacagcaagaacattcacttttgagtgagaaggggagaggatgactttggtttcaaacaagttaaacttagtattaccggggtacatcttagtggacatgttggttgacagttggaaatatagatctgaagcttagagaaaagagctagagatgtagatttgagagttattagcattaagtgataggtgaagcctgtgttggaatgaacgaaattacctgggagtggataaggagggtttcagggaagaagagacttgaagatagataaggcatatcaggaagtagaaagaaagatgggagagattaatgtcagagaagataaggaaaccttttaatgtcagcaactagagaaaggtggagtcagataaggattgatagaggctattggtagttattaataacctttgagagaatgtataacttcggccatcataccttaagaaaaatgtttagtaattttcgtctctttacatgttataatcttaaggtaatatttcttgaaaaggcctttaaggccttttaaatagcagcataaagttgaggtttatgatttccagaagttgcctttgttttttgtttattttgaaagtaaaaatcaactttaggtaaaataatttctagtaaaaatcagttgtttagggagtggtgtcagaaagctgtaactgttggtgtgataactttttcttaaatgtttattctttctaagggataaaatttatacatttaacagaaaattctttttccttttgcatatagagttattattaaacacactacataccctttaaggttggaagtggttgatggttttacttatacatttttaacatttttctagttcagtatcattttcttttgtcattaacacacaggttttttttttttttaattttgagctattggaagttgagttttcttaattataatttggagccactcaattgtagattaaacactgacacagcattttctggaaatgaaatttgagctagaatttagagaatcatcttttaaacttaagatcttagattcagtacaagttgagcatagatagattttaggggttttttatttttaattacatgagtaatgtatggattttttttttgtcattcatttatttcacatttattctcattgtaccaggcaaagagaggaaggagtcatgcaccaacacacacagattgtgctgtttttcagtctttctgatagaatcaggatccagattctaactgtcttctaaatctggatcagtcagtagagatggaccactgtggtggagggcccggggctgctgagagaaaggcaggatacatctgtagaactgaccatggcaggttcatgttccagggctcccatctgggtacctgagcattttccatatagatcacaggtgttggggcccacatcggctcctgaaagtctccgggaatgccataggcgtggggctggtgctcgggaggtgcaaggtcagccacatcagcacagggaggacctgagaagacgctgatcttccatctgtatcccagaatcctgtgcagggcctctccataaggacattgcaaggggtggcaccttggcctctggttggcctcatgaatagtgaagtataagtcctgcaagcttatcagcatctggagacattcctgccagctcttctttatacctctgtgcttgagatgcggggcaactgcttttgatactgtgtgatacttcttcaccccgtacacttcacgctcaagaaattcccattcttgcaggaaactctggacttcctggctactccatggtttaattaactggactgagggcttttctggtccctggactgctttttttctgcttcattttcaggatgtttctggtagtttcagtctgaagtatcactttctccatttttattcctgagttttcttctgggatgattctcactgagtctgcagggcctgttcctgggttggcggaacactggcacttactctgctctaatggaacctaggagagtcagaaggagcctgagtgtggaaatgtgtttgcttctctctgcttcttatgtatggatatttttatttttgtaaaaaaattttaaattatggcatagataatcccattttttttttttttgagacgaagacttgccctgttgtccaggctggagtgcgttggcatgatctcggctcactgcaacctccgcctcctggttttaagcaattctgcctcagcctcctgagtagctgggattacaaatacccacccccacacctggctaatttttatatttttagtagagacgaggtttcgccatttggccaggctggtctcaaactcttatccacctgccttagcctcccaaagtgctggaattgcaggcgtgagccaccgtgcccagcctaaattacttttgaccactgcctcctcccagtcctcttcccagaggtaataattgttattaattcggggcataattgtttatattaggcatctttatatgctaggaactgttagtacaaaatgagagaaaaagaaaaactttaagcatatatttttatttccaatgaggattctaataatattgaaattaaaacataaatgttttacctcctattatgtattttttagttattttgttattcaagagctcaaacaagtaaactatgactatttttctagagctcaaacaagtaaactgactatcttagtagactctggcagttctccccgacccctcactccaccttggttcagaaccatatagaaatgaaaggattttactagaatgtcagagacctgaataccagtcatgactatgtcactatctatctatgtgatcttcattgagtcattttcttaggcctggttcatccataaaataagattgggtttaaaattgctaaggtcttttccaacactttgaattgtaatttctgctgacatttagcttttaagcaaaatttactgtgtataaattgcttatggctacactttggtgtctgtttgcacagggactatatcagttatctactgctatgtaagtactccaatacttactggcttaatacagcaaccgtacatttactcatgatcctattgtttgtcagtttgagctgaacctagctgagtggctcggctggtctcgcctggggctgatgtgcagttatctgggagattggggctggctggtctgattcatatgtctgatggttggtgctgactattagctggaccttcctcaccacatggtctcctgattggttctaagaaggcaagccctaatgcaaaggtgtgtcacatttgctgatgtcccattggtaaaagcaagtcacataatccaagagtcagtgctataggagaccacacaatggtgtagataaccaggagttatggaggccattaatataccagtttaccacaaagaccaaaatatgtctatcgaaacctcgtacactaaggcttcgaagtgctgccattgtctctaaattgctgctgttgactgtttgccaggatttgttcagtcctctggtcctgtttcatttttctatagacagtaatatttgtcactgtttttgtttgtttgtttttttgagatggagtcttgctctgtcgcccaggctggagtgcagtggcgtggcatgatttcatcttactgcaacctctgcctcctgggttcaagcaattctcttgtctcagcctcccgagtagctgggactacaggcgcacactgccacgctcggctaattttttgtattttagtagagatggggtttcaccgtgttgcccaggctagtctcaaactcctgagctcaggcaatccacccacctcagcctcccaaagtgctaggattacacgcgtgagccaccatgcccggcctgtcactgtttttatctcctcttttagccatttctgctagtgctcaagtaggaacaggactatcaggattttcctaattggtgaattgtatcaggctgaaatttctaagaatatattgtatctaaaaatgggtcccaagggtaacacagtatttactgatggcaagaaaatgctgctgaaaaatggtattagaaagctaaaaatgctttttttttatttaaagatcaacaaaggtggtttctgtgcccacagttccttcatttccttttgtgtttcctttctttgtctgattttaaggaactaatacagcatctggtgtgtatatgtttggttttaagctctttctgtctgtgagtttgtcaggacagtgaggaaatgaagtactaactttaaatgatttgttgggacgtttgtttcttgttgactttttttttttaagagttgggggtctcactgtgttgcccaggctggacttgaactcctgggctcaagcagtcctcctgtctcagcttcccaggtacctggaactacaggcatgcaccactgcacccagatgtgtttgattttttttgaagttggtaacttcatagctagtgaaataatgaattaattttgtttaaaatagtaatcaacaactggccacagtggctcatgtctataaccccagcactttgggaggccaaggcagttggactgcttaagctcaaaagttcaagaccagcctcggcaacatggtgaaaacccatctctacaaaaactataaaaagtagccaactgggaccaactgtaaaaattacttctggctacttgggaggctgaaatgggaggatcacctgagcccaggagatcgaggctgcagtgagctgtaatcatgccactacactccatcctgggcagcagagcaagactctgtctcaaaaaaaaaattaaaaaaaatacataaataaaagaaaatagtaaacactaaactaaaacaatctttgggactattagaggcacaaaaagggtttttaagatcattaagttaaaagtcattctaatgcagaggaggcacatcagatgtagagtttgagtaattcacccaagattacacagctaataagtaacagaattgacactaggttatggaattagtgtttgtgttggaaggagcacaaacaggcatgccttggtttcaaaatctggctgcagcacctgttagcggcaagtttaaaaatattgttcagctttcctcatctgtaagatggtgattataccctctacctccaagattgttaggaaaattaaacaagaaaatatataagaatgtctcctacctggtagagactcagtaaatgctggcttttctttcagttcagtgctctttccactgtgtcgggctgcctaccttttactgttaatgcctgccagtttagtgattaaacaacaaatcagaatcgtgaggcttttttttttattctatttgtgtttcagaaacttgttccttctttccccatcctctcttctccctctcccgtacttccttctcatttatccttccaccttttttcctccttcattctttgtctgtcttctcctctccctcttccctgttttattcccttgggctgatgatgtatatttctttttatatgttatattgcctaataaagtgctggacatgttgtaggtatcctgctacctattaacttcaaatatttttcttaattttcctgtgccattcttatatatcattttctctaactttgtggaatcatgtactctttcttctctgtttcttcaggccaactggcctcatgcaactagatctttacatatcagaaactgacatcttaaaaaggagcttaagaataagagctggcaataaaattacagattattctcagctcacaaatgacttgtttatgcagctagtcagagaagggtttccctctcataggacaagaaacattcaactcttcagtgacagtgaatgtcatgatactcatgatgcagaataggaggaagaggctgcttgctttagaatatattacctgtgtgactaagagaggattctcttttgggaaggcacctgtgacagatgagatgtatttccagtgatctgagagtagtgagtcataaataggacaggtaaatttctactctagtttttagcagcattgttagttaaatagagtttggttagggaagcctggaaatcaaatcagcatttacaacacaatgccattgtgattgttgaatgagggaatgaatttgtcaaaccaataaactcctaaataaactttgtaggcaaccctcttttagaatttgggacttgttttagtggtgtttgtatgtattatatgtatgtacatatgtacatctatatacatattcataaattgtgtacaaaactaaaaattatggaaattgtaaagtagaaatttcaccagaagtctactgattcgtttctggatggtaagtaaactctcttaaaattttgtgccagatattatctgtcctttttctggggagaggacataaaagatacacagttacaaagattcttaaagggagggtaatggttctcaaaaggtaagagcttcagctataggatgtatagatatatttctgtatgtacatatatattttttgagtatcaaactgttatgcattgccttaacattttatttatgtctggtgtggaatctgtggtaattaggactacttgatagaattatggtaatcatttgtggtgtgcaatattgaatactttgtcataattttatatcttaagccattcctggtaatatatggatttgccaggaatttgatacaattcatagataaaacatatccagagatttggatgatttgtctcttaacctaaattcttcctgcagtttaaggaacatttgagtattccagttagtacctgaattttatatttggcttttaatctgtgtatttaatactataagaatttctgttttcccatcatttttatcttaaatttaaccaaaaaagaactaaaatacattatttccctagtgtcattttccatgtgatttgaatgaactataaatgctgtatattcacataaagattttgatcttcaattacattttatccaaagtattcaaaagaaagttgggaagatacgtatttgttatcaggaccaatttattttaaaattttatatgttttaacttcatgtattcatagacatataaagatgaactttcaataggcctccttcgattgtatttttttaatacagttaccactcgtatttttttaatacagttacaaactctttaataaaatacagctgtgtactttactattttctttaaaattagatgtatcgattgtctttacagtttgaattccaagacatgaatgagaagcttatcaaaaactgtaatgtggttacattctaaaaataacagttttattgagatgtaattcacataccattaattcacccttttaaggtatacattatatttgcttttcagtggttcagaaaaagaatcattatatacgttagagggagagaaacattataaaagttaacagtaggggaatgtgagtagaaaatatggaaatttttagtgtacggttcttgtaacttttctctgtttgaaattatttcaaaatacatctttttttcttttttccagcactaatggcttgggtgaattaaaatattttttaaattaaaaaaagtgtatggtgtggtgggggccttaatatattcacagagttgtgtaactgtcaccactaattccagagtgaaattttaagcatagtttgtgtttgttttcctgttccttccttttcacttgatatacaaaagttgacgtatcttgacagaaaaatttctttacaattttcttaaagttttcaaatgttgaactaaaagaccaaggtatatcataagtacaaggaaataaagtagaattagggcgtataaaatgaaaattcttacttgacaaaagaaagtgaactgcttttaactttatatatcctttgttgaaacttttgtgtagaatcctggaataaatcattagtcttatgcaaaactgtgtctacttcttaaaacttgaattgaggaaggaaatgctttgtaccaagatggcaaatattttattataagaacatttctgtttcttcctctcatactactatgttcattgtactgtatcttcctctgagagggtttaaactctttagagaactgccttaatttttgtatgtattggagcaacataatcagtgtttgcaatgttttgataaaagtaaattcttaataataaaattgttataatctcccataattttcaagtcagttttcactgttgttaatgatgtatgatattgtttttccttttctcttaattggaatttataaactcttactaaatgcagatacatctgctcaaaacttgtcatttgttcttagggtcaaaaaattgggaagattagtttgcactaccattgtaccttgctttttataatgagtgtactctgggtaaaaacatgaatctgaataagtactaaaaaaatgcagttgcctgtaatacaactgaggttttatctaatcccctgattcaaaatgacccagacaaatgtctgccaaggggcaaggagaaatgagacactttttcattctttagaatgtagaaaaaatgctttataaaaatggatttttatgtcaataggtacaaatcattttaaaatattttctataaagtattatataaaacagtgctaatgagtcttaggattatacgaagcatgttttcttatattgttttacttattttctgtaggaaaagtagccatcaaaaaagaagacttgtgtaatcacagtggcaaagaaacttggttttcattacagcctgttgactccaattcagaggttcaggtaaatattaaggcttatgtaatacaagagattgtcacaggaaatgagtaaaaaatgaactaattaaactggttcatgtaaatagagcatattataccttattttaaattctagcatcaaatattatagacttttgggtaatataggacaggaaggtaatggctttgtcatattgtttcaagaataatgctcatgtatatgcatatgtgtagatttgtggagattagggcatttctttcttaccttctgtttgagtcacaatagcaaattattatttgtctttgaggggaaaagttttaagggaaaatatgtgttttattaactctgactttgggggagaatccctggaagtctgattttgtctgtcttgattctctgtttactctctagtaaactggacttggggaaatgttattcatttaaaccctgcctgagcccactgtgcacagccttcactcccacacccaccctttcctgttgttcacctcgctttttatttgaaagagtatcattactctttaatctttttcttttttccaaaataagagacctttttcagattctgagtaaagatgtgtgtttagccatgtagctgaagtttctatttgtttttagaaaatctgagttgctcttagaaattatttttctaactaaagggaatctttttgctgtagccttatttatttataaaatatggtaaggattgtgaaaccatttcccgagggcataattgcaagcaggattcttcctctctaaaagaagttttaatttgccactgtgactcagaagtttaagacaagaaaaaagtgctacacccacaccacagataatttgcaaataagtgcctgtgtctccatttcctcataatctctcaagcattctctttgattaattattaaattctcaaaaaattaagtacttatgcactaaccccccttcttaactgcaaaatttaacatacttttcctgtttaacctactttgccatgttttaatattcttgtctttccttatgaccatagctattattcagatcccagttgtacagtattgtaaatgatccatgtgagaagcaatgtgaagaagtggaaagtgtttaaattaaaaggcagaaaacttaggtcctagtttttatatgtagttacttaaatgacattgaatttcatttctataaagtgggaataaaagttgctgtgttcgattcatatggttgtgagaattaagtgaaatatctgtaagaatagtttaaaagctgttaatgctatacagatgtaaaatattgtctgtttaccaccagtcagtctggtggctatttccctaatattcctttaccaaaaggcagatatgaaagttttaaagtaccagtttttcttttaatagttttaagaaaaggcatgataggaaaaggctttgaaaatttaaactgaaattttatgaaccattacattttataaaactcataaattttgtgaattttatgtaaatttgctaaacaatttaagagttccagctctcaaaaggtaaaaatctatatagaatatagaattcttgtagatggtactaaagattaatacagagacacaagactttatttgatggtgtgtgtgtgtatatatatgtgtgtgtatatatatatgcatatgtgtatatatgcatatgtgtgtatatatatgcatatatatgtatatatatacacacacattacatacacatgggtatgcatatttatagatatacatatatatgcatatatgcatgtatatatacacatttgagagatatatatctcatctatgaaacatgaaaattggggaagcaacagttacccagatataatatagtcatttaaaaattttgtacaagttattttcatgactgtgagttattaaactttacaactcttttgtcttaaatgatacttacttaataagatttgctcactatttaaaacagattttagaaggaaaagtactttgtggggtggaagagacatataacacttttgggttaatatggtaccattgaaaatgttgttgtcccactgctgataagggaatactaaattatgagtctagaaaagatagaaaatcatcccatggttcatacaaatcctactttgttaataaatttgttcacttccataaactttataaaattttacaaaaataccatgaaacataagagcaattaatagggaaataggtgaaagctatgaaacagattgcgttcaacaggaactcagtctgataattactattagtaattataccagtgtatcctaagcacagtactaagtacttaatgtcatttaactttcaaagtagcattatgaggtaaatagcatcacctgcattttacaaataaggcaaatgaaattcagaggttaaatgtcttctccagagtcacagaactactaagtagtggagccttgattccaaaagagatctgtctgattctaaaactcctaaccacagtgcctttactacctttcaccattctgtactattagtcattaaaaaaaatagattaggagtatcacttaagtaacatctgagtgtaaggaagagaagcctgctcagatttgctcaaagaaaatgggagaggccattggaaagctcctaaagagtttcttggaatgtcatcataggaactttacattgccagtgtgagctagaaagttgtcaggcatttgcagaggagatgcatcttaagtggaggctagattcttagaacaacagacattaaaatttgcctaagttcatctgtaaaatgagtatacaaaatgaaaagttaaaaatttttgcgtaagttacaattatttttgaaaagagtttagtttcttataaaatacactaaggtatttgggtggtttgtttgtttttggttgactaccgcataaaataattggcttgcattctgggccatggtaaatgaaaactatatactgtatctttaaactgtagacctcccccctgccctgactcagtacagcaatagatactgcaagtggcacatggaaactgagacccactaatcatttcttatattcctatgttcactgtgcttattgagcataagttctcactgtttaaatattgttttttttctttccctttcatgaagtgaataatgttttctctcagtctttccctctcattttaataactatttgctttgcaaaatataaaggaaagaaaaaaacaccattttgagatgccattgtattctttttgtatgtatgatgagacatgtctcttcctctgcttctctgtaaatctactccagtctctttttgagacctaaaagacgccacaccaatttttgagtccatgtgaccatacagcttcctcacctccaacatctgactcagttttctgccacaatctagagagaaagtttggctaaacttgggtcagatgtctacttcaatctaatttgatatggttggaggaaaattcactgtaaggcagtccactttagggctttgagtaggcatgttccctaaggaaggggtttgagtagaggaaatgaatggcattgctacctcagagggagagatgcttgtttcctagttctaccactaattagcatttgtgccccaaataatcgcaagcctgttacctgaggatcttcatctatgaaatgataatgtcagcgcaaagggttcccttagttgtgaagttctagggaaataacatgcagaaatgtaatttagctttccagtggaaggatcccagtagtattaagatgggctttatgccaaaacagttgaaaaattgtttagaactataacctcttaccttgaattgtctcccagagataattttttattattgctgatactgttatacttgtcaataatgttaatagttcttttcagtttcatcttcagtagttcaaaatattgttagtaacatttcatgagtgtatttttctactttttttttgtatttagattttggcttgattctaccttttgtaatttttccttctgggctgaaccatttttttcctcaacctattctaatctgctttcagactctgcagtgggtcagagagagagcagaaatggttctttttaccaatgacattgtgtcaataagtctagtggacatttttcagtcctcatcttacttgatctttgagcagcttttgatactggtgaccactccctccattttgaagcattcttttccttagtttctgatcctgtttatggtcctagttatcatctatttcatttggtattctttctcaatattctttgccacatatgtgaagttaatatgggttgtgctggtgccttctataaatcctcttttggcttcagtgaactacagccgtgctattagttattaggtcctgtaactcaccaggaacattaggtatttatcctttctttatttcttaggcacagtgataaaaagcatactttacatatggttgattaaccaggccgggtatggtggcccactgtagtcccagcactttgaaaggttgaggcagacagattgcttgagcccagaagtttgagaccagcttgggcaacatagcaagaccccatctttataggggggggaaaaagagtgattaaaccaaatctcccatatggagaatttgctgctctcattaattaaggagtttgtctcacacaacttgtccaagcagtaaatccagatgtgctatcaaccatgtcctatatgatgcaattacttagttaataggtctttaccaacaagcatatcttgaatttctggatcatgccataagttattgattgttttataggtgttttttttttaaagacctctgccttacctgtttaaaaagacatttaaaaagaaatgcaatgattatagctaataataaatacatgaggatttttaaaacatgccctattcaagacataacaaatgtaaaaacataattcattattgcaggttgattttttttaacttcattttaaatttttatgtgaattaataatgagccattctagatcatattaaatacttctttaaggagaaaacaacaccttcataaagaactgccattaatataagagatattaaataaaatttgtattttgctttttcatctgatgggcgattgtgtccaaaatcatttatagaggtaatttctacgtattaaaacatccatcagaaactccgaagttgggatatttttcacctcatgtacaggcataccttctttcattgtacttcactgtgtcgtgcttcacagatactgcattttttacaaattgcaggtttgtgacaaccctgtgtcaagcaaatctatctgcctcatttttccgacatcatatgctcacctcatttctctatgacagccttttttagcaataacatatttttaaattaaaatatgtatattgttatttaagacatattgcacacttaatagactgcaatatagtataaatgtaacttatatacactagaaaaccaaaaaatttttgtgactttctgtttagatatttgctttattgaagtggtctggacccttagacagtatttccaaggtatgcctgtaaaaacattttttaccagttgaaacatactgagttattttatatggaaatggttgttaaaatttagtgttttgtgataaaaacaaaataaagtttagacttgagaggattttaagtgcatgtattatgttttgctcaaatacctctatattagtccatttttgtgttgctataaaggaacatctaaggctgagtaatttataaaggaaagaggtttattttggcttacagttcttctgcaggctgtacaggaagtatggtgctggcatctgcttctggtgagtgcttcaggaagcttacaatcatggtggaaggtaaacggggagcaggcatattacatgatgagagagggagcaagagacagaaggcagaagtcccagactcttaaacaactagatctcacatgaactaactaagcaagacgcacttatcaccaagggggtggcactcagccattcatgagggatctacccccatgatctgacacctcccactaggccccacctccaacactggggatcacatttcatcatgagatttggagggacaaacattcaagccatatcaacctctgttcatcttattttcccaaactgtatgcagaaatttacacagtatcttctatatggtaccaagaatgtatgtaatacacaattgaaataatcacagatatttttgtgtgaaatttttgtaaaattaattgaaataaagttagcgtataaaatactaaatcttcaaatagtacctgtattagcccattttcacgctgctgataaagacatatccaagactggaaagaaaaagaggtttaattggacttatagttccacatgactggggaggcgtcagaatcatggcaggaggtgaaaggcacttcttacatggcagtggcaaaagaaaatgagagagaagcaaaagcggaaacccctgataaacccatcagatcttgtgagacttattcactattacgagaatagcacaggaaagactggcccccatgattcaatgacctccccccgggttcctcccacaacacatgggaattctgggagatacaattcaagttgacatttggtggggacacagccaaaccatatcagtacgagagtagtgtaagttcctcagaatgccccttaatataagataatgtgatattataactgcatgtatcagcctaacatagtcagtgctatggaagtcatatagagcaataccttccaagaatttggtttattttttattaaagacgtataatacagtgcaaggtatctgatcttccaacattttctgacatacatgaaaagtatactgtcattgagcttcctttaggagattgaataataagaatgcagttgtagaccaaatcacattacatgtttattatcaaacatagtaccttgttagattcttttttttttttttttttgagatggagttctgctggagtgcaatggtgtgatctcagttcaccacaacctctgcctcctgggttcaagtgattctcctgcctcagcctcccgaatagctgggattacaggcatgcgctgccacacccggctaattttgtatttttagtagagacggggtttctccgtgttggtcaggctggtctcaaactgctgacctcaggtgatctgcctgccttggcctcccaaagtgctgggattacaggcatgagccactgcgcccagcctccttgttggattcttaatgttacttcttcgtaggttctttatttttcttatttgtccctaggagttcttgaatctgtggcttgtcttctatcagttttggaaaattccaggcaattatcttatctcctttttttttctgccctgttctttttttctcttctctgctgtgactccagttacatgaataataggccatttcaccatgtctcatatgtctcctatgctttttccctctctgtgcttcattgtggatattttctactgacctgtctcccatttcaccagtcctcttttcagctgtggctactctgctactaaatacattttcattttggtttattgcttagttctaacttttttatttcattcattttatagtttccaggtatctgctggatttttcattttgttttatgtcttttaaaaaatagctattttaggctggatgcagtggctcacacctgtaatcccagcactttgggaggccaaggcgggaaaattacttgaggtcagaagttcaagaccagcctggccaacatggtgaaaccgtgtctctactaaaaatacaaaaattagccgggcgtggtggcacatgcctgtagtcccagctactcgggaggctgaggcaggagaatcgcttgaacccgggaggcagaggttgcagtgagctgagatcacgccactgcactctggcctgcgtgacagagctagactctgtctcaaagaaaaaaaaagcaattttaaattctgtcaattccaatatctgcgtctcttgtaagtccactgctttcctcattttttctcttggtttttgatcttctggcatattctgtaatttttaatggaatgctggagaataaaatataaaatatattggagataatttgagggcctgaatggtatatttcctctagagaagaagtatgattccctgccagcaactgctgtttctatcttgttggccagaactacatcatatggctatccctgatctcaagggaggctacagaatgtcagtttgctgggctcataactgccccatcaaaaaacaaaacacacacacacacacacacacacacacacaaacttgttttgctgcaattcaaatctattaaatgattacagatataagtaaaactgaacttttgtgtgaaaagagactaaaaagtattctaaaatgttcactgatttgagtttctaaaactgaaaagcagttttaaataatttaaaactttatttttctttactaagaacaacacagtagtagtaaaaactttgaaaattaaattggtagtatatacttttaaaatctgaaaattaaattggtagtatgaacttttaaaatctagagcaaaaaagcaaagaaaatcttctgaaatttcaccaaccaaaggtgtcttctatcaacattttggtagatgatcttgtaattttatacatatatgttttttatttttataagttaacattatagtatgtaccctattttgtgatttatttcttttgctaaggatagtatgtatttccttgttaaagtatataatgagttagtgttttacagtttagaaattataatttccttaatttaactcataatgccttttaatttagtgttccaccctaacagtatgtgttttgtgtctgcctgttctgtcctcacacttttcttgacctggttaatatataattgtgttattgttgattaatacctaaggaatgttttatttaccagtcagtgggagtaatgaacatattaggtaggctctgactcaataataatgatttctggcagaatctcattaaatatccttttgacttgctataatactatgattttagttgtaaacaaaatgattatctttttctactctattgtcatagtttttatttcttagaactggaatagatcccagacatttcctgagagacagttgtgttagcatacgatttctgtaataaaatgtatatatgttaaaattgtaaaactgcaaatttttgtgccgttggcttggctcccttgctagccaagtaatacatacatgctgtcacaacagaaaatatgatttcaaaattctagttgagtaatattacaaattacagatcatggaccttcaagatcacccttgaatagtagagattgtaaatactaaatgcaggaataatgaaagacctagtttacaaattatatatgattttatgaatatttgtgcctagatttttagtggaagatttgcttaatttagttccagctccacgtaactgctattaatttttctaccacagatgtgtttgctcctttagaccttagctttctcaggcagacttctgttttaagatccatcagtattttttgctcatctcttactattcatctaaccctgagctttgtacctggtggacctcagattcattcttgtataagtccccttaaaatagtgagggtgtttcaggttaggtttctgtgaaagaatttttgaaaagggttgttctaaagaggaacagtgactagataatgaactttcctacctctaatgaaatcactcacgtcatcagtccctagacatcactcccctgaaatctccacatggcaatgtgagaatttgtcttgtcagctggagggaggtaatccagtactgtttcttaaccagtttagaattgttagcgcagaattgctcatcaccagcggcaggttagaaatatcaagctctagattatattgttcctaagcctttatttcttgagaagttgattgtttgaattcttttgaacttacactacttaatttttaaaaattcgtctattaatatctctttaagaaagtactcctttattttcagtgtcccatctttccatcaagactcttggccatatgttatcttttgtttattgtcttcccaactagattgtacgctgcttgtaagcagtgacttacatctttaacatctatggattcctacccactcccacagtgccttctgaaacatagtagacattccataaatctttattgtttgatcaaagtaagtagtgacaaattgagttttattggctgtaacttagtttttagttgttttagaattgtatgatttctctgtcttttaatgagactgcttctgtccttaatgctggtttatcttctggaaaaagcatcctacattttataatttggttttatctcaaaatttccttaaatttaggtattgtctttccttttagtctgtgataattagatatataaatatttattgaattggacataaaattcttaaatttgaataccatgtttgacataagtatttgtttcatatctttcagaactttgatctctggttttggttattattcatttaacaagtacttagtgtaggcaaagccatgtgctagtggtcagtggataaatactgtggtgatttgaaaaggcacatacctttaatattttgtcagtaaaatagactactcagtttgtaatctttttgtcattatagggtaaagttcaccttgaattaaaactgaatgaactgataacggagaatggaactgtatgccagcagcttgttgtacagtaagcattttttttaaccaaaatcaactagaaataattctccattttgtattctttcgattttaagccaactccttgttttaacttcagaaacttttttcaaaaatgaaattctgctatgtcattccttttgtgaagttgattttcaatttaattttctcatagtctactcaggttatggtgagtcattaatttattcaactaatatttattgaatatgggttaaatgatatatatgggcattaaggataagggtgtctaactctctggcagtggagaattggaaaggcttcccaaagaaggtcctctagaaattgtcataccacagagcagagctttagagactttggagctagaactaatgcccactcagagatgaccagtattgattcccacctactttgaattcctttttacctcttccaccctcaagtcattttttaccacccagactctaatctcctggctgttctggaaatctgttgtagcccaatcccctactcttttcctcccctccaaacccttactctgtgatatcaatagactgccagataaccttcacttcttctgggtgttttcctctatttttgcattagttgacatctgaatatcccacaaagtacagcagtttcacagccttctcagttagaggctttgtttttctatcatgtccacatattgtaaggtcagggagtagagtagatattactctcctattgctgctccagactgtaacttattctcatcaattgtgaaccccagctcctttgaggtattctatctgtatataaatatgtctgtttgctactatatataatatttatttcattaattttttctgacctctttgaaagaagattgcatatgtatgactcttaatatatcagtatgtatttcctaagaataaggaatattatcttaaataactccagtacagttaccaaattcaggaagtttaacattgttacaatactttttaaaaatctatagttattttctaatattttaatctgcagttattatattccacttttgttaactgtcccaatgatgtctattaaggcgtttttttccttctaagaaaggatctgctccaagattatgttttatgtttagttgacatgtctctttaatctcctttaacatggaatagttttttgcttttctttgattgtattaacattttttaagaatataaaccagtttttttttttttaatgtttctcaatttggatttacctactaaaaatagttcaagatctgtttgcagctttttctccacagactgactctgtagaccaactgagagcatatggtgaaagtatctggattaggtcttccactcctccctcccctgcttcagtttaattataatagtcatttgaaatatagttagtttggttggtttggtttgtttgcattcaatttaagggtttttttgtgccccttccccccaatttaagttttttcccccatccttctaggcttaattttatttttgaatagaatatttgcatgatttcaaaaatcaaaactataacaaaaggcgttactcagagatgtgtgtagttcagttccctctccccacacccagctccaagcaaccatgatctgatttctgtccctacagtttttgccttttccaaagtgttatttgaacaaaagtatatgatatgtcttttttgtgtctgctgtctttcacttagcataatgcttttgagattcatccacactgtacgtatatcatttcctttttggtgtgttatttgtttcttgccataatttggtagatactgttatcctcattttgcagatgacaaaactgatgcccatattggttaaataagcctaatttcacacaggaagtgttggaggctggcagtttgatttttttcccccaactttaaaattttgaaataattacagatttacagaaagttgtaaggatagtacagagaggtcctgtgtacccttcattctttttccctcagtgggtacatcttgcatgactatagcacaataccaaaaccaggaaatttacattggcataatgtatgtatatagttatagatcattttatcatgtgtgttgatttgtgtaactaccaccaccaagatacgaaactcttctgtcaccataaagatatctctcatcccatagctttatagtcataaccactcctctcttctaacccttggcaacctctaatctgtctttatatctataattttgtcatttcaagaatgttatgtgaatggaatcttataatatgtgaccttttgagattggctttttttactcagatctatctgaatgactgtgtgtagttttttgtagacagaatatagttgggtcacttttttaaaaaaatcatttttgccaatctctgtctttttttggtgagttttttccatttatttttaatgtaattattgaatattaggcttaaatatgccattttttgtttgttttctgtttgtctcctattttatagttttctgttttctttttcctgtgggttacttgaacactttttagaattccattttgatttatttatattgtgtttttaaaaaatctatggtctctttgtatagatttttttttagtggttgctctaggtattacattatacatgcataactaatcataatgtactgatgtcaacattttaccaattagaataaaatgtatgtactttacctttctttaaatccctttaccctcccccatttgtaatatactttgtcttaaatattttgtctacatatattgagaaccacatcaaacaatgttataatttttgcttcagccatctaacacagttgaaaagagttagaggaaaaggaaagtgtaagtctgttgtctctacccacatttttgccctttccatgttatttttttcctttctgatgtttcacgattccttctgtgattaagtgtatagagtttcctcttaacattcttttagagtaagtctcttggtgatacattctcttggttttccttcatctcagaaggtcttgatttcctcttcatttgtaaaagataattatactagatatagaattctgagtggacagttcttttctttccacatttgaaaatgtaccacttccttgtgtcctcgatggtttctgatgtgaagttcattgtcattcaaattgtttttccctataggtaacacaccgtttttctctggcttcttttaaggttgttctttgcctttagatttcttttcttttttctttctttctttcttttttctttttttttttttttttgatatggagtctagttctgtcactcaggctggagtgcattggtgtgatctcagctcactgcaacctctgcctcccggattcaagcgattttcatgcctcagcctcctaagtagctggaattacaggcatgcaccaccatgcccagctaatttttacatttttagtagaaacagggtttcgccatattggccaggctgctctcgaactcctggcctgaagtgatccttctgccttggcctcccaaagtcctggggttataggtgtaagccaccacgcccagcctgcctttagatttctatatgttttagcttgattgtgatgtatcctggaatagatttatttaatttatcctgtttggggttcgctcagcttcttgactatgtatatttatgtcttttgccagatttggggaattttcaaccattatttcttctattaattctttatcacctctgctatctttctcttcttctttcagaacgccagtggcacaaatgttaggtcttttttttacagtcccagaggtccccctgaggctttgtcctttgcttttccccccagtctattttccctctgttgttcaaattgggtgatttctattgttatgtcttcaagttcactgattctttcctctgtcttcttcattcttctgtttagcttatctgttgagttttttattttggttatttatatttttaagttctaaaatttatatttgattcttctttataacttttttcctttggtgagagtttcttttgcagagactttcttgtttttttgtttcaaacatattcataattgttcattgcattattcacaatagcaaagacatggaatcaacttaaatggccatcaatcgcagactggataaagaaaatgcagtacatacatgccatggaatactagccgtaaaaaagaaagagatcatatcctttgcaggaacataggcggagctgaaggccattatccttagcagactaacgcagaaacagaaaatgaaaccaaatactgcacgtgctcacttatagtgggagctaaatgatgagaatgcatggacacatagagaagaacaacagacgttagggcctaccagagggtggagagtaggaggagggagaggatcaggaacaataactaatgggtgctagccttaatacctaagtgacaaaataatctgtacaacaaacccttgtgacacaagtttgcctatataacagacctgcacatgtacccctgaacttaagttaaaaaaaaattgctcattgaattatttttatgatggctgctttcagatccatgtcacataatcataacaatcatgtcatcttggtgttagtgtcttgtgttagtccattctcacattgctataaagaaatacctgagactgggtaatttataaagaagtttaattcactcatggttctgcaggctgtacaggaagcatggcagcatctgcttctggggaggcctcaggaagcttccaatcataacaaacaccaagcgggagcaggtgtcctacatggcaggagcaggaacaggagagagagtggggaggtactacatacttttttttttttttttttttttgagatggagtctcactctgtcgaccaggctggggtgcagtgacatgacctccacctcctgggttcaagtgattctcctgcctcagcctccgagtagctgggattacaggtgtgcaccaccagacctggctaatttttgtatttttagtagagttggggtttcatcatgttggtcaggctggtctcgaactcttgacctcgtgatgtgcccacctcagcctcccaaagtgctgggattacaggcatgagccaccaagcctggccctcttttagttatttttaaatgtataataaattattgttgtctgtagtcaccttcttatgctgttaaatacgagatcttatccattatatctaactatatttttgtaccctcacttcccgtcccagcccctggaaaactttgttctactctctgttatcatgagttcaattgtttgagtttttagctcccacaagtgagaccatacgaggtttgtctttctgtgcctggtttatttcacttaacgtaatgatctccagttccatccctgttattttgaatgacaggacctgattcttttttgtgactgaaaagtactccattatgtatatataccacattttctttatcagttcgcctgttgatggacacttagattgcttccaattcttgactattgtgaatagtgccacagtaaccatgagagcgcagatacctcttcaatatactgattccctttctttagtgggattgctggatcatgtggtagctctatttttagttttttgaggaacctccaaactgttctccatagtggttttattaatttacattgccaccagcagtgtacaagggttcccttttctccatatcctcaccaatatttgttacgcatgtcttttggataaaagccattttaactggagaaaaattataatttcattgtagttttgatttacacttctctgatgatcagtgatgttgagcaccttttcataaatttgtttgccatttgtatgtcttcttttgagaaatatttattcagatcttttgctcatttttaaatcagattattatattcttttcccgtagagttgtttgacctccttacatattctggttattaatccgttctcagatggttagttagcaaatattctcccattctgtgggttgtctcttcactttgttgatccttcctttgttgtgtagaagctttttaacttggtgtgatcccatttgtctattttcgctttggttgcctgtgcttgtgtgcttgtggcaaccattatgcaagaaatctttgtctagtccaatgtcctggagagtttcccaatgttttcttgtagtaatttcatagtctgtggtctagatttaagcctttaatccatttttatttgatttttttaatatggtgagagatacgggtttagtttcattcttctgcatatggatatctatttttcccagcaccatttattgaagaaactgtcctttccccagtgtatgttcttggcacctttattaaaaatgagttcactgtagatgtacggatttgtttctaggttctctgtaatgatctgttggtctatgtgtctgtttttatgccagtacaatgctgttttgattattatagctctgtagtataatttgaaatcagataattgtgattcttccagttttgttctttttgctcaggatagctttggttattctgggtcttttgtggtttcatataaattttgggattttttttttctatttctgtgaagaatgacattggtatttcagtagggattgcattgaatctgtagattgctttaggtagtatggacattttaacaacattgattcttccagtccatgaacttggaatatctttccatttttgagtgtcctcttcaatttcctgcatcagtgttttacagttttcattatagatgtctttcacttctgtggttaattcctagctattttgttttatttgtagctattgtgtaagcagtattactttcttgatttatttttcaaattgttcactgttggcatacagaaaccccactgatttttgttgtgttaattttgaatcctgccactttactaaatttgtttatcagttctaatagttttttggtggagtctttaggttttttccaaataagatcatatcatctgtgaacaaggatgattttacttctttctttccagtttggatgcctttatttctatctcttgtctgattgctctagctaggacttgaataacagtggtgaaagtgggcatccttgtcatgttccagatcttagagaaaagactttcagttgttccccattcagtatgatactagctatggatatgtactatatggcttttattgtgttgaggtttgatccttctgtacctattttttgagggttttattattatgaaggactgttgaattttgtcaaatactttttggcatcagttgaaatgatcatatggttcttgcccttcattctgttgatatgatgtgtcacactgattaatttgcacatattgaaccatccttgcatccctgagacaaatcccacttggtcatgatgaatgatctttttaacgtgttgtcgaattgggtttgctcatattttgttgaagatttttgcatcaaggttcatcagggatattggcctatagttttctttttttgatgtatctctctctggtttggtatcagggtaacactggcctcataggatgaatttggaagtgttcccctctctattttttggactagctgagtaggattggtattagttcttcttgaaatatttggtagaattcagcagtgaagccatcaggtcccaggcttttctttgctgcaagactttttactgtggcttcaatttcattacttgttattggtctcttcaggttttggattttttcatggttcaatcttggtaggttgtatatgtccaggaatttatccatttcttctaggtttttccatttattctttttttcaaagtttcttaagcttttgctctccatactcactgtcttgtagcagcagagttccagtggtagctttatggaatttattgttgatttctcatccttatagatattctgaaattcatgacattctctgttttttagtattgctaaaggcatggtttcacatatggctttctttgtgcttcttgctggactttggttttgggggagtaatgtatgggaagattcatatcctagtagttactattatcctccagacctagaaagtccccactacaacattttttgaactttagtgagacctccctgccatccattgatcttcactgtgttcctgttttcacttctttctacatctttttccgtgacctattgctgtagtcattttctcgcaggttccgtaaactcccctattgttctcatcattcttatttatctggaaaaactctaattgaaaatgacctcttcctctgtgttcaatctgcacatgaatatagctggagaaaatcatgtaggctgatttcactttaaatttatcatcacaggcctcacatgggcacttatatctgccctggaatttaactgtgcttctctaatacagctataagattctctaccaccacagcctggaaattgcttacatcttcctgaatccaaatctataaacctaatttgcatccataattttgtccttagagcagaggaggtactccttttcttgacattgaattcttccatctgagctctggattccatttatttcctctacttaatgagttttgctccttcagttatgccttctttttcttgttttgtcagctttaccttctctcctacatggttctcaccacaaataaacatggtctagtatctctgtcctaaaaggcatgcctccccagacctcatctctgcccacccataccccagtcctttttatcattcccattcctctgctctcctttgaaggcagacttctctagggaaaaatagtggtaggagtgtgtatgagtgtgtgtgtgcgtgtgtgtgtgtgtgtgtgtgtgtgtgtgtttgcaattctccagtcagcactctccagtagatttttctgtgatgtggaaaatgctttgtatcttcactgtccaaaacagtagccactagccatgtgtggatattgaaaacttgaaatacagctaatgtgaccaaagagctgaagtttaattttatttaattttaattaaatgtaaaaaaccacacatggctaatgactacagcattagtgcagcttcagtaaaagaacctggactcctttttagcagtagcttatttcaggacttgggcagggaaaatatgagatgagtctggagcatcttggggtctcaaaaagtaagaaagtgctaaaaaataatggggatatgtaaaaaggacattgaagccaatgtaaagggacttcaaattaccaaatctggaacaatttgagcttcagaataaataataatagtggattaaaacttatagaataaaataaatataagcaaatactggtacaaataaacaattaaaaactcaaatacttggtagggagaaaggactgatttttcctatagtagaattctagttaatgaatgtaggaggaatgatggaaatgaaaatcaacattggcaaacatcacaataataagtgggtgaggggacaattcaaaaaatcatctatggatgctaagtgagcataagtgtggtgacaagatgtctgatagatgccaccttaattgagtgatcaaagttaacatcaccaataatgagacatccagtacttcccaataggatgcattgagaaggacaccaagatacataacctcaacctaatcatgagtaaacatcagacaaactcagattaaggaatacactacaaaataactggccaatactggcaagatcacggggcaaagaaggaaaactaatgaactgtctcaggatggagaggaataagaagacatgacaactaaatgcactatgggatcctgtattgtgtcctagatcaaaaaaggacattggtgaaatttgagtaagggctacagatttcagtaattctgctgtggttctacaaaacgttaacatttgttgatgagtatacagaaactattattttaacagcttttttgaatatctgaaattatttcaaaataaggtttttaaaattgcctgtaccttgtgcattcaacccaggtctgttttctgagtttcagattaatatgtctactttgatgaatcacattgcaaacttaacacatttaaaactgaagtacagggaggctgaggcaggagaatggcgtaaaaccgggaggcggagcttgcggggagccgagattgcgccactgcactccagcctgggcgacagagtgagactctgtctcaaaaactgaagtactgattctcatgtctatccaactcctcccccaaagtcttagcaaatgtttaattccgctcagtatgtttttcatctctagatttttccatttttattgtcttctgtgtctggatggatcatatggaatataattataacttttaaatgtctttgtctgctagttctgtcttctttgtcatttctgattctgtttctattgatttttcttttcattatggatcataatttcttagttccttgcattcctggttattttctgttgcatgccagacattgtgaagttgctggatattttaatatttctatgaatgtacttgagctttgttcggcacttggttaagttacttagaaacagtttgatccttttgtggtttacttttaacttttgttaaacagacaagcacagtctttactggagggcttatgttttcctactattaaggcagtacccatgaattaccaggttttctactgtggctgatggtacctcttgctagccatgtgtgggttttaggaactattgcctctattcttttcaaatggttctttccccagcctcagatgatttcctcatatatacacgtatcaatactcagctgaatactcagtggggattcttgtagctccctggaggtttttctttctctgtgcaactttcttccctttagtactctgccctggggtccctagtcactttgacctcctcctgctgacagctttgcctcttcttctcagagaaaccatttagctgtaagctggggcagttggagggctcacctgtccttcactgctgattttgttcaattcgttttgggtggagagtaaatctagttcctgttactccatcttacctggatgtagaagttaaaattttcttttagtttaaaaaaaaatccaaagaaaagaatcagatcagtcttattctgaactgtttataatattttcttacctttgtaaattttagatactatattgtaaatgctttatatgtcacatataaataaaatatcaaattccttattgaggttattttcaacatttgttttctgcccatccatgatttatgatatgaaattgcttacttacagattggaagaacagtgctatgctaggtaattagaaaaataatatttccaaatatatgtaatgaataacctatatttaataatattacttaagttttgcagaaaactcaatttttaactgttttatatttaaaaattaagagtactgatgatttctgtagggtgcacttctggtttatgggcatccgtgttttggtttgtgggtattcttatcgtttcataagttttttataagtcagtactgcattttcctctgcttttttttatacctcataaaatagaaaattggatttctgtcattaaggtttctcataattggtgtttatgtgagataaatgtggtattacaaggacagtaatattgtatttgggggcacagtgggaatgtagaagggcactggacttcagtaacaaaattaaaaagtagaagttgagtcttggccagcttcttacaagttacgctacctctttgagccttaccttgtaacttcctcacataacctgtgagccttacttcttttaaatggcataattctcttctcaaaggcagttgtgagaattaggtgcattttgtgaaagtgcatagtaaactgcaaatgccgtgtcagatatcattttgaggtttagcctgagaagggtaagttttaagcagtatgtacagtgggaaaatctgactgtacctcaacccaacattaaaacccagaattatcttggcttgtgttttctttggctagtttcaaaatttctttctttatttttttatgctcagctataatagaaatgagtcgtattatcatttctgtctttactctgcagtataccaatagcacttcactcacatctgtgacctgtgggttgtggagagaaataaggatgtactcaacagcttgcatctttcaacaaagaatacttttcagcaacactcatgagtttctcttaggcattagaaaatgcagacccttagacattaaactaaactcataaactcagtaatatttagtgagaaaattggaggaacaaatcactaaagttagattctgtgttctctgtaaatgccaacaactgtgagccatggagtagattagatgaccttggtttttatggtctaaaacattttctacagaatggtgcttactgaggagctgtttactgagaattggaataaaaggctgcagaattgtgtgaagcttgccctatatttatgaatcagatttttaagtggaagctgcagttgtttccttgtttgtcattcatgctttagcagaggatatgatgccatagagctggcttggtttgtagcttctcatttagggtttgcaccactttcttttcctttttagaggccacagcagttttgatgtattatcaaaccgcaaaatgtaccttgttgggtatttagcagaaggaaatgtgttgactattacacatcccttatctacagtgcttgagactgttttgaatttcttattcttatttttttttttgagtatttgcattatatatacttgcccattaagcatcccaaatccaaaaagcccaaatttgaaatgctgcagtgagcatttccttggagcatcatgtcagtgctcagaaagttttgaattttggaggactttggatttttgaatttggaatgctcagtctgtgtttgatagtttcattagtgattgtggcattcctgtttagtctcattttgaaaatacagcataaatttaaaaatgcatacatacatatgtccatacatattactacctattccatataggtagtatatagccatacaactgcagacacatggaaaacaattcttaaccttttgaatgtattagtttgtgtttaaagataatgttttatcttgtttaactggaatctaatatgttaaatctcttttattctaccttagcatcaaggcatgccatgggttgcctctcataaatggccaaagctgtgacccttatgcaacagtttctctagtgggcccttctaggtaatatttattgaattattattaggttttaaagttttgatgtttgatttaaaaatttaaaaagtaagattctacgagcaaatgataaatagctatttataacacacagtaataaatgctttgaaagaaaaatctttagtgagttctattatacacttgtcaataacaaagccctctttttacagacagaaattggtaccccattttaaatctgccatgctcttaggctttaaggaacaacttcagttttatactagtacaatgtagtactttaaaacataaacttgacttttcatgcatcagcattcctacttttcaaatatcctgaattttatgcatgtaaaatcctgttttaatgaatgccagttcagaataacaagacaatttatatatttttatctggaaggcagctcaggactgaaaattgccttttctactcatgaaatctgtcctctacagagagaattccaactgtagaaaaactgctgaagtactagagcatggcaaagtgtaccatatcattgatttaaatgatttataataatttgtgaaaaaacctatagcactttgtaatacggtgtgttatatgacttcattatgatttctttaaggaactgacacatctgaaatatgtctacaacttgaaggtttagaatcaggaagcaagaaacacagtattccctctacacacacatacatgcatacatacacaccccttttccccatccccagaatctctagttattcttactttgtagaaaatcactactaagtcactttgaaaaatgtatttatgtatgtatgtaaagtacctagtaccatgccggtatttattaggtgctcaaacaatagtatgctattagcagatactcagtcgtatgacattaaatgctattagagagatttatttttgtgtgttaaaaatgttcaatctagtggagctatttttgttttttttaataatctctacctgacaaattatttggtaacatacagttagagacaatttggcatatgaatttgtgttttaaaaagtctggccaggcgcaggtggctcacgcctgtaatcccagcactttgggaggccgaggcgggtggattacctgaggtcaggagttcgagatcagcctgaccaacaaggagaaaccccgtctctactaaaaatacagaattagctgggtgtggtggctcatgcctgtaatcccagctactcgggaggctgaggcaggagaatcgcttgaaccctgaggcgaaggttatggtgaaccgagattgtgccattgcactccatccagcctgggcaacgagcaaaactccatctcaaaaaactaaaaaataaaaagtcactgttggttttgctattgtactgtagttgtgtaagatgttaacactgggagaggctgggtaaaaacacaagatttccttatgcgttttttgtgacctcctctgaatctataattaaattaaaagatttttttaagaagtctctattatacctgaagcccaagaagtaagctgagttaagaatgtttttcaagttccttgggtatttttcaacatagatgaaggtgctctaaatcttattgtcttccttctatttattctgagttgcttatagaatagaatgtgtttttaaaacccctgaaaaaggttggcaatctagtgtgtccgtagagagaataatacaatcttggcacataggggatgcctaaagcttatatattctttgatttgagtttataaggacagttacttttttccaagcaatatttaaaactgaatcttccctgagtcaccttaacttttaaatggaggtcaggctccctggttggaaatagcatgttttataattgtgtactgttaagttctacaaggtaaaactctaccacattggaacaggaatgaccaaaagaagacaaaagtaaagaagaaaacaagcaatccgcagtttaatgaaatcttttattttgaggtaattttttgttttacgtaaatgttaacattaaatatgtaatatttaatgctagttgatttcttttttcaaaccacagtcatagtaatcattttatcaattaatgcagataagcatttctctcctgaaagcagtagaaccatggtgtgatgcaatggatgcccaatatataaaatgaataaaggcagagctctaatttgggagcaggaagggccagggccatacccactccccagtcatcctcactattcatgcccttcctttgcaccctcccttaccctacccagctccctacctaacacatagtggccacaggattcttctgcagggtaccctttgacagtcactagtgaagtaagtgtaattatcactcaagaaatctgagttccagtcaagttgactgaaagagtcactaaatgtgactcaagtttcttatcctgtgaaagaataatcggaagggaaactagcagcactacctgactcagagtttttgtaagacccaaagcatgtgagaatcctttgagaccataaaatactttatgattacagctttattattacttttttttttaagcctaattcattctgtggacgcctgcttatcttcatagacagcttcagctgccttgaagttgtcccaaatacagtttggacaaaagctttggagtgcttttctttggagcatttgttaaagaaatcctttttcatattatttgcaaactacagaaaaaaaaaatcaaactctcaaaaagattgtattctaataaagcatgttgcagttcatatcaacgtgtagggaaggtttgaaaaaaggagttacattttgtgccttttcttctgtgtgtatttttcttggtatttcacagtggagagaataacggtacctctagtcatgcctgattgctgtactttaataaaggaacacaggccgaagaaaatgccaaaagtgaagcaggaagaattgtggagggggaagcaagggagaaaaaaaaaacaaaagaaaaagtaccaatgtgagacttttccatttcctggctaaggacttggtgcagttgttctacgtttattaatggcggttgcatctaacctggagaaaacaaagaaggcagcaatgtaaagggccgctgactaaaggcactcacactccccattagcccacataccttaaacctcagctggatggaatctactctgcttcatggatccttacagtcagcagatgaccttttaaaagtagaaggcctgacctgcctgctgtagcaggagtacttgttaggccttgcaacattcattcagagggcctttagttggttataaagatagatacatttccatctctgtcctttaactgaagcaaggaacacaaagcagacatatgtatgcatatacacaacagtaaaatgcagtagatattggggaggtcagatgaactctgctccattaaaggcttgaagaaatattggattttctaagattgaggaaagagagtattagagatgacgaacattttgagcagaggcacagagacagaaaagcagaaagttatgtccaaagtacagtgagtactgattttactgggcttgtgtaaggaaataatggaaactaagattagaaaggtagagtaagaccagctgatgaaaggccttgagtgcctagttatggtgcttaagtaaatgattttgagcctataagttatgagtaaaacagtgtttgggaaggaattaactatgatctgaggtccaggtggcttagggagaaagaacaaagctggggagactgttgtactttaggtgtaagaaaaatggggaggggatggggtatctttcaagagagtgctatggaaatagagaggaagaggcagataaaagagagaatgcaaagggcaaggtaacaaattggttatagaaaaaaagagaaaggaagtagttgaatgctgcccccaaggttccaaatctggaaaaatagaagagtagggaagaaggaaaataaaagtggcttagtttggagcataattagcttgagggctgacattttaaatcctccagtagggagtttatgactgaaacttaatatgagtgatagttattgaccaacactcaaggtttgtttatataaacagccaagaaagccaagagaatagaggtatacaatacaggagaaaagtgaagaaactaatttctgcgactcaagtatttaactttcagcatgtcatttaatttctgtacttcagcttcctcatttttaagtgagggtaataaatctagccctgtccgcctctgagcagcgttctgatgaacaaaggagataatgcatgtgaaagcactttgtagattgtacagcactgtgcagctccaagttgtttttagtgcaaaataaaacataaaattttgaagaataatttatctatagattctgaaaaagaaacaaagacagcagcataaggttgccaaggtagtgcccaggtaaattctatagagtgtttctgggaaaggagatacagttgtatgatcactaaattaaataggagatcaagggaggtaagaactgagaatttatcgtcagatgtggtgatgaagagagattttaggagagtgatctgtgaggaagccaagattataaggagttactatagtgagtgggtggtgaggaagtacaagctgtaaggatggattgcagttttcagatttgtctaagaaaggaaagagataggaagaccataatttaaggggagaatttttcttagacttgagtgagatgaacaagctggtattattttgattttttttttacactaccttattcttttctgctacttccatagttgcttttatattcagctattgagtaaaatattacttggacattttcctctgcttttatccacaattgaatattttgcagatgatcatttttaagctgtaggaaaaatgtatttttttaaaaaaaatttttactaaaatattttgtttacaggtaaccagatccagtagttacaccagaaagtcccagttccaggtagaagaggaggacattgaaaagctagaaatcaggtatgtgccttggggttttacagaattgcttttttgtataccaaaagaaaatcctagattcaaccaaaaaaagtaaaccaactttaatagaattctctatagcaagttggttgatgaaacttagaggaatatgcaactaatttaaatccagattatctttccaaagtctgatttgtttgcagaaatagtcaaagtgtattaattttataaacaaagatgatctaattttcatctgttttattgtattgatttttaatttttcccaaattgttccttacatttctggattatagtgtaatggatggaaaggaagttatatctcagccaatttagaaatttttttttattcttcttaacatatctgctgtctaacagaaatttcagtgaggtaagaagataattcaacaggtgcatgtgtttgaagtttgtgctgtttcctgggtcttaaatatctatgccctttgcgaaggaaaaatcttataaatgcatgtgtaggtgtgatgttaacagtgtgttcatctagatggtatattaatcatgtgtttggagtgatcaggtaatgtatttttctaatttttctatatatatattaattggtggtaatctagagagaaactgtagtcttattgtagtttctttctgtagtccttattgctataggttaaaataaagcctcgactttcaaactaagacagtttaagtgccttctttcagactatttaaaattactttctgtgctttttaaataaaagctgctgtagtattttgcttctctagtctggatagtgaggtatgtatatggtgttgctaacatcttttaagcatgtaaaattaatgctgtaatacagatcaaagtaatttgaagctgttttgtggtgtgaactctcttaaacattgtttgcaaaacataaagccagttttcaattttcaggatcgacttgtggaacaatggaaacctagtccaagatgttttcctaggtgagattaaggttcctgtgaacgtattaagaactgattcctctcatcaagcctggtaagggcccagcattttagtgaactccatagtttaattctctttagtacagtatatatatgcaaataaatgcttactctgaacatattttaaatttgccatgtaataagctaaacgtcattaatattgatatgttcattaattcattgttgcagaagtaaattgtaagttttatgacttgacctgtggtactgagataaaagaactgaatcatctaggaatatttttctgttcagaagtgaagacgactcttaaggagaaaaatgggaaacatttaaaacattacataagagttgttcatgtaagaaaacgcttggtcacaaatcagtgtctgcatttcagaagttttattagtggtcataggaactgtgggtatttgaaagcaaaggattttatttaggggactcagttgtttatgggaactaaccactgttcttccttcaccacaccccattgaaatgtactgtagatggccctaatgttactttttgaatgtctaaggtcttatgttgttgagctggcactttttagggctcttggttttcaataatgactataatattattttagttttcagtgactctaataataacattacactgatgttaaattcaaattaatgttcagacattacattgagctagtttccttagcagaatcaatgtgaaactattgttttttttctgtctatagcacttaaaagcgtgtgtatcctttcagtatgttgcccagcatctctcttgctagattttggtttcaactgggtataaatgaacatgcctttctcatttgccttttaaggagcactttttggatctcagtttctgctgcctcaaagaggagtgtttaggtgtttcttatggatatcagtttcatctgttcctaaaagagcctgcctcttctgattggccatcagacatcttcattttagagtcttgtcctagagcagttatcacttgtagactgatatggagactctcaaaatttttactttatttttgcctctctatagtccaaggcagatctaagatttattggtctttatgttggcattttgtgtattatagtttgtaaaatgcatccacagagggggaaaaaaatcaaatgtagtcactatgaaaaattgatgaagatttgggacctgtcatcctcccactacaccatgtcttccaccttccatcaaatagcatacattttaaaatgaaaatttctgagctcagtttgtcaagtttttaaaattatgtgccagaccactcagtacagaagagaaaaacacgttgtagtgcctccgggtccctcaaaatgaacttgaaatgtgccacataatctgttttttaagtaagactgtctccagagatgccttccaaatttggcaaaactttgtgcagcttccttggcagtatgtaagaacattaacaaactaattttatttttatagatgtttttggcccatgatattttaaagtaacctgccagaaatataagtgctgaaatttatatagcatgaaataggaacatctggtaattcatatataattccacagttgtaaggaaacataaaaatgtgaatgccatttcttttaagttggaaataaaactcttaacctcctccatcaattgtagagccatagcatccccttgtggggttgttagtaactgcatgaaaactcaagaaaagatttatttaccctcaggatttcaggcaaattctttctaatgttgatgttaagagagtaatcatcagtaatttaattctgttgtttgaaaagtctcaaaatagattaatttttaaatttgaaagtaagattcaaataatagataaaatgaattactgggtttttcttttcaacagaagcactttatacatgattttagactagatgaatatttgatatgatttagctttccagtttgttaattttgacaccttttgtcctcaaacttttttttgtgggggggcggtcttactttttttgagacaaagcctcactctgttgtccaagctggagtgcagtggcatgatctcggctcactgcaacctccacctcccgggttcaagtgattctcctgcctcagcctcccaagtagctgggacttcaggcacacaccaccatgccgagctaatttttgtatttttagtagagacggggttttaactatgttggccaggctggtcttgaactcctgaccttcgtgatccgcccacttcggcctcccaaagtgctgggattgtgagccattgcgcccagcctttggtctcacatttttaacgtatctgtttaatatttgaatttagaaaatataacaagtctcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccattctcctgcctcagcctcctggtagctgggatgacaggcatccgccaccacacccagctaatttttgtatttttagtagagatggggtttcaccatgttcaccaggctggtcttgatctcctgacctcttgatccccccgcctcggcctcccaaagtgctgggattacaggcgtgagccaccgcacctggcccacgttcagttattaatagaactgcttctttattctctcatttacatagcattatgtacaaataattgcactttgggtttgtctacctcaattttaattacacagaccctatggttagaattgtttaaatgctgatttttttctgttaagggactgtcaaaactgcttactcttgagagcataaggattgcttttatgcctgtgaatgaaaagtacatgtttagagcaactgaatgctactttcagttaaaaatttctctttattccctgtttctttttctttcaaacggaaatatttcattcaaaaactgacatatatatatatgagttttttgttttgttttcacttagaaatgccagatagtcctgaactatttaacaaatcttgagccttttctctttagctctaattcatacagaattatttaattcacaaggatccttcaggcagtttattaaattgagcttttgtaataatattttaaaataatcacatttatatagttatacaaatgactattgatagttattcatatatttaagtggtaatagttatacatcacatatataaatgttatatgtgtaacatttacatagtgattactgtgtgccaggaactattctaagtactttacttataataacttttttagggctgttgtagggttttaatgtgttaagacactattaatactccttatttgacaaatgaggaaaaagcacagagaaatttagcaacttgtctaaggtcacacagctgggatttgaaccaaactgtttgaccccaaagtttgtgcttttaaccagtgtactgtaagtttgaactctggcatatttctgaatatatttaaaactcaaaaacattcttttaagccattagcaaagatttgagtgtcccttgcttataaaatattatataaaagagaatcagagagttccctactcatttaaaaaatgatcttttcaagggatgggtaaaacaacaacatgttgtgaagtctttttttttttttttcaagtagacatagatgagatattttgtctatggggatttcttatcctgcaaagaaaatccaaggaaacaagtttagaaagtatggcaggagtgaacccttctggagttcttaagcatccaaaaacaatgtatgcataaaaatgagtaattggtatagcactaccctaattcctctacatagaacaatgctatgttaagactgtaggcctggtaattttcagttatatgagagtaaagagggatgtcatacccctccctcagttatttggagctaaaggaaataaagttgcgctctgagcaaaatttctgtagtaaaaaccaaaacagagtttgttttgactgtagagttcagagacactgtttaagatggatagggatggtcccagagaggcagaaccagttgtaactgagtaagcagtaatacaagtaatgttaatctactgtgcatggaaaacattagttcaataggaggaaaagattcatctagagtaataaaaaaggattccaaagaggtaggcatggtactgcctattcaagcacaattgagggggtaggggattctggtccagaagaattactgtttccttggcaagactgttgtcttagctgagagattcttaaggctgcataaaactccttgtcatgcctctgtactcaccacaacgccttttgataatttgcctttccaaatagcctaccaacaggtaaaaaaatacagtgaaagatatagatgaaaaccctatggtaaatggtgataattgttgtaaccaagtgacaagcacatgggggtggtggtaagaaagggtgttcattattactattatcactcttctccctacttttgtaagtgagcatttctataataaaatgcattggtcacttaacaatccaggtacttatgccacttgactatatttctttttcataaatttaataattgacctgcttttaagtatatcaggctctgcactcagtcattgcaattcaggtgcaccttattctttttttttatttttttgagatgcagtctctctctgtcgcccaggctggagtgcagtggtgcgatcttggctcagtgcaacctccacctcctgggttcaagcgattctcctgcctcagcctcccaagtagctgggactacaggcctgtgccaccatgcctggctaatttttgtattttggtagagatggggtttcaccatgttggccagcctggtctcgaactcctgacctcaggtgatccacccgccttggcctcccaaagtgctgggattacaggcgggagccaccacacttgaccttcaggttcactttagatgtgctgataaaacgagatgtctgaatttgcaaggttgccgaacatgccctggattgtgaaaaattgaccaaagtatcaattgtcaggatgcttggtcatcaaccagctaaacttcctgatgtggtttggctgtgtccctacccaaatctcaccttgaattgtaatcatccccacatgtcaagggcagggccaggtgaagataattgaatcatcgggtggtttcaaatccccatactgtgcttgtggtagtgaataagtctcatgagatctgatggttttataaatgggagttctcctgcacaagctctcttgcctgccgcatgtaagacgtccctttactcttctttgtcttctgccatgattgcgaggtctccccagccgtgtggaactatgagtcaattaaacctctttcctttataaattacccagctttgggtatgtctgtattagcagcataaggacagactaaatacacttcccttagaggtacttctgagtcacctttgctaacaggcttgtttctaattatttcattgaccatatctttacatcactatttcttaaatcagacagtagatgttctgaaggttgatcttcctcttttgtgggatagtgatgtaatttcttcttgtattaaccatcccttcatcctttaaatttgccttggttaattcgctagttgtcttttctgtctttatcttatctttctcaaagctaataaatgttctattaaagccttcctccttctatttttaaatgaattaatatattagaggaggtcatagctgataaatatataaattaagtattaaaactactatttcttttataaaaagcatctcagcattccagctaagtgaaggaggagtgatagagttataaaattatcattttgatgattaatggctctaagccgtgatcatcagtggctgctgatattgcaaaaggagaaacaaccagacatttatgcctcttggtagaactacacagcattatcaatgaagcattcttgccagaacatcaaatctgaatctaaccaagcctctagatctaactaccaatatagaggaaatacagagaggatgaaggaatatggtaaatgacattgtggaggtagagataagagttaacacaattccaaaggtggaaaactctataggaccaacagtgaggaatctataaaagagacttaagaatgctattaccaattctaatctatggaccttatttggattcgaacaaactgtagaaaaacatttatgataagtttggggaaatttgaatactaagtgaatagtgatgactttttaaaattatatatgaaattatacctggaaattgctttaaaataataatgcaggaacaggatgggagagtgagtgaaggtatggctgaaacaagatcagtcttttattaaaaaaaaatcagtgtatgtatttttaaattttgtttggcattgcctttagatagagaatagagaagatggcagcttttttctcatgttagttagaaacttctaattgctttcaaaaagtgacccaaggcttcaaaaccaaagcattcattcactcactctctagtcaatatccatgggaatgtctactactaagcccatgtgccctattctgacctatctactaaaaataaaatcgtgggttcaaacagcaatgcttaaaaaaactcaaactgcttaaaaatattgcacctgtgaatctgttttagtatttttagggaattactttactactgggctttgtaattttaaactttagaaaggccttagcacaggatttataaaacttgaaaactatgagtataaataaataattccaggccaggcatggtggcttacacctgtaatcccagcactttgggaggctgaggcgggtagatcacctgaggtcaggagttcaagaccagcctggccaacatagtgaaaccctgtctctactaaaaatacaaaaattagcccggtgtggtggcccgcgcctgtagtcccagctactcgggaggctgaggcgggagaatcgcttgaacccgggaggcagaggttcagtgagccgagagcatgccattgcactccagcctgggtgacagagtgagactctgtctcaaataataataataataataattccaaacattctacattcttagataaaatatgtaatttatttctcaaacagtataggggaaatattgacaacatttaaaatgcattttaatgtattttaaaactttttaaatgtatttttaaaacattaaaatgcattcttaatgtattttacatgtattcacaaaatataagaaaatgcaattcgtgtcataattgtgacatgataccaaaggagaaaatccctccctttactgtagcaagtgtataccatagaggcagtgagtaagagaggaacagaatagagcagtaacaagatgaaaatggaaagacaaactcttcctcagtataagtaaccagtgctataaatttgccgtgcctagtacaaatgttgaacaattgtataaacagaggttgaggattttctgcaaataataaaagaaatatcagtgcagattattctgggagaagaatggcaaagaaaatccacaaaagcattttagcaggacttgggtaacagaggactgagagagagaatttcccagacccaaaaagcaaataaataattttccccagtctcttagtaaggagggttgaaattaaattcaaaattttaatgtttgctgtttattgctttctgaacacaattatttttaagttacttatggcctattaagctgtatagcattttcacttcacaagacagtacaattatttttcattatattcataaatacctctcttaaagaactcgagtccattcattgcatgaatattatgtacccgttaaaaagaacaaactggatctatgaaaagtagtttcaaagagttaactaggaagtgctttcaggtaaaaaaaacaagatacaggagagtagaatatgataacatttttgtaaactgactaataggctcagaactcatttataaatgtgtatatatgcacacattttaaaaaatctatataaaattatataagcatgaagaaaatagagaagggtccatagtaggtagttaacaggttcctaagagaagcggaggtgcagaatggtagtgttttgaagataggaaaaaagataagagaaaaacaaagttaaaagagaaaataaagaaaacgttccttaaaaaaacaaaagcattgatttgatgacattgtttatatatgtatgcatcgttatctatttgtctatgtgtagtaaggattttttaatattaaataaagaagattctggttcaaagagtgatgaaaatagtaagtggcactccacacagattctttcttggttcttgaagtttgagcttcactacaaaaagaatctccattcagttgcttttatctaccctacagcgtttgttaatagcaaatccaaatttgtaaatttaatttggagttatttctgaaaataaattttgtgggcaatatgatgataagccacaggaaaaaaaatatgcagataaatatttataaataaattcctttaatatattctaattgtgatagtttctgcagcataatttaaaattatgctattttcagtgtccaaataaggatgttatcagtgttagtattgatcatctggctgcacatagtaacttaaaataattttgttttagaatatactaataaaagacatatataatacagtttttctgcagtttggtttctggttatagttaagtaaagcaaagattcactattttatatacagcacaagaaaacgcctttttaaaataatgaattattgaagaataagaatacagttaagtttttttcctggatgtttttagatattttgctctaatggaataaaggggatgaagtatttgtaatgggcatattattttagataaataaatttttaagagtttgaacaattttttaactcctggaactcttgtgatatcttgaatgagtagcaaacttttttttttccagtcctagaaagatatattttggctaaagcccagcaattctgaagttttaatgaccaaattagttgagttcaattgtttttgccaacttaggctactttaagagtaaaaattgcctttctctaatcctgatatagtctagaaaaaaataggtatttacactaacaacaaatcataaatttcaaatttaggcaagcatattgctgagtatccccccaaaaaggaaatatgaatacttgattgtcaatggtactttacaatttttatcagccttcatccaattttgttttgttttgttttttaattttagattcaggggtataggtacaggtttgttacatgggtatattgtgtaatgctgaggtttaggcttattatcccttcacccaagtagcgaacaaagtaccggatggttttttcaatccctacccccctatctccctccccacttttggaacccccagtgtctattgttaccatctttgtgtttgtgcatacccagtgttcagctcccacttacaagtgagaacatagggtatttggttttctgtttctgcattaattcgcatagggtagtggcctccagcagcatccatgttagtgcaaaggacataatttttttctttctgtgactgcgaacaagattagtcttcagttgataattgtttaagctagataatgggtacatgagcgttcaatattctcttttgtttgtgtttttaaattcccatgataaaaagctttttttttttttttttaaactcttagatttctggttttggtcctgcaaatttctcttaagttcaaatttttggaaaaagaatttactttaaaacaaggttacttacgcattctgatatgtcttatctacttttttttttttttgagacgaagtcttgctctgtcatccaggcaagcccagactggagtacagtggcgggatctcagctcactgcaactccgcctcctgagttcaagtgattctcctgcctcagcctcccaagcagctggattacaggcacctgccaccatgccggactgatttttgtatttttagtaaagacagggtttcaccatggtggccaggctggtctcgaactcctgacctcaagtgatctgcctgcgtcagcctcccaaagtgctgagattacagtcatgagccactgcacccggactgtcttaattttcagctaaatgcctctttcttaaatttagttggtaaaaatttatttttgataatacattggattttaaatgtttaccttttattatcattttttctaaacctgcaagctaatcaaactcttgttcaactcctttgagatcttaatttctgtaatatctatgctttttgtttcctggataaaaatgtgtttatagctttgtaatccaatgtataaccaatattagttttctgaagatgagtatcctgctacttatgaagcttcctaactgtaaatactaagttgacttttttggtttagtttttttataacttaactcttaacttgcctcattggcttgaatgcatttccatcacatggaatcacttatatttttactttaggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaagtatgttaagaatcttaaggatatgatttaacacgaaacggctaaaataattctataaatgataaggaaaagatttcaagagtatcaagtcttattaaaacagtaaaaattatatacatacatatatatacacacacacatttctatttatctgaaccagagtactatgattcctacatgtgctcccacaatcatctctgataaaaaatttcgaaaattaaatgtcctgtataacagctttagtgacattatttcagttacttttacaggctagtgattgaacagttaatcatgtttccttgatgtttgtgcttgttttctacctttctgtatttagccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacagtaagagttatattttattaaatgttaattacatgttgttgaaattggaccttagtttgacagattgattttgtagtctgaatttttttgtattgatcagccttactgtatagtaggctgaaaagaagtacttaacaaataacaaaaggcagttaagctatcaaacagtattcacctaccttaaggacaacaattaatgaaggatgtttttctttaactcaggaaatttcatttgttactaatctgcttcttagtgtaatggttcacgtgtcacaagttaaaacaccagagcagaagtgtttttttctttattcattatgtatcacccttatatgcatatgtatgacattctaaaaagcagtcaagtgacttctcattcacgtcatagtctaacactgttgtttttttacacacagagacatacatatactccacatttttggttcataaacatgatttgcctttttaaaaaaacatatatatatatatatatatatatatatatatacacacacacacacacatatgtattgagttttttgtttgtttgtttttaagacagagtctcgctttttcacccaggttggagtgcagtggcatgatcttggctcactgcagcttctgcctcctaggttcaagcgattctcatgcctcagcctcctgagtagctgggattacaggcactcgccaccacgcccagctaatttttgtatttttggtagagatggggtttcaccatgttggccaggctagtctcacactcctgacttcaagcgatccacctgcttcggacccccaaagtgatgggataacaggcatgagccatcacacctggccattattttaatatatttttggtaagtttgaaaaacctaatggcagcaagcttttaaataaatggtaaaaattactaaaattgtaggtcacttatgccttctagtatgtcttaatctatttcagctaaatgcttctttcttaaattggtcaagtatgttatattattggtttcaaaacctttgtttactacatttggtttcatctatttctatttcagagatgcaaacacaatttttagaggaaattccctggctacccgatgtctggatgagatgatgaaaatagtgggagggcactacctgaaagtaacattaaaacctattcttgatgaggtacagaatatatctccaacaatgatagtttgtggccttatgatagttgttcttttatcaagtgatctattgatgggaaggatttattcattcatgtgttactgaaaaaatagactgaacactttagaagcaaattatttacttctctgtcaatggatttttactcaaaaggtacagtatagtataatctacattatttctttgttatgggatttctattttagctagagtttcaaatatatgacaaatactttttgatatcatgttttaagaaaattgtatatgttatccctgcataggacattttacgctttgctacagtttaaatttctataattaacttttattatcagaaaaataagttattttcattttgtcagactacttagaaaaaaatcattaactgaaaaatttatttttcagatatgtgactcctcaaaatcctgtgaaatcgatcctattaaattgaaagagggagataatgtagaaaataataaggtaagtccttgttatattatttataattgcattaaaattggtcttaatggtgtacctttctcccacttacattatgataaagccatatagagggaagcagtgctgtttattcttcacataagcctttattattagcagcacttccagctcctaggattagtttttagaatgttatttcctcagtggtttcactttatttttgttcttgattgtctctttttggctctagtaacaatagtgaacttaagctatagctagttgcagcccccgttctagccattcctttgggctcaaactgatcaggctaagtgacacagtgactttatcagtcagtagtttcagtggcctctgaaaaaacaatgattgtgttagggtcacaaatttttattgcagtggataatagtgtcacaatgtccttgtgcttgtgtatccgagttattttgtgatttccttttggatcattttattccctcttgcttcttgtgaggtttattcatagattcacctcttacgcctagcaaatctaaatttaatttattaaattaagtcagtatgtaaattgtccttaaactgaatgagtttggaaaagggtaacagtactttaaaaaatgttagatagtgactgtctaataaacctcattttcttacatttttctttcatgaaggctattgaagatgtgtgaacatcaaaatcttaatgtttacctttttaaatcctgcaggagaatctgcgctactatgtagacaagttattcaatacaattgtaaaatcaagtatgagctgccccactgtaatgtgtgatatcttttattctctaaggcagatggctactcagagatttcctagtaagtgccttgttttactaaaacatgccatttatttttctttgacttttttatagatattaattacatgtttggtttgtgagatatttaaggtttttatttatttatttatttttattttattttattttattttttttgagacggagtcttgctctgtcaccctggctggagtgcagtggcgctatcttggctcactgcaacctccatctcccgggttcatgccattctcctgcctcagcctcccgagtagctgggactacaggcgcccgccaccatgcccagctaattttttatatttttagtagagacggggtttcaccatgttagccaggatagtctcgatctcctgaactcgtgatccgcccgcctcggcctcccaaagtttctgggattacaggcgtgagccaccacgcccagcctaaggtttttaagtacaaccttctttagtttttcaaaatgattctatctttctcataagaaatctgatttttcttgaaatctcaaaatacatattccattttatttcagtataatgcaactttatacaaagagcaaatcaaaatcaccattaaagaaaggcaaaaattcagaactgtaacattatataagtaagcacttataccagatgcttatgagagttaaaaatacctttgttatttataccaactatcttttccagctgcatgcattcagatagtgagaatctttagttccataaaattgactagatttgacagtttgagaatgctaataaggttttggtggtgagaggtttttacagaaatggtcttagacattagaaacctttctgttgtaacatacatagagttttaaggtacatacatcagtaactggcatgttttaattttgaaaaagtagctatgtcaaggttttgcttagaaacttttcataaaattaagtgttactgtcgctgctaatacttagaattattcacattttaatatatttctgataagtaaataaacttgctataggtagctttccagatctgtctataatgggaggtggtgggtaggagggtaaaattaggcaggtacttaaattaccagtcttaaccagctgtgcaaaactgtaagtttatttctgtaaccatctgaagagattttgcagttttatgttcttttaagcatgtgctcaccctgtacacacatgtgtgcagttaactgcacttctactaaattgacccattactaaattagtggggctgagttgtctaacatgtagataaatttagatctaaatgtctttgctaattatagttgcaaataagtaactaaatctaatcttcataacaaaaataaggggagccagaggcacacggaaaggtgaaatgctcattgaaattatatttttaaatagttaaatcatgataaccacattgactacttagtaacacacacagtgttagtgtgttagcctccattgtctcctgttctcatcttcacaaaaccacatgaggtaggtactactcccattaggtgagaaactaaggtttagagaagctgagtaactttaccaaggtctgtggcgtggccaacaggcaagcagggcctcaaacctgggcctagtctactccaaactacatgctgccattcactatactctatactaactggtgatcttggccttaaatctgttttagcagtttaattcttgtttatataaatgatcttaaacactttatggggtttttttgggttttgtttttgtttttgtttttgagactgagtttcactcttgttgcccagactggagtgcaatggcacaatctcggctcactgcaactccgcctcccaggtttccagcctcccgagttgctgggattacagacatgtgcctccacgcctggctaattttgtatttttagtatagatggggtttctccatgttggtcaggctggtctcaaactcctgacctcagatgatccacctgcctcagcctcccaaagtgctggaattacgggcgtgggccaccgcgcccggccaacactttatgtttttatatacatgcagatgtatctctttagttatgtttttgttgacttaactattaatatggttatcatatcctcagtagactatagtagtgacagttttgttgccataagtgtttcatattctctcgtttttgttgttcttactaccctagaagaatgggggaaggagggcagagcagacagcaggtagaaagcagatattactaaagaatgacaaattaaacgacttgttaatggttacctactgaatgacttagaagagttaaaactcgaaccaaacctaaagattctttccctcaccatctgcttcaccaccatctgtctgattgttgggtaaattgttgactccagtctgaaacgaaagttgtaggtgaatgatcaaagccaccagtagtcttcagttcatctgcatttttatttatggactgttgatagctttttaaagtaaacatttctgcctaattgtttttgttgcataacttttgatattatcaagatttttgggggggatattgaaacaagaacctaaaactgaaagtagccttgtatcatactcttaagggattcagtgttaccactaggtagtgctagatactacttttatttctgttgtaattttagcagtctcttcttgcaggtgaggaaagaggtatttttcaaattaaaatatttctgaaaacctagcagctttgtcttttttcatattatttcttatttcttttggatttttttaatcataggggttttcttttaattgagtcataaatatcactatcatttcatcaactcagttcttactagacaaattatgttgctctcctagtttacatgtcttttctatattttttaatttatcatctttgttttttaattgtttttgtgcatgacatttcaccatttttttcctgcagatgaccctcatgttcagtattctgcagtgagcagctttgtatttcttcgtttctttgctgtagccgtagtatcacctcatacttttcatttgcgacctcatcatccagtaagtgttcattcttctgaaagctttattccatttttttaatttttattaaaatgaagaaaagataaaataaaccaatttcactaggctgtattttcttataactgatacttaaatttactcagcatttttcttggccatttcagtctttcaagtgaggctaataatcctattttttgttgttgttaaaagatgttctacaagagtaataaaatgttgttaattattgaagcttggtgatgagtacaaaggggatttattatattttttcatctgctactgtgtgtgtttgtaaatttccataagttttttttcattagttacaggtttcattttgataggttttttatttaaacaaaatctactttcctgatttattaaaataggttaattttgcagatatttttaaattgcacagaaatttgaagaggctcttctctaagaaagaaggctacaagagaaattccatttaatttagaaacagcatctaagatagatttcagtagcaatgaaactgaaagcatataattagaaaatattaaatggcaggtgaactggataagcattaacagtaaaaacagaaaaagaaaccaagaatgcagtatagtgaaaggcgtaggaacttttattggaatataacttgttaaatatatcagtattttcactttttatttacctgaggtaatactgtaaacatgagatttaaaaatttcttaagcatataaactttgttctggagtcctgtttaattaccaaaaatctaaatctccactgcatagatttacatgtttatttcttaatttttaaaattctttatttttgctatacttctgattccttcttatatggtgtaatttggttgattctttaagcttttatgttccaaatactttataatcttacctaattgctcctagttgctgatttgtataacaaataataacaatagtccacatttatttagtgctttgtactaggccttgttctaactactttatgtgttaacttatttggtcctcctagcaacctggtaaggtaaattctgttatcatccacatgtgcagataaggaaatcacaatacagtaacttttccaagctcacacaactgacaaattatgatttgatcatactcgatttgaattggatttaactgggattcaaattcagtcagtctttatcatctgtgagcttaatcctatcccttccaacctcttagacagatgttcaagtacctataatgtatcattccatgctcagtactggagatgcagtgatgagtaagatactctttgcccttaggaaactcacagccaagaggagttgctcaatagtgtagggaaaacagatgagttttagagttaaaccaggttctgaatacccatttcttctctcaacggctacatgacattgacactcacttaactttgtgagaactgaatagaaccatgttgcagtggcagcaccacgccctttcttgccaaaggataaatggtctgtgagtagccccagcagagagtgggccagtgtccttttgttcacagggctgtccattctgtggctttgttactaaagctgcacagaactctgaggcagtgaaagcgtggtagcaacattctggacataaacagaacacctacttctgaacttgtgagtctgccttgtattcatacttgaatttgcatattcctgtaacagatgttggtggatacttaggttggttctatgactttgctattgtaaatagtgctgcaggaaacatgagtgcaggtgccaggacatctttaagaatattattttcttcaaagacagagaattgtagggaccttttatagatgtaatgaaatcccagatgttacagctaaaatgttttctgaatagacttaatttaggtgtgtatctactttataagtatattataaggatcatatttcggatattccttcctttccagattaccttatattctggtcatctcttccccttcacattcattgcctgttttcaatgtgggggttggggggatactaaaatatcaaggaatgggagccaaaaatcaaactaaagcttttctgtatctaaatttttctggatatgtttttagatgcaagatactgtttacttgaatccgtaaataaaaatggtctgtgttttgatagaaacttacacaaatgtatggattggtgaaaattcagcagggtattcatttaatacctattcattttgtcatatgtaaattatatctcaatttttaaaaaaatgaaggagcaaagattcctgagggaacaccgtttagtcaattttatatgctactatatattacttctttcagatagacaggcctgaaaaacctcttggataatagacccaaataatcaccctctggtaagatccaaaaataactaggtgacttcacatttcctaagctgaatttaggtctttgcttccatggtgaaaagagttaattgcaaaagccatttaaagtattgaatatgtttagaggtgagctgagcacagaaaatttggaacacctaaaactgccattttaagttataaggtagtaaagtagaagtgactattccagaagtgactataatttgccaggtaatccaaggtgccatactgtacaaaacaacttatatataatattgataaaattatggcttttggctggtgccaaaaggctcatgcctctaatcccagcacttcgggaggccaaggcaggcagatcacctgaggtcaagagttcgagaccagcctggccaacatggcaaaactctgtttctactgaaaatacaaaaattagccaggtgtggtgtcaggcacctgcaatcccagctacttaggagactgagacaggagaatcgcttgaacccagaaggtggaggttacagtgagctgcggttatgccactacactccagcctgggcaacagagtgagactccatctcaggaaaaaaaaaagaaaaaaaaaaaaaaaaatatatatatatatatatatatatatatatatgacttttaaaagcaccacatctttaataattactttgggaagaattgttaattatatatggtttctttagtctcttaattccttaggctggtgagttgtacccagccttagctagattttaactgtgtgtgttttgaacgtttttgagtcattgttttacagcaatgtagtccatttactctattctacttttttatacaaactattttcttgaaaacttagtagttttggtcttttttacattctttaggatgcacagacaattagaacattaactctcatctcaaaaactatacaaactttgggaagctgggggagtctgtccaaaagcaaggtaagtccttacatcttttattttgtttttacacttctaaatgttgttacatcctatgatcccttatccttgacttaccttcttccaaattaaaaacaaaacatacacacacacacacacacacacagacacaatagctgtcttttaagtagatactctcttagtcacctgttaaagaggacagtttcagaagctgggcatagtgacttgtgtctttaatcccaggaagccgaagcgggaagatgacttgaggccaggagttcaaggctgtggtgcacaatgatggcacctatgaatagccactgcactccagtcccagcaacatagcaagaccctgtctctagaagttttaaaaagaaaaaaagtttaatgagaacattaaaaaaaaaaaaaagcagacagtttcatgaaaactgctaaacaagacaagagagcctagtaaggaggtgcaggacagtctgtctgtctgcctgcttcggccataatcacatgacagctttgaaagaagtcttccactccaagccctgaactctctgaaaatatataattgagtccttttaggccttaatcctcagcttaaaaatacagtccattctattcttaattctctatttaacacatataaaccctgtgtttgttttttcttagtcaagtttcaaagagacattcatgtgtgaatttttcaaaatgtttcaagaagaaggatatattatagcagttaaaaaggtatgatggttttattctggaattgttaatatttatttcatataacatggggaaataacattttatatatattattattatcaatccccagtttaaataataatgtttaaactgttcatcaaaaaggcttcctttttcttttttcttcttccacaaagctgtgcttttcagctttgaaaatacctaaataagtttaacaacaactacttttgccagtgcattagaaacacaaattacagatgtctagggttaggatttctcaaagtgacactattggcatttggggccagataattcttgattctgaggggctggcttgtgcgtttcaggatatttagcagcatgcctggcctctaccccttagacgcaagaagtatgcccctgttttgacagccaaacatgcctccaggtattgccaaatgttccttgagggacagaattgcctctggttgagaacctctggtctctgggggtaaaggctttgtatggtgcctgatgtagagtgggcacttaattgccatagtaaaaaatatatacattattgaacatttaatgaacaatataaatttatggtagtaacctgaggaaaattactataaatttacaaaaacctgtagtatataatatcctaacacaaggcctgcagcatacaaaaatcactgtacttagaagttcagaatgttttgaaaggatctttaatttcttgagtctttagtcctgaatcatctaaacaaaatatagcattatcgtaaaatgctgaaaatttataaagaaaagttacctttgaagtactctatcccatatagtctagaagttaagaattaaaaaataaggaaagaaatgaattacatctaaactgggcctgaagaaagtactgtattatatgtatcacagtcttaacttaatgaatccaaattagcaaagccaaatgttaaagacttcattcaatttctgtagcacaactagcagttggttgccagagtatttattttgttgagatacatgtttgagcctttttttatacttaggattcttacagagacttagtaagtgaaaaatgatgatttaaaaaattcaagtccgttggaatatttttcatctggaatagtgcctgtttaaccaaaatttttttaggcaaccattgaaggcttttgaggagaaagtctttcaaaagaataggcaaagaaaaagctgcccttttatttttcagacattgttgaaacatttgtgacactgtaggcagacttttattggcaggattatgatgtactgtcttttgtttgagggttgtttttccatgttttgtgactgaggctacggtagcatctgatcttttttcccctgatataatcagaatgtttagagttgataatgtcagtggagaaaggatttaagggttccaggagtttagtctgttcctgatctactctgagtcacccactcacattctaatggactatcgccatagtgtgcctctgtctcagatttggttctagatccctaagctgacatagggtattttgccctaatatcctagtttcctttattatttagtagttacaacaagatatgtgcagtgctataaagtgtaaaagcttgtgaagctcaatttctcattttatattggcactctgcctagtgacatttactattgatgcagaagaaaataagagtataactgaatcatatgctattccctgcagagtttagaaaggataacctggatagttctataaacaaggtgaccatataatttgatgtctaaaccagaacacttttaagagtgaaaaatactattagtgattattctgggatgataggaatggtcctgatagggatggtcctgagcaaactgggacctatagtcaccctgcctatagtccatcttaattactgggttttctttcacttatatctctgtatttaccccatagttccttaagaattataataaataaattattggctgggtgcagtggctcatgcctgtaatcccagcactttgggaggccgaagcgggcagatcacctgaggtcaggagttggagaccagcctggctaacatggtgaaaccctgtttctactaaaaatacaaaaaattagccaggcctggtggcacgtgcctgtaatcccagctactagggaggctgaggcgagagaatcgcttgaacccaggaggtagaggttgcagtgagccgagatcatgccattgcactccagcttgggcaacaagagcaaaactctgtctcaaaaaaataaaataaattattataaataataaatatttgctaacaaatcagtgacttcaggtatatattaagaaataaaatattcacataactcagactccattagtgcatggtccatctgggagagtcgatgctgtgatagggcgcttcttcagttcccttggatacttgtacccacattacccacatataatgcaaaaggaactctgttcttgttctttcacttaccaatattttctcccagcaaacagaagtaaacattccatttcaaaactccttaagtctgagctctggcaggcaattgtcagccagtcttaggagaaaatggctgtgcctacaaattccactttagaataggcactggagcctcaatactatccttattggaatgtggtttgtttttaagtcctaagcagaataatgtagagaagtataaaggaaaaagcaaagaaatgcagaccctctctgagtttctgagtttgtaatatccatctaatgaactaaataaatggatagctcatttagggggcaaaataggattcttctttaagaacaagaattgttcctcaaaatcaaagtaatggtagattaaaaaaaaagaagaagaaaagaaaagaattgttccagccaggcacggtggcttacgcctgtaatcccagcactttgggaggccgaggcaggtggatcacaagatcaggagttcaagaccagcctggccaatatggttaaaccctgtctctactaaaaatacaaaaattagccgggcatggtggcaggcgccggtagtcccagttactcgggaggctgaggcaggagaatcacttgaacctgagaggtggaggttgaagtgagccgagatcgcaccattgcgctccagcctgggcgacagaacaaaactccatcccaaaaaaaaaaaaaaaaaaaaaaaaagaaaggaaaaaggaatcgttccttgaactgctgatttccctttcccatgaagagacagccaaatactaaaaagcccttgaccagtcagggtagcatatttatgaagttaaatgtttttcactagctgacttggtaaagatggatactataaattttcttgatgggaagtttataaatggcgattagatttcgattatcccagataatctgtttactcttcagtcatgactgtgaaataccatctctcagagctaaagtcagttatatatgatagaagttggcaaactcttttctgtaaagggacagtgagaaaatattttaggctttgctgatcacataaggtctctgccacttagtctttgttttcacaaccctttcacaatcctaaatgtaaccctaattgttacatttagaaatgtaatagttacaggttgagtatcctttatcaaaatggttgagaccagaagtgttttggattttggatttttttcaaattttgaaatacttttattcattctctctctctccatatatattttttttaactgattgagcatccctaatctgaaaatccaaaattcaaaatccagaatgcaccagcaagcatttcctttgaatatcctgttggcactcaaaaagttttgggttttggaacatttgggatttttcagattaaggatgttcaacctgtattcttatgggccttacaaaaacaggctacaggtcaaacgtggccctctgagccatactttggtgattcttaacctataataaaggttcacaatcttatatgtaaaatcattgggaccaaaagtatttcagaattcagtttttcagagtttcaaaaggtaatcagtatatactatatttaacaccccccagtggagcctagggtagcaccccacaatcaaatacattaattcttatagcacagtatatgaatacttacagtaagtaatataagtacagagtgtaaatagccttacaccagttcaggttaagttatacccctaaatgagtacttcaaatcaaagacaagatttaaaaactttgtattcagaatgttatgtatttcagaattgcagttaaggaattatggattgaattattcctacaaggaaatatgttctgggttttaagtaacttaagaacaaagttttaggctgggcacggtggctcacacctgtaattccagcactttggtaggctgagtcaggcagatcacttgaggccaggagttcaagaccagcctggccaacatagcgtaaccctgtctctactaaaaataaaaaaaaatagctgcccatggtggcacatgcctgtaatcccagctacttgggaagctgaggcatgagaatcacttgaacccaggaaggagaggttgcagtgagctgagattgcaccactgcactccagcctgggcaacagagtgagcctctgtctccacataaataaataaataaataaataatacttttataatacttgtcatttgtaaattagggatttcctctctaattaaatatgtgttttgttttataaattactattatgtgtattcattaataatgaagaacttcccattataattaatgacatgtaagataaactgaattttttataatgtaccttatcacacagtgtaatatttgcccatttccccatttagttcttggatgaaatttcatctactgaaactaaagagtccagtggtacgagtgagcctgtgcacctgaaagaagggtaatttaatcaaattagacgtgaaagtcatatatcagtatagatattaagtaagtacaaagagcgtgggtctaagagtgaggagatctggctttgtgtgctgtgttagaactgccaaaattagcagtcaggtaagtcgcctttactgtcctacaaactttatggcaaaaaagcatgatttcctgtgcatacagtcctagagttgttttgcaattatagtgagatgatgggtatttagagtacttttaaaaagtaacagcactattagtcttaatgtaaagtgtttattataagttaagggggggaaccactcatttgacccttttttgttctgtatagtacaattaaaaatattaaattaattaaagaccttattcctttagtgtggccaaaataaatgcaacagtcatggatagcaaaaacatttttatatatttaatataatcttacactactattcatgtcatttaaagttaaaggatacttctttgttttggattaacttttaatttttatagctaaatgtttacatctgttatgttggcagtgagatgtataaaagagctcaaggaagaactcggattggaaaaaagaattttaagaaacgatggttctgcttaacaagcagagagctcacctaccacaaacagccaggtagttgtgtttatgctttattgtggggtttttcctggttctcagtgaaggtttctttgccgcttattgtgactctagtgaatcctttcagtaatattactgtagtttatggtttctcacactgatacatacgtactaagaatgaaaaaatatttgacagtaaccccatgtatattatgtttttctcacattaaatttcttgagtttctgaaaatggtgttccttcagtgtgctctgttttctaaaaatccatagtaatccatactgttatttatcaaagaacaacagctaaacctcttagaacatgggagtttctttaactctcagaggcaaaattagcaagattccatatcgaataaatgagactatttctgtcctttgctgggaaatatcagccaaaaattcccacagttataccatagattgtgatccctatacagttgtcaaattcatcctaggctcttagctaagctaaccccaaggtggatgacttaataatttgccttgtgagaagactctgttgcctttacaagtgggctatttgtgtaaatgaagccatcttcctacagtgtgatttgagagctgcagagaggcaaagcttatccttcagtagactgacacagtcctttaaataaactacttttgagtttattccgttgggttaattttccacagaaggccaggtgtggtggctcatgcctgtaatcctagcactttgggaggccaaggtgggaggattacttgaggtcaggagtttgagaccagcctgaccaacatggcaaaaccccatctctactaaaagtacaaaaaaattagctgggcatggtggcgcatgcctgtagtcccagctactctggaggctgaggcaggagaatcgcttgaacccaggaggcagaggctgcagtaagctgagatcttgccactgcactgtagcctgggtgacagagcaagactccatctcaaaaaaaaaaaaaaaaaaaaggaattatccacagaaggccattagcttctgatattttagcaagaagaatttagtatctagatgacagatcacatctatatagtagaatcccttctgtccaaaatgatcaggatccagagatgttcacttaaccaaaccaaaaggttggttaaagtgagaatcattttaaaataaacaaaaagatgcatatagatcttaatttatgtatttgtttaccagcattttggtagagaaccaagattatttctttgactatggacctatagatcagatttcctgtctttcttgtgtaaatatacccataatgcatcagttttcaggatgatttctccaaagtaaatctagaacttagatacttgaaaagtaattcaagcacaaaatcctcttagattttcaggatagttacattagtcttttacagctgtcttacctccacataaatcagccttatttgtggaggtatgcgtctcctttttagaggcttttcaaagcatttacctgattttcaaataagtaataaacctcttggtagtgggcacttactttgtctctttacataaagtaaattataattacaacatagaaaactagcataaataagtttagcaacaaacccaatggatatagtaagcaaaacagcctaaccgatggaagtagaagggcgcaggcttaacagagtacctgagcaaccacaagcgtgtagcaccccgtgagcaacattcagtatgttttacagaggaaatggagagtctgttaatctatcaaatctgttaggtaaagatctgttaagagagcttctgctgtaaattctggaataatacatcagacatagggtgctttaaagaggatataacacagttaagtagagtgcttcagtggagactcttgaatagtagagtgataagaaaaaatttttatttcataattcttccttaggaatggcttaaccagaatgactacatgtgtcccagtatattagaaagatataagaaaccaaatgcattatacttttgggtatattactcagataatttgttacaacatttacatactcaaataactaaaagtcaataggctacatacatgcccttccagatagctttttatttttattttttttttttgagatggattctcactctgtcacccagactggagggcagtggcatgatcttggctcactgcaacctctgcctcccggattcaagcgattgtcctgcctcagcctcccgagtagctgggattacaggcgcccgccaccacacccagcgaatttttatatttttagtggagacagggtttcaccatgttggccaggctggtcttgaactcctgacctcgtgacctgccccctcagcctcctaaagtgctgagattacaggcatgagccagcgcgcccggcccagatagcattttttaagctaagcatattttgaatgttttagaaattataacttactgaatactatataaatgttctcacctatgcatagcactgggtgctaattatgtttacattaatagtacatttaaataaaagttaaggtaaattagtcattctctgtgaataaatgagttcttttttcttcatttaaagcattttctaatctaaaccaatattctgaagtatttttcggtttataatcttctttaagaattagatagctatggacccctttgtctagaaaactgtacctacaaacatagacaaaaaattttgcatttaacttcaggggagttcatagtacacaaaattttgcatataatatcagggagttcatagacctaaagttcatctgtgattctcaagttaagaacctctgttctggccgggcgcggtggctcacacccgtgatcccaacactttgggaggctgagtcaggcggatcatgaggccaggagatcaagaccatcctggccaacgcggtgaaaccccatgtctaccaaaaatacaaaaattagccaggcgtggtggtgtgcgtctgtagtcccagctacttgggaggctgaggcaggagaattgcttgaacctgggaggcggaggctacagtgagccaagattcgcgccactgcattccagcctgggtaacagaatgaggctctgtctccaaaaaaaaaagaaaaaaaaaagaatctctgttctgtccactgattttaagaggacaaaattctctagaatgatgaggctactagaggtataaaacagacgcattagaagctatgttgttgttaagcattaagaagtttaaaattttggaatgacattggaggaatgagatatgaagtttcaagcttatttaccaaagcctgcagttttaagcttccatgctttttgttttaactattttgatggatttttccaaaatatattacatgcttccctgccttctaaaaaagagttcattgaacgtaagttaacatcttctagatgacttggggctaccattgataatattaattgttatatggattctgatttagtgatattttcagggctgcttaaaggtgtgtgcaactgtttactccagctaaatgcatttactccgcagctaaatgccttggactgctgtgctttttgtgttcctatgttcgctttatacagtttttctgtatcctttgtggtaaggctgtggccttaaatttcttgtgatgtctgtgaaccataatataacaccttattcccatcccatcacccacctctattttttacagtagtgtcctataagtgaggatgcaagtgctatgtttgtttaaattatgcctaagattaaaaggctttgaatgaaaacgtcaggactttctcctgtaaataaaatacctgggctttgcattctctgtttggttgttgagcaaatgttttgcttacttccaatttccctgctgttttctaggtagccaagacttgctagttaattagtcttttgctacacttactgtgtgactttggtgtctgaaagaatacctcccaaatttcctgtaacatagacctaaatcattgagtctttcactctctcttcctaatatacagtagtattgtgaatcaagtatttctgtcacttagtgtcaaataatatgcatagtcttttcccaatttactggaaaatgaattagtagaattttctctgtattaaggatttttcttcaataagtttttaaatttttgaggcccctttaggcaagtgctaacaggcaatagtaagcaactaatcagtagagttaaattaacatgtagcaaatgaatattatcagacactcagccatcagtcatgattaccttgagagatttttatggccctgtgtacttacaattatgattttatattgctatactataatttagtcatcttctacaagtaaaagttctcttagttatatgcggagatcaaactagttattgatgttctagcctctttatgtctcattcagcctcatcttttgcagtatccatatgtagtttcaccagactactttttgcagtgccttctttacatcttttgcatgcttttacattcatgcttttgcatatgtacataaaaatatctacctaaaaattcctttattttctcctttacctgtgtaatctgttgtcctttaagtcttagatcaagtgtcagctctttatggaagccattgtaagcctcatatggctacctcagtgtagccattcccttactgtgtatcttcagctacgtggcattactgtgtggtcattacttttgtccatctcttcccctagtctttaagatcctcagtggtaaggaccatattattactagtggcataaaggcatatagtaagtattcttcaaagaacaccatgtcttccatatatgctgtcatctgaattacgttacgaactacttgtctttctaaaatttctgccaggcatactaattcatctttgaaattctgttctgtagaatttaattagatattgtctactttggggagacctgttatacacatatacatacacacaactttcatgtgacattaaatgccctagcttatatagccagccctaccctagctcatatagccagtggacattgtaaaagaaatgtccatgatattttaaacataaatgttcaatacactgaagttgacacggttttcacctacctgtattttcacatacagggctctgcagctttttttttttctgatagctaaagaacaaaatacatcattgattcaatcatgcatttattcaacaggtattttattgagtgcctactatgtaccagacactgttctaggctctggagagaaaaatagtaaacaaaacataccaaatccctgtccttatagatctttactaagacaataaacagtaaaaaaaagaaaattatatttatgttggattataataaatcagatgaacaaaaaagaagcagggacaaggtacagaaaatgatgggttcagtgaggtgagttaaaatattaaaaggtctaaccagggaaggcttcactgagaaagtgacatttgagcaaagacctaaatctaaagatggtcggggagtgaaccatgtggatatttgggataaaagtgtcacagaaatagctaacagcacccagaacaaatgccttgaaatagaagcatgcctggagtgttaaagagataagagaaagctcttgtggctggaaaattgaagaagagggtaagtcataggaactaagatcaaaaagatcatagaagtgctagattttataggaccttgtgggcttttactttgagtaaaatggaaagacattggagaggtttaagcagaagaataacattgtttaacttatgtcttaatagggtaacttatgtctgtggagtgttacatggagaatgaatgaagggcacaaggagagcagttaagagactactaaaatattctagaggagaaaagagaatggcttggatctgttggtagcagtagaaatgataaaaatggatcacattctgaatctatttgaaaaatagtacccagaggagttagatactgggagtgagagaaaaaggcaagttaaggataattccaaggatttgggcatgaagttgcctttttaaaaatagataaagaactctttttgaggaaaaaaaagaagtaaagaaggggaacagaaaatgatggagtcagtataaaactgaacttgaaaaaaaaaaagaagagtcctggtaatggtagaaaaaaccaagagtcctggtagtggtagagaagcttatattagactaactcttatagataacaattataaacctttagcagaatatatatatagcaattctctgaagaatttgacccttgaaagaaaggaaccatgctggctaagattgattgattgagatggagtttcactcttgttgcccaggctggagtgcagtggtgcaatctcagctcactgcaacctccacctcccaggtttaagtgattcttctgcctcagcctccccagtagctgagattacaggcatgcatcgccatgcccggctaattttgtatttttagtagagacagggtttctccatgttggtcagtctggtcttgaactcccaacctcaggtgattcacccaccttggcctcccaaagtgctgggattacaggcatgagccactgcgcccggcctaagatttatttttatacagcttttccccttgaaagcactcccagtctagccagtttgaggtggtgctaaaatgcaagcagaaaactaagctttattggcttgagataccaaaggatggagtttagggctaccagagaggctggaaattgaggcataaagaggagttcttcagtctgcatgtgaactcctctgaaatatttagttgactcttaaaccgctaatgcaagagggacctccaaaggggctagtgaaaagcaataactgaaaacttgaaaaagatgagcagagacttcagtttctgtccgcctcaaaggagacagaatttggaattttacttagagagcttagcaaacacttaaatattttcatcaaaatctcaaaagagtggtggcgcagtagtaaagactatattctaggattaagaataaacaaagtatagtataaacaaagtataaaaccaaccctcacgataatcaccaatgatgtaacttcaagggaaggtaactgaatccatagtttctacaatgttttattcatgaaggccagtatgtaatggaacattaacaactcaagaagaaacacagaattataatgcataatctggagaaaaggcgatcagtagaagtagacccctagatgatctacatgttggaattagcagacgtgaacgttaaagcctctattataaatatttcaaggacttagtggaaaagtagtcatcatgagtaaagaaatggggaatctcagccaaaaaagaaaataaaaagggaatcaaatggaaattctagaattgaaaagcacgatacctgacatcaaaaatctgatgggcttaacaacagattggttcactgaacttgaagatcgatcagtagaaatgaaccaatctagaacacagaaaagacttgggggaaatgaacaaaacctcagtgaccctttagtacaatatcaggtagtctaacatatgcatggttggtgtcctagaaggagagtagagaaagaattggacaaaaaaaaaaatttttttttgaagaaataatggcctaaaatttcccaaatttggtgaaacagtatcttatagatctgagaagctcaatgaactgcaagcatgataaacgcaaaggaaaccgcacttagacataaaatagtcaaaccagagataaagagaaaatcttgcaagcagagaaacaaaagacaagatacatacacaggggaacaacagtacagttgacagccaactcctcataaaaagcaactaaaactggaggacagtggaatgacctgtttaaaatgctaaaggaacaaaagtctcaacctaacattctagagaaaattttctttgaaaatgaaaatatattttaaataaatgaaagctgagagagactccattgtgagcaagcctgcactataagaaatgctaaaggaaattcttcaggctgaaaggaaataataccagatggaaacttagatcnnnnnnnnnnnnnnnnnnnnataccagatggaaacttagatcctacaaggagtaaagagcactggaaatggtaaatatgtgggtaaatgtaagaatgcctgttttttttttctccatttctttaaaaagcaactgttcgatgcaaaatgtataacatttaattatagggtttataacatatctggatatgaaatatatgacagtaacagcacaaaggaagggggtggagtaaattattccaagggtcttatattttatgtgaagtgatgcaagaataattttaagtagactgtgatgagttaaggctgtatattataatatctagaacaaaaatttagggaaatacttgacataactaatccatcccctctcctcctcccaaacaataaataaattaaaatgtgaggaagggaagaacagaggagcaaaaatcagatgagacagacagaaaacgtataacaaaatgatagcttaaacccagccatatcaataattacagtaaatgtaaatgaactacattacattgaaagagactatcagactatattttaaaaagcaagatccaataatatactttctacaatatatccacgttaaatatattataaaagcacagataggttgaaagtaattgggtggagaaagatgatgtaaacagtaagcagtaatcccagaccaagtagatgtcaaaacaacttttaccaaatatgtttgggcacattttataatggcagaaggagcacataatcctaaatgtgtacatacctaattacaacttcaatgtagttggagaaaaaaacagaattgaaataggacatctacaattctagttgaatttttttttctttttttcttttttctttttcttttttctttttttgagacagggtcttgctctgtctcccaagctggagtgcacagacatagctcactgcagccttgacctcctgggctcaagagatcctcctgcctctgccttctgtgtacctgggaccacaggtggacgccaccacatctggctgattttctgattttttgtagctgcaaggtctcactttgttgcccagggtggtctcaaactcctggacccaagtgatcctcctgcctcggcctagaattaacaggtatgagccactgcacctggcctgtacttgaatattttaatagtcttctctcagcaattgttagaggagctgagcacaaggaccagttttcttacagaagtttgaaataatactatcagtcaccttgatctaatttacatttatgggacactaggccaaacaggtgcagaatacatattcttttgaaatgtgcattggaacattcagtaaaataggccgccatatgctgggcctggagtctcagtaaatatcaaaagattgactttttacaaagtatgttctctgatcacaacagaattaatgacaatatgatacctggaagagccccaaatatttggaaattaaataaaatacttctaagtaacctatagattgaagaattcacaaggaaactcaaaaatatttttaacttaaatgataatgaaaatgcaacaaatatatcaaagtttgtgggatacagctaaaacagtatgtaaagggaaattgattgttattaacaagtaaagaaaatctttgagcctttataggttaggcaaagatttcttacataactaaatgtatggtctataaaagaaaatatttgataaattggatctcatcaaaattcaaaaacatttcaaaagaggaccattaagaaaatgaaaaggtaagcaacagactggaagaatatatttgcaaaacgcttatctaatatacttgtatctagaattttcaaaaacccaatttaaaaagaggacgatagatatgaacaaacattttatcaaagagattatacaagtggataataagcatatgaaaagatgctcaacatcattattagggaaatgcaaattaaaaccacaatgagataccatttcacaccaactagagtgtctgtaacaaataagacagacaataccaaatgttgttgagaatgtggagaaacagaaaccctcatacatttccagtgggaatgtaaaataggggctttgacagtcagcaactgggcagttctcagaaagttaaacataaaactactatacatgtaacctagcaattccactgttggttacctaccccaaaagaaatgaaaacatatgcccacacaaagaatcggagtgaatgttcagagcagcgttattcacaatagccaaaaactagaagcaacctaaatgtctatcagctggtgaatgggtaaataaaatatgatatatatatgcaatagaacactattagcaatacaggctgggcgtggtggctcacatctgaaatcccagcactttgggaggccaaggtaggaggatgacttgagctcaggggtttgagaccagcctgggcaacatggtgaaaccctgtctctacaaaaaataataataaagaatactactagcagtaaaaaagattgagctactgacacatgctgcatcatggatgaacctcaaaaaattacgctaagtgaaagaagtcagagccaagaaattacgtactgcatgattccatttatacgaagtgtccagaaaagacaaaggtataggaacagaaagtaggttagtggctgcttgggacaggttgggaaccagtcccaagtagccgattggggtataaacaggcatgagggattttattggtagaatgaagctgttctaaaattgatttatggtcatggttataccactcagtagagttacaaacaaaccttcatttgtacacttaaactggatgaattgatatgtcaaataggctcaccttaataaagcttttatttttaaaaaaagaaaggataaaatcaaatatattttcaacttaaactagaaaatgagaaaataaacctaaagttaattgaagaatggcaaaaataaagatgagagtacaatcagtgaaataggaaacaaactaatagtgaagcataacaaagccaaaagctttaataaaattgaaaaatgcctagaaagactgataaaagaaaaaaaaatcaaacacaaaattaccatgattaggaataagactactacaaattccaatgacattaaaagactaaccagaaactaatatgagcaactttatatcaataaatttgacaattcagatgaatggacaaatttcttggaaaacaatttactaaaacagatgcaagaaaaaagtagaatatcttaaaaaccctgtatctctgcttgtgatgaaatgtgtcctaaaaaagaatgccaggcttaaatagctttactggtaaagtcggccaaacacttaaggaagaaataacgtcaaccttacccacaaagtcttttagaaaacagagggaaagaatacttgccaagtcatcttctgaagcctgcataactctagtactaaaactaaagatttttcaagaaaaaatacatataatgaattaaatccagcagtatatgaaaaggacaatccataatgaagtggggtttgtcccaagtatataaagttggtttaatatctgagaactaatcaacataatttatcttattaacagactaaatgtatttgacaaaatttaacacctctttgtgattaaagaaaataaaaactcttgaatgaagtctaaaagataatctcctaaatctgatcaaaagtgtatgtaagaaatttgtagttaaatcaaggattatcccctttaataaattctgttcaatactgaagattttagccaatgcagtaagacaagaaataaaaggcatatagtgttatattgaaactcctgaagaatcctcagaacagctacttgaacaaataactgaatttaatttagcaaggtcttgggataaaggataaatatgtacaaatcaattatatttctacaagttgcaaactgttagaaaacaaaattttaaaaatcataccctttacagtagttcccccccaaaaaaaccctaaaatacttaggaataaatttaaccaaagaaggctgggcacggtggttcacgcctataatcccagcactttgggaggccaaggtgggcagatcacttgaggtcaggagttcaagaccagcctggccaacatgctgaaacttcgtctctactaaaaaataccaaaaaatcagctgggcgtcgtggtgcatgcctgtaatcccagttactcgggaggctgagacaggagaatcacttgaacccaggaggtggaggttgcagtgagccgagatcgcgccactgcactccagccccggcgacagagcgagactctgtctcaataaataaattaattaaaataaatttaaccaaagaagtacaacacctctacactgaaactacaaaacactccggagataaggtaaagaaagtctaaataaaaagagacatgtcatgtttgtggattgaagattgagtttctttgttttttgggttttttttttttttttttggtttataaagtgtaattttattttatgttactctgctgttacatagggcataacattttcacaaggcttttttgggactacagtcaatgattagcaacacacaatagtgttccaactctaacaatcactagacaaacaggacaccctctcacgtgcacagatctgcatagaaaagtacaaaagttttaaatttagacttgtgtactttaatttgtttcccctttctagtgtattaaaaaatgacatgcactttaatttgccaaaagcaatgttgtattctggcagcaacatgctacttctattacatagtaaagtgaataccagaactacaaagacaggaggtataagtgaatttttattgggaagggaggttgtcaacttaaacagcagcaaataaagagtgaataaggaaactccctgttgccacagatatacatgacctccttatgtgataaaggaggcatttcaatttgtgaaccatagccagagatggcaagtgcgttttcattcagtctaatacttctggattcctactaaaaaggaatacattaagagcatggaaaaattgcttattgaaaggaaaccctcgaagagtaagggagggaatgtagaaattaagttatgtagaacactctttaaattgtaattaactacatttttatatcttcacagtaatacaaaacacagtcacttgcagaactgtttcagattacttaaataccagatacatttttagtcctctacataagtgtgtggaagttacttacgtttatatgaaatgaagctattaatatttttctacagcagtaactgcacaccaggaaggccaagacaaacacaaatcagggaatgaagttttcccaaagctgcagtgtgaaaagactaaaaacagttgactccaaacacatgaatcggtttctttgctataggaaatccaagtggaataaggaatggagatgtgtaaaaaggtttcttgaaggaaagaaggaggacaccctgtatgtatttagttttcagccccttctactgcctcacattcttctcctgcactgtctgatgtccaaagtgttaggttgtctctaagcaattgcatgatgagggttcttgtcggaggtgtcagtcttctgctcaatgttcaagatgagcctccaggcggacctgcagcccccgaccacattctaataaggagcaggttgcgctccttattagacagctcggcgacctacttggtcacagccttcatgcaggtggccatgtcatcgtagtgctctgcctgcttggccagcttggccttcaggatcagctccctcttctccttgacgggtgcagggcagagggcaaagagagcaagggcaagcgccgacccggagcaggaggagtccttcagagcttcacatctccgtggccacaactagagtcccaccactttgatctgccttttagataagtattttttaagaagccacatctccctgaattcatctcgattttaacacaatcccactccaaatcccagccagtttttaaaataaaaatggacaagttgattccagaatttacatggatggaaaaataaaggtcttaaccatagccaaagcaatgttgaaaggtaaaacaaagttgagagctaatttaaagacttactgtaaagctgcagtaatcaagattgtaggtttaggataagagagaaagagatcaatggacagagcagaaagaaacacacacataaatatggccaattccgttttaacaaagctgtcaaggcaattcagtagggaaagaaaaggctttttaacatatggtgcaggaacgaccctgataaacatggaggggaaatgaactttaccccacctcacacaacacaaaatttaatttaagatgatggggccgggcacagtggctcacacctgtaccctagcactttgagaggctgcggcagacagattgcctgatctcaagagttcaagaccagcctgggcaatatggtgaaaccccgtttgtattaaaaatacaaaaattagctgtgcatggtggcccacggctgtaatcccagctactcaggaagctgaggtccgagaatcacttgaatgcttgaactcgggaggcagaagttgctgtgagccgagatggcatcactgcgctccagcctgggcaacagagagagactgtctccactgtctccaaaaaaaaagatgatagaatcatagacctcaaagaaaatgtggaaaaatatctttaaaccatgatatgctaggatttcttgaagagaacattaaaagcactgaacatttttcttaaatgaattggacttcattgaaaagaaagatgtattttctccattattcattgtgattcctttttctttttttaatatgatgaccataaaatgtattacttggtggttgaaatttttcaagagcttgttggggtttgttgaattttttgaaccataagataatgtttttcaccaaatttgggacttttttgacttatttcttcaaatttctcccctttttcttctagggatcctccaatttatgctgataaattgtctcatggatctcactgagactcagttcatttttcttttattctctttggtctccaaatcagatcatttttacttaagttcactgatttagctcatgtgaatttttcattcatctgttgtacttttcagctccagaatttccatttagttctctttgtactttagatttttctgttgagagcctatatatgttcagttgctattagtatatttttattgaattatttcagcatatttagagtaactgctttgaagtcttaggctgctaaattcagtatctggacccattcagaatcagttttagttggctgccttctttcccaagttatgtgtcacactttcctgtttttttatatgtcttactttcttattaaaagctagacatttttaagatcagcagtccccaacctttttgtcaccaaggaccagtttcatggaagacaatttttccacggactggtggggggtcatgtatttgggatgaaattgttttacctcagatcatcaggcattagattctcataaggagtgcacaacctagatctgttgcatgctcgtttcacaataggatttgcactcttgtgatctcatgccacccttatctgacaggaggcagaactcaggtagtaatgcttgcttgcccacccactgctgctcctgctgggtggcccagttcctaacaggccactgaccagtaccagtctatggtccagattttggggacccctcttttagatagtacactgtagtgtgtctgcatttggtttgttctgaatgcttgcctagactaaaactgcagtctctctctcttacttacagtgtatctctctgttcagatgtttccctctaaccctagctagctccctagggggcctcacctgaacttgattagtttagtggtcaacaaatgaattgagcaggcagctcaaatacctcaaaggcttccaccctctgtcatctgagctgtgtgtggattagagaatacattcagagtcacagcaaattgacgtctccccaggctttcagtttttgccagactctgggatattccacatacatgcctacgttagcagtcaggcagggatctggcaagtttattatcaggctttcatagccctcttgcttccagatttcatccttaaatggaatctgtaacctccagccagtaaaactcttgtattttcattgcctaacttggggataatggaaacacccccaggtaggaagaccataaatccacagttcttaccctatgcggtttttcatgagtaaacttatcaccgttggttgttttcccgtgccctgaagttgtttttaacaatttgcccagttttatacacccatctttcttaacactattatcaaaaatacagtcatggtaacattgttttagctgtgtcccttggggccaatatgtagttggacattcatttttattgtggtggtaattgtatttttttaaatttaggccaggcacagtggttcaggcccgtaatcccactactttaggaggccaaggcgggtggatcacctgaggtcaggagttcgagaccagcctggccaacatggtgaaactccatctctactgaaaatacaaaaattagccaagtgtggtagtgggcgcctgtaatcccagctactcaggaggctgaggcaggagaatcgtttgatcccaggaggtggagattgcagtgagccgagatcatgccattgtactccagcctgggtgatgagagcaaaactctgtctcaaaaaaaaataaaaaataaaatttagatataattcacataccataaaattcacccttttaaggtatacagttgattggttttcaagatattcatagtgttgcgcaattgccactaattccaaagcattttcaccacccaaaaagaaaccctatacccattaacagtcactccccattcctcccttctcccagcctctgacaaccactaatatactttctgtctctatagatttgcccattctagacatttcatgtacatggaatcatatgtagccttttgtgactaacatctttcactcagcataatgttttggaggttcattcatgttgtagcatgaatcagtactttattttcatggctgaatcatattctcttttacagataataccacattttgtttattcattcaccagttgatggacatttaggttgtttttggtttttggctattatgaacaatgcagttgtgaacattcatttacaagtttttgtgtggatgtgtcttcagctctcatggtatatacgtaggagtgtaatcagtgagttaatagggtatttctgtttaattaggaggtaatgacaactttaaaacctgatttcagccatttagtaggaaatttaatgcactcacatttattgtgattaccattactactactttgttttgtgttttctatttactagtcttttctgtttcttgggtttatttttcccttcctttttattggaatagttgagcatatatgggtgtttgcactctatctttctgtctctatctagtgaggaaacttgactatcctatttttactttttaaattgttaacaaattaaaacttaaatgtttatattaatgtctacagttgatccaagtctccattcaagctgggaaagaacattatcatgctttcaattattcttttcctagcatctccctaaagaagtcatctggaattttaatacttgtttctcttgtttcttttacctttttacattatgttttaatgattttgcatccttgcctatcaattttactgatttctttggcccaacactattttttgtataacacatctttttcctggattcattattattttgtgggagtacttaaggaattctttcagataggctttatggctgataagttttctgagtccttacatatacaaaaatgtcttttacctggggtgtggggaggggggagggatggcattaggaaatatacctaatgtaaatgacgagttaatgggtgcagcacaccaacatggcacatgtatacatatgtaacaaacctgcacattgtgcacatgtaccctagaacttaaagtataacaaaaatatacatatattaaataaataaataaataaattgaacaggaataaaaaaaaaagtcttttccccttactcttgaatgatagttcaatggagtaaacatactccattgtttactagcttccattgctgctgatgaggattttgatgtcactctgattctcagtcttttgactcttctatctaaaaactcttaggactctctgtagccttcaagttctaatgtttttctgcctagtatttaggaggttttcttttttcttccatcctgcttagtacttggtggataactttctatttgaagatttctgactttatcttggggacatttttatgtgtaattttctcctgaatactcttatttgtcagatattaaaacttctaaatccatccacgatggtacttaactattctatttttgcttctttttcttcttgtactgtatttttggaaagacctcagtaaaatctttcattttcactaactcacattgcagttcactccagttaacactgttaactgtgaaattaaccctaatgatatcatgacagtatatgtgcctgggagcaatgccctttctccacatatgctgtgttacaatttgtccagaaatgaataaatatagcaattttcagggtatgtgcattctttgtgtattcaacaaatctaaagatagaaactccttgaaaaattttaaaattctctgactataatgccccctgtaaattagtacccaaagacataggtctcttcccccccaatttcttaaactcctgatttcctcagatgttatcctcctttgttgcacgtatgtctcttcttcagagtgatgagtttccttaactggtgattttttttttttttggtgttttactcatctttgtgttttgcagtccatttacctacttgagtgttgagtagcttactgccaatgattatgagggagggacaggacaagctgctgaggggcaggagtgctgttgcttgtcttctggtgtgggtattctctccttcccttctgagagttagcagctacctgtgacattgcactgctctgcagcccagtatgcatccttgctgctttagcctgtgaatatatgcctctgttgactgctgcttagcacaaacctgggaatggggagggcctgattgacccagctgttccacatgcaactcaccgattaatcatcctgatgtatgtctgagtgcccccaaccttcagctgtctgtgtccactggctctggcttgaaactcttccttaaccactcctacttttgcagatgtcttattgtacatctggcttagactatggcttccttcagttactgcctccctgccccaccattcaattccccacccccataaatataatctcgtctgattctaggagattgctgatagtctttccttattatctcatgcatttatgatttatatttgttaactgtaaatgtcatttcctcagaaagttttttcctagccacccaatttaaagtaatttctcactttctatcacatcacctcagtttattttcattgtagcattcatctctatttaatatttatggtcttttgtctttccagacctaaatgcatactcctttaggagccttatatgatctatttacagctatatcataagtggttagaacagtgcctgatatataatagacattcagtatatgatagttgaattaagtgactttatcttttttaaaaacattatatgtcacatttgcttgaattacataaattttagattttataccagaaaccaggcttatcaaatattccatcttaacatctctgtcaagacaaaaaaaaaagaaacatacctttattaaccaaatagttttctttgcccaaaactatgcaattaattggttaaataatataaaatgcaaagtttcttaacctccagcacttcaatctatatgtcattcaagcaaagcttgggggtgaaataaaagcaaagctttgatttttctaagaacaatattacaaaatgaccagaagttagaattatgtttgcttatagtttctatgactatgtgagatataatttattctcaggtaaatcgttaagttgaaatgcatcatattcttatgccatgttattatggagctcctttagcaaattcaaatttccttaatggaatttccaaagtcttaggttaaggattcattctaccagataagatttttactttttttccctacatctcttaaattttgtagcttttgatcaggtggctgatcaacccatatgggacaataatgaacagtttttcagtttagaaatattattttgagggttaatcccttcattaaatttaggttagaaaaatataaaaatgcacataggtagtcatagtcactgcttacatagtaactcctccatgaaagaaaagtccttgtctaggcaagttttgagttggcctcttttgctgagtctattttttcagtccccatatataaaattttgtaactttcttacgttctacacagagatcaaatttagtcccagatttttccttgaaaatgttttaatattatatggcaaagaaaagcagtggtcactttagaagacaatcaaaattcatctgttccatgaaacaaatatttatatatatgccatttgtaagtcttctgtaggttatttacactcctaccatcaagaggatgagcttaaaccctacagaattaacctctcatctttataattctgatggaaattactttaattttgttttactttttttattatttaggcaaagatgcaatctacacaatcccagtaaaaaacattcttgctgtggaaaaactggaagagagctctttcaacaagaaaaatgtaagttatgtaaataaatatttaaagctttctgaactgcatatattacttaagtatttgtatttcgaggtatttgttaataccttgtatttgtatcacctattacttagatatttgtattcaaattttcaagaagttgtttattggattgtttactattaatcattaatagttcataaatagctagctgaaactctgtcttaaaattgtcctttattgttgatgcctcatatagcttgcctagtttgttaagttaaaaatacttttctcaagatttccctgttatactgctgtacatgatattcaagtttctaagtaatacagtcccaagctatctgtccagctttgtcttctgctcccattcagtgcataccatacacttaagccaaccaggatgatttccttgttcctaaatatttttctactgctttttctttatactttttcttccattaacaattccctccctttattcttatctatatgatagtccattcctttggatatgtgtggcttctaaaacttacattcttttgtactgcttagtaccatgtgactcagattatgcttgggactaacttgcttgaaacataataatttctaagacatcttagcaccagttatctagccaagcaactagattcctttaggtacttttcttctgttttgtactgtgtgttggtttttggactcttgtcactaactttttatcttaattgcctatgaagatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcgtaagtttctttctgattataaaagcagtgtgtcaaaatttgatatatccatgtaatgttaatattatttgtccatgaaaaggaatgacatactgatccatgcaacaacaaggatgggaccttgaaaaattatgctaagtgaaagaagtcaatcataaaggccacgtattatctgataacattgatataaagtgtctagaataggtaaattcatagaaacacaaagtagattagtggttacaagggataagaagggaggaatggggagtgctattggatgcagagattcttttaggagtgaagaaaatgttccaaaattaatagtggttgcacaagttaaaaaattttaaggcaatgtttaaatagaagcatgagcttgaaccaagatatcaagaaagaaggatccttagcattctctttctaattgtatggaacaaccattgtatttctatagacttaagtaataatatattgttttgtgatgaagcataggttgtggaaatgattttactttaaaatttccctccttctgattagagtcacataacaaccaaaactctccttggccccactttattttaactgtcaaatgaaactaaatttccagacttccttctgcaaaagtctgtggttctatttttagtctcaaaccatcagaagtccttggcatgttaacaaaataaaatttgtataatatctttatttttttatttttaccatagaggtgtccctgcagacatccaaatagatattgatgaagacagagaaacagaaagaatttattccctttttaccctcagtttacttaagctgcagaagatggaaggtaaatacacaatctatttttatataaccataatctttcattaccaattcctaaagtattgctttagcattatacaaaagttgaaaatactcatagatttaccaaaatgttatttattgaaagttgacaaacccacagagaggcatttttcattgacattcatgaagtaaaaatactgtttttgcatgaatgtgatgatcctaataaataaaatgtatatattttagttatctcggctctgccaagggaaatcccctcagcataagacacttgaaaaattcttatttgtactacatattgcatttatagaatttagttgtctgatcagagatttattttcctgctctttgtagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaagtgagtaatttttaagctattgtaaacatatttttaaacggagtttgagattgcctctcctgccccaacctcacacctcctgctcacccacatctgtcaacatcccgctcagggccattctctggtgcaagtttccctggccactccaagtgctctttgtgttgttcagtttagccatcatttcactgtgttggtgctatactttatcgactttttaatttcatatatatgtatatgaaattatatatgatatatgtatataaatatatattttatatatatttatatttatatattatatatttatatttatatattatatatttatatttatatattatatatttatatttatatattatatatttatatttatatattatatatttatatttatatattatatatataaatatatatatatatatatttagtttttgtagagacaggttcttgccctgtcacacaggctggagtgcagtggtgtgatcataattcactgtaacctccaactcctgggctcaagcgatcctcccatctcagcatcttgagtagctaggactacaagtgtacaccactgtgcccagctatttgttttattttttgtaaaaacagggtctcgctatgttgcccaggctggttttgaattcctgacctccagcgatcctcctgcctcgtctctcaaagtgctgaggttacagatatgagccaacaccaccaggctgtaaccagttttaatgttacattcagttgtaattcatttcttgaatacttagtagctcttcgttttgtttttgtttttactgatcctccttctacagtacataataagaattcacaaaactcacccccaaaaaaattaagctgtaaaagtgctagaattattttatagttgattttttggaccacttcaggtgtagatggatactgcaatggataacaacagcaacaactcgcatttattgggaacttactccagcaaggggcactgtgcttatagtactttacagcttatgtagattgcttttagaagcaagttaatgaagtcccaattgaggtggcttaaacaataaaactatttactcttgcaaattaagtagttaacttctacagttggttaattcagcagctcagcactgtcatcaaggaacacctgccactcagccaacctcaacaaggtgatttctctcctcctcaagcttgttcccccatggtcacagatgagctgcaataattcagagccccacatttttatatgatagcatccagaggcagaaaaggctgttttctccgtactaggagaaaggaaccttctctagagttacccccagctttccctgaaacacatggctacccagtggtagagcagaatcagggtctgttacaaagaagtggatagggcggggatgggtcttgggccagcaaggaacagtgtttgccacagtgaacactcattgatcctcaaatcagcccaacttggttttatcctcattttacagctagagaaacggaggcttagggaagctaagtgccttgcccaaggtcacacagctgacaagtcacactgctgactagggctctgaatcctggccctaccactttaaatgttctttgaaaaatatgtgaattaataattatattttttattcatgtacaataaaaatcaatttgacaagtataaatatttatatgttcttcctagatagatgcctcaattagaaaggttattagaagcatcctaatcctgtcttttctgtattaatgtaattggttctcttccaacagtagtaatccagtttccttggagccctgggaagtttccatatgagatcccagacattctttcttaaatagtacctctccactcatacccatacacaccataccacttcccagctttatttttctctattaaaaaatatcaacctctaccatactaaatatcttattaattttatttaccctataccagagtgtaagttccatgatggcaagggttttcttggtctgttttgtttactactttatctttaagttctacactagggtctaagattgaataggtggtcagtaagtactcattgaattaatgaaacaacatttggcatgagagattatccagggaaaattctaaatacttaatggattatatatttgtcaccctttaaatttttgtatttcttaaattttgaaaaatgactttttttcttctctagggaaaatccaattgttgggaaagcatcttagagtttaacagattggttcagaagaactggaaaatattatttttcttggagcttttcaattcatcatatattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaac

SEQ ID NO: 17196 - DNA, 118143 bp, Human
taaatgtatcaatcaatgaaaattaaaagtgctcagctaagccctagcaatgccttcaggacttgatggttaccagtttaaggaaagtcttgaaaatggcaggaaattcaattgtagttgagtttgcacattaaaaaaattgctctcctagtttcagagttaaatattcagccagcccacagaaattggaagtcacagttatagacgggtcacagtctgttcatgttgatagtctgttaacaaaatgtagaagagtctgcaagcaggtattcaaaataacagctcctcatagccagccatgtcaacgtggtttacaaacaacagtggagaaagtctcaacaaaccctctgagggtgataactgtaatgatggttcgtatctttgccctatgtaattttatgggaattgagagtctagccaaataataagttccagccctttttatctgcccagttcccagcacactcccgaggtgtctgaggcacttctcaacccaacctcttaaagcagattgtaacaataacaacggtaatgacaagttcccgagctgcacagttcccttcatttaaggagcgctgggagcttcaaaaaaacactcattaatggaatctgacaaagcttgcaagatgggaagtctctcccatttccagttttctggtggaaaagtggggactgagtcccagaggggtgtcagtctctctcaaggggcttgagggggtagggggtttgggagtcctgggctaccattattccatgaaattcgagagtcaagagtcccgggttctggacgcccccttccccggcgtgctatttaccaagtcgcttcccatttctgggccccagttcccttaatagaaggaagggttgggccaaatggtctccaagatctctgcggtcaaccctgtctttgccccctcacctcgcggttgggggtttctcccgcttcagagttcggttagacttgtagtagaaccgggtcgggggtgggagtggcgtcgaggggttggagtgttgcggatgcgggaaggaggatgcctgatggggtcctggacaaactggtgtttcacgagtaccgtcctatgggaagcaggtctggggagaccaggtgaggctctaggacgagctcggagccccaaatccccctgctgcctgcagcgaaacaatgcgagtaatgtgccttccccgcccagcccgggagctgcgcggataggagcgtccgcgggtgcgggatggcagcggggaggcggatatcgcggcgggagggctccgcgcggcttttgcccataggcggcgggtcaggtggccgcgcgcaagaaggcctggggctcagacatgggcttcgggacaagtcccaggccgtcccgttccccagaacctgggcccttcagcccggagtagttggccttccctttgtggttggggggcggtgggctggctccccgcctccgaggaggaggggaggaaggaggagccgggtggggcgtgtcacgcgaaggagcgccgggcgcccggtgcggccccctaggaagtggatttggccgctccggatccaacccggcttccaggttttctcccggcccggcccagcgtgctcccgcctgtctccggcccccccacgacgcccgccccctccccccgagtgccgcccgcttggccaagtttgcggagcgtcgccgcgcacgccggccagtcaatcagcggcagagctgagaagggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtaggtgggcacacccgggaggtgggcgcagagaccgacacttcgggaagggaggctgcaactcccttcccccgccccgccgccccctgcgccggacgcaggtacactagagggagaaatgggcagtcgagagggcaggagcgagcgagcgagagagccaggcagcccgggcgcaggacgttccccgcgggcgcagcgctccccccttcccagcactgcgagcggaggggcgccgccgggttgcccagtgcgactgtcgcgctccgctccccgcctccgctcctcctctcccccctgcattattcgccgtcccgggaagcccctgaggactgtggccctcaaagtgcgtgtcaccggctacttctccttttccgggttgaactccttataggacgccccgctttgttgtatgggtgaggagaggccgggtgggggtgggggtcgccagtggggtgtggtggagggaaacgtcccggagcttgctagattctgggggtcgcaaaacgtggaacttgaattgatgtttcattgatgttcttttaaaactctctccccgcctctcttgcaccgctgacaaggattaggagttttagtagccgcaaccgcttcagaagtcgcctttaaaaagcaaacgactacccccactctccacccctccaaaccctgacttttgggaactctcctactttccggaaggtatcagaccagaggagtatttttcccctctttcttttttcttacctcattttaagggttaattgcactttcaattacagacctttgaaaggactgattacaggaaacctgaatctcagtttggagatggttatgcaaatagagacggcttagcctgtgagaaagttcaccggattttggcgccggtggggtgggatggggggtgtatgggggtatttgtgaaagcccctctcggagcgctggggaggcagcgttcggcgggtgccctgcgtccctcccagcgaagctggcggcggtgtccggccgggtcccctccgggtcgcactgtcttcttagcagcggccaactgttgcgcgcagccccgccggccgcgcaggtagcccgttcgccctgggggctcagaaagcaccacgaatctagctggctggtggccagcgtaatctaacggaggagtgagagattcgagcccggggggggggctgagcctccactccgaacctttcatggaagtgagtggagcgcgcctttgccttgccgtgctggtctccgggtggggcgggcagggggccggcagccagcaaaggaaatactgtaatttcaaccaggcgcttccaaaggcttaggaagatttgggggtcattttttggaagggctattaataaccttggagattaagtgcagtcatcaattacatattaattacaaaggtaattgagggaagttgctgggcacttttggagtgtaactggcgtctgtctagaaatagaagcgaagaaattgttggagcagcccaggcgcccactgcaccttggcagttaccaaataacatgctcactactgattagacactgtttgcccttcagctgcctgtcttttggggagctcaagtatgtcctcaaagcggcacgattttattggttgtagagccctgaaaagccctctttctttcccttcctcctgccccgccagaaaaaaaatgaagtgaaccaccagccgctgaagcttggggactctgcaggtcaaacctggggtctttgtgccctgcacagtttaggcctgggcacagcggagatgattggcgtgaaggttacagttgtcattcccacattttgaaggggtagatgcagctctgcacttaatgggaatgtgacaaggtttcatcttctgctcatgcaaacaatatgtgcctttgatattgactgcaggcattcagcgagtggggttgtgaaactgccctccccagtttccccaactttgctctgtgcagtctttcgctgtggcagggcatcttccccagccagcatctcaggaaaaaggaagcttgaagggtgctcagagactctgtgctaggtgttccctttgattgtcatcatccccagaaatcacctgagggatattttgcgtatatgtctatctggacattcccccatgccaaagataggggagttattagtgaccagcagcaggaaatggaagctaatgtgctcacacccaaaacattttattctttttgtcttgtccttcatctccctccctgggctgctgcttttatttccccttttgaatgacctactggactgcattctcctgaggaacaaaggaagtgcctttttagctggaatccttggaagaccaccaaggactttagctcatgcagtgcaatttcgcaccactttcaacaataacaaaaatgcatgactgaatggctcaaaaatgtggagtgttagaggcattcatttgagtctaggacactgtcacaacacagacagacccaagtaaatacctttagacggccagtatagaaacaggcgtaatctttaccatcaccctggcctctccagatgcatacattagccttgtcttctctgagctacactcagataattttggtcattttttaagggggatagtcaatatagtgacttgtattcagcctaggtctggatggattaattgccaggcactttgcctgggatggggaatgtgcttttttcagtgcaaaacacccaggatcattttccaggtgaagtatcacaaagtctgggtacctagctcattgagccccaggctcagcccaagtttaatgttttattccagatggccttgcacttgccttctagaggtttgaacaggctttaagaatactccatgttctggaggagtctcagtctttatagatcatagttaggatcatctgatgtgctctcaagggtgtcagggagtacatcatgctgacagggcttccaactgaggtcctgcattgcctgtctgcttgacccctgtacttttcaaataatgctgagtccaggtgccatgatcaaaagggatctttaacacaaagattatgtttttgttcagctttcaatggccatgtacttttggagcgcccactatgtgcagtatcctctgctcagcattgtggagacagcaagaaaggcaggaggggcttctgccaccaggacctttcctattagtaaggagataagccacgcacacacaaaattagaatacaacacagtggtgataagtgccatacaagcgatacagatgacgagaagggagtgcccaggcatttcaaagagagaagggatttaggactctaatactatagaatattaactgggtaaagctagttcactagtaaaaatgaaaatactaatgaagataagtttaaaaatctaaccattttcattatgcctccctccataaagacaaaggtaaagggtatgcaacaatgggcattttattactcatctatgttgaaattgtttttaagagtgaggcagtgggttagaagcattcatgaacttgccaaaggtcctcttcacaatgacattgaatgatactcagaactttgtgccctagttgcagttttggagtttttatttcttgttcccttctgtgttcatgagcaatgcacctatgatcatgtgctcacacacacatacatatgtacatgcacaaaggattccaggactcctataagctgttatgactacgtggaaaaaaagtacgtgtgtatgtgtgttggagaggtagcaatactttctaatagtgagttgattatatatgacacacagcatgtgtctttaagatttgtattccgccttccccaccgtaagtaatgtgttggattttgcaatgaatctgtgatctcctgttttgttggaatcatcaatttggctctgtgtttcacttggggagggtcgaattgagccacagggcctatcactgtagaaattgtcccaagtagtttacaggaggtatcttctggacatgttcaaaaaagaatttagttaaagttctggcttatgcagctcagtctctggttagaacatataaatataaaatgtctgattcagcataattactgttttccttttttatttgattcacgttgggttgcatgcaatttcaggattaactggagactagactgaggaatgaaaaaggaagttttttgttatgtgtacaagggaaacaacattggcgttaatctgaggcagttggaagtgagtctctctggctccccaatgacattaactgttttagcactgaggtttttttcttatttatgtttttaaaaatgtattttggcctcatgataagagttcgtagctattgaatgctttctctgggcctggccctataccaaggaacttacatgattgtctcatttaaaacccacaacaaccatatgacatcagaattatcatctccattttatagacaagaaaacaaattcaaagggattatgaaatatgttcacaatcttatagctaatgaataacagaggtgggatttgaacccaggtcttatctgttctagagtatagttcatgctatgttgtacagatagtaagacaagaaagtaccttctctattcccatagaggttgttgagatataaagtatgggaggaccctcagctaactagtaacagaccatcatcaaaacggcacaattttcgtgttatagtggagaggatccagtcacatcttttgtagacaaaatgtcaaacccagacatagacaatctagtgttaatggtagaaggaatataaattgtatttcctggacaatacaattgagccaatgagggtttctgagggaggggaatgtcgtcagtcaagctgttttaggaagataactagtggctctttgggttaagggttggcgaggcaagagataaagacagggaggtctgtcagcagactctttttaaatagttcttaactggtctacctgcctcttgtctgtccccccctcctaaatccctgttctatcctgaacatcgccagcttaatttccttacatcactgctttgattagagttattcctgtgctttgagcttcagtggctccaagcatctcaaatgatacttctttcattgagtcacttctgaactctccagggttatgtgcccacttcttcctaattccctgttggaaccagtccatggtctttgtacataactgccttgtattatagttaactgtgtgtgcaggtacgtgtttgtcttctcaactggaagcaacttgagggcaaagatgacaactcctcgtcttgtctgtgggtagcagtaccaagtgtggtaggtcagtgcaatatttgttaaacaagtgggagaataacatagccaattctattgtgttctctgtcagacactagtgctacaatgagattatactgccttgatgatagattgtcattccatggtctgttgatctcctaggaatcttttggatctaaacactttttttttttttttttttttttttttttttttttaaggcagggtctcactgttgcccagactggagtgcagtggcgtgatcttgcctcatcgcaacctctgcctcccaggctcaagcaattctcctgcctcagcctccagagtagctgggattataggcatgagccactaccgcctggctaattttttttttttttttccaagatgaagtttcgctctgttgcccaggctggattgcagtcgcgtgatctcggctcactgcaatctccacctcctgggttcaaaggattctcttgcctcagcctcccgagtagctgggattataggcgtgtgccaccatacccggctaatttttgtatttttagtagagacgtggtttcaccatgttggccaggctggtctagaactcctgacctcaaatgatccagcctcccaaagtgctggaattacaggcatgaaccaccattccaggcctgtatctaaacactttgaagtgaaataaatttaaagtaaatatgcatatgttggtatagcttggagaacgtttttattcttttgggggagtacttgtctttaccacttcattaataactgaatgcttataggatttttttttattttttgaaacagagtttcgctcttgttgcccaggctggagtgcaatggcacgatctcagctctccgcaacctccgcctctggttcaagccattctcctgcctcagcctccagagtagctgggattacaggcatgcaccaccatgcccggctaattttgtatttttagtagagatggagtttttccatgttagtcaggctggtcttgaactcctgacctcaggtgatccacctcggcctcccaaagtgctgggattacaggcatgagctactgcactggccaggaatttttcagaaagattcagaattgtttttcttaatgccttgagatacacttctttaaagaatgaacagttgagactgttgtgattaggcaatttagagcaaatttaccacatgcaactgttcagtgtgcatcagttaccttttaacataaaaaaactcaagtttattgtctttaccaagaagaacacaagctttgaagggtatcagaatattttatataaataaacagacatactaaaatacaaacaggtaaaaactagcattttcaaatctacttggttaaacatctgttgcttactatagagaacatgaaagtgcagaaaatgcatgaagcgattccatcctggaggtaatttgaaatattatgtttaagttctgatgcatttaattcagcaatctggtgggagagaaaaatcaaagagctgcatcagccaggtattcaacttttgagaaagaaactctaacaaatgttagaaattaggggaaaaaactgaatgggagagttaaaaaagtcaataacctccaggaagcctggaaactatgtaaaaacatcttattggaagcccagataaatgtgtgccagacatcaaaaagaccaactgctcgggggaagaaaaaaagaacccggcatgactaactggcagagtaaaagaggctgcttcagggaaaaaggcatctttcacaaaatacaaagagtttaagccagaagagggaagtccactaggtttcacaaggcccaggtacaaactagaaattaagtgggctgacagagaattgaagttgaatcttgcaagggatttgaaagatggcatgtgtgataataatggtgaaaagggtgggttgagtccaacctatctagggagaagcaatatggcttctttaagggtaaaccatgcctgattgatctctcgggattctttgtgtggaaaaaaaagcatgaggatacagggaagcagacatacatcatttaggtttttaaaaattatgcaatgggattctaaggcaaagaatattcagaaaatatatttactttgagataggtggggatagttggacagagagggagagtgagggagggaagagactccactgttgtagatggagtagtttacatggagaagacatggcttgttaggatgagtagttctagcctaactctggcaaatttgttgtcaaatacctttggtgaggttcttccctctttgaaaaatggggtgaaattgaaccacctggcacctgaggagcttttaaaatatactaatgcctgggtaccaccccataccaatgaaataatacttttttcaggaaggactaggccatgatggatggatggatggatggatgaatgtgtgtgtgtgtgtgtgtattttttttttttgagatggagtcttgctcttgtcacccaggctggcgtgcaatggcgtgatctcaacttactacagcctccacttcctgggttcaagcgatccttctgcctcagcttcccgagtagctgggactacaggtgtgtgctgccacacccggctggttttttgtatgtttagtagagatggggattcaccatgttggccaggctggtcttgaactcctggcctcaagtgatccacccaccttggcctcccaaagtattggtattacaggcgtgagccactgtgcctggcccatggtagttttttttaattttcttttttttttttttttttttttgagacgaagtcttgctctgttgccaaggctgggtgcaatggcatgatctccactcactgcaacctccgcctcctgggttcaagtgattctcctgcttcagcctcctgagtagctggaattacaggagcacaccaccactcctggctaattttttatatttttagtagagacagggtttcaccatgttggccaggctggtctcgaactcctgacctcgtgatccgcccgcctcggcctcccaaagtgctgggattacaggcgtgagccagcatgcctggcctaggtcccttccatctctgagattctattattctaaattttccaatgagattcatcacaaaatgttgtttgagataaagcctttagtttagaatcagtgcatggttgttttaattttggctaacttggatttaagagaaaggtgtgtcaaacatggaggaaaatgttttcaatcaagatataagtgtgaaccacaactgagtgctgctttgctgcaggtagagacataagacaagcacaatgagaatactttggaaagaattagaacagaatccagccttgctgtcatttattgattaagtgtcaacatgctaggtgatatttcttccctttttctttattggtaaaattaaaataaatctctttatcccttactttaatgtcctctttgccatgtgtttattctcttcaagtatcttatcaagaaatagaagtacagtaaatccctaggcttctagctggtgcaaccatccagaacacagctgggaatgtggaagtaagcagaaaagccaaatgatggaaacagctgtcataaagcccatgcattctatgtggagaaaaggccttcagaaatttattatcagcaatcattgaatggctcctgtatccagagcagtatgctgggtgcaggggattccaagaggtgtcaagcaggaatcaagcttttgaggaacttgcattcaaattaggtagatagggtttatacgtgagaagataaaatgctttggttatccagtttcccagtctatggcagattagaagtagcaaatggtattggttgggggccgatgggaatcacaggaagggatcgtgttagaggcaggtaagacttgacatctggaagaagtgagagaggacagttggagggtgaccagaagctgaatgggagagccagaacttgctgatcttggcagtttgagatctcctagaatgggcgaatgctcaaagccacctttgtaaccataatcatcgagggcactagtatatttcattacagtattaaataatggtgtttggcttattctgatttaaaagttcagaaagtacattttagaaagagttccattactgggcacggtggctcacgcctgtaatcccagcactttgggaggccaaggtgggcggatcacctgaggttgggagaccagcctgaccaacatggagaaaccccgtctctactaaaaatgccaaaattagccaggcgtggtggcacatgcttgtaatcccagctactcgggaggctgaggcaggagaattagttgaacccgggaggtggaggttgcagtgagccgagattgagccattgcactctagcttgggcaacaagagtgaaactctgtctcaaaaaaaaaaaaaaaaaaaaagagttctattggaaatattcaaaatatgaaaactacccttaagggggaaatttagttaacttacacatttacctatctagagcacccagtttcccaacagtgctggatcaacaaggagtcaatctacgtgtcactttgtctttttattttaaaaaatgtgttaaaaattgtatattattaattcagtggctttttcacctcagagcttgtggtttatgattttgttcctctgcacctttttttttttttttttgagacagggtctcactcttttgtccaggctggaatgcagtggcatgatctctgctcactgcaacctctgccacccaggttcaagagattatccctcagccttccaagtagctgtgattataggcatgcaccaccacgtccagctaatttgtatatttttagtagagatgggctttcaccatgttggccaggctggtctcgaactcctggccttaagtgattctgccttggcctcccaaagtgctgggacaggcgtgagccaccacgcccggcccctctgcaccttctttttttttttttttttttgaggcagagtcttgctctattgcccaggctggagtgcaatggcgcattctccactcactgcaacctccgcctcccgggttcaagcgattcttctgccttagcttcctgagcagctgagattacaggtgtgccccaccacgcctagctaatttttgtattttttagtagagacggggtttctccatgttggtcatgctggtcttgaactcctgacctcatgatccgcccaccttggcctcccaaagtgctggggttacaggcgtgagccaccacacctggcccctctgcaccttcttttgaaagccctctagaacatctaggttcaacttagtttctgatactgtactacctgctgtggtcagtttagggaactgagttttgacctgaagtcaacaacagttggttcctcgttaagggtgacacatttgaatactggtttcccttgtaaacatttaccaaactaggtaaatgtataatcataagaaacactagaagttaaggatagtgtctgactatgtagctatttgaaccttaaaaaaaagcaaagcttggctgggcatggtggctctcgcctgtaatcccatcactttgggaggtcgaggcaggcagatcacttgaggccaggagttcaagaccagcctggccaacatggtgaaaccccttctcgactaaaaacacaaaaattagctggggtgtggtggtatgcacctgtaatcccagctactcgggaggctgaggcacaaggattgtttgaacttgggaggcagagattgcagcaagccaagatcacaccactacaccccagcttgggcgacagagtgagactctgtcaaaaaaaaaaaaaggcagctctatgtgccctatcatgccagatctgagaaaccatgtatccccagttcctaacatactgcatggcatgtggtaggtgctcaggaacgttaagcatgactttttgtttctgtactcattccaggacgagatatttttattcatatctgctgtgctcttactctattcttctaaaattcatatgttgaaatcctaaccctcaaggtgatggtattaggaggtggagtctctgggaggtaaaccctcatgaatgtgattagtgcccttataaaagaggccccagagaaaaccgttaacacttgcgccacatgaaattacggtgagaagatggccctctatgaggaagcatgcccttaccagaacccaatctaccagcatcttgatcttggacttcctggcctccagaactgcaagcaataaatttctgttgtttagaagccacccaatctttggtattttgttttagcagcccaaacaggctaagataaccctttttaaatctaattattttaagctatctcatttatttttaacttttgcatacattcagtcctagatgcctaagtaaggaaaggaaaaggaaaacatgtttttttaccccttaacctagagcgtggtgctctttcttggcttgcttggaggtgggcgcttagtatttcatgtggtttgttttaatcccggtagacaaatggttgctacttcttacgctgtctgttccagacattagcaggaacttggctgtgcctgcagaggtgctttttctttctttcttttttttttttttttttccttttgagacgtagtttcactcttgttgcccaggctggagtgcaatggcataatctcagctcactgcaacctctgcctcctgggttcaagtgattctcctgccccagcctcctgtgcagctgggactacaggcacccgccaccatgctcggctaattttggtatttttagtagagacgggtttcaccgtgttagccaggctggtctcgaacccctgacctcaggtgatctgcctgcctcggcctcccaaagtgctgggattacaggcatgagcccccacacctggcctcagaggtgcttttagaagaggctacctttgcccctttttgttgcatcagcctttctactaggtgctcacttccgtcttcttctcctggaggtttgggtcaggacttgatctctgcatcatcgcaaccattcttttcatgctagtcctttctttgcaaagccactttgttagtttggcttttgcaggcctcttaaagcctgtcttctttcttctgttcaccttctgcctaccagagcaggctggaagtggtttcttttggactgtagacatttccttagttcaccaaacccttgacgtcatcatcccagcaagcattaagccaccagaatatttttttttccttcagttattgtttctatttcaccacacatttgtctccattgagttttcggtctggtgtttggtcagagatgaaaacaaagcactgtgtccttgcaaactgcagtgtaaagcatgtggttagcagttactacttgcagtggtccagtctgagtgggagtatcatttttcttggcagtgacttcacagaaagtcctgttttttggtgccagagtaagcagtcattacattccttacaatttatagtcaaattattatctactattgtttaaattgccttaattatagaagatttccctgtgctaagattttaaaaagcaaaataagacaactttttaccaatgtactttagaaatggtccttaaacatcacctgtcaccaggatgttggaggctatggtaaggattagttctttgtgtttatggggagattttttttaaaggggagtagtgaaatgagttcactttaaactgaatttgaattaaatgcccccagctggctggttggttaatgttctgccttgttgtttacccacagtttggaactaacttttctttctgccctctcagatctgatgggcctggacacattctgggaggctcttctggtatgaggtcaatggattattaagcagtgaggcagtcttagaagatgttcgtgtattctttaggttggagagcaaatgatgaaataacaaccttccacaataagggactgcatcaattttcttgtaatctgaataaagatttaggtgactggatgggatatgtttcagcttagctaatgtttcataatctctacctttgggctctgctttcaagatatatgtaaaatttgtcatcttaccatctcagtgactactatcctggtctcacccctcattacctcttgcctggattattgcagtcgcccatatcagttcccctgctctagctctctggctctggctctccccagcctgtgttctcagcatagcaaccagtgtgatggtattctcttaaacttagatcgtatcactcctttgctcagaatgctccaatggttccccatgccagctagagtgaaaatcaaggcttatgagcacatctgccttctcctgtgccagcccacgaggtcttctcttctcaggctttatctttatccaggtcccatcccactctagccatgttggtctctctgttttccttcaagcacaccaggcacgttcaggggcctttgcacttcttattttcagtgccttgaacaccctgctgccagatagcagcatggttcactccctcacatgtttcagggctttgattacctatcaccttaatagagaagcttttcctggtctctgtataaaataggatactcccacccccccaccccctgcagacacacacatatattcatatacttcgtccttcttcctctctgctttcttcttcttagttatcaccacctgacctgtgggcaggggctttgcctcttttattcactgccctatacccaatgcctaccacattggctaatactcaaaaatgtttgttgaatgaatacatgaatgagtactccttgcaaataggttgctcttaggaaaaaagctttcagagggcatagttgactctttaggacttgtgaatatgagattatacatatgaactcccatctgtagaaagggggtgcctaaactggattcattcattcagcagatatttagcaagtgcctattaattgctaggcgctggggatagaacagtgaataaaaaggatacaagccaggtctcacacttatggagctcacagtctaaatggtgaggcagacattgattcaataattctgaaaattggtaattagttacagttgtgataactacttccaaggaaaagcccttggtcttggatgtggggtaagggaatggcaatcagggcaaagcatagttttcttgaacattatgggcctataaggccttctcattttctaggagtagtgctttttacatcatcacaagctcccgcccccagtgaatggccagggtttgtgtttctggcagtggatcctgagatgagtcctagagcacttgtgcagtagtgcagggaagataggcccgagttatcttggcttacatggaacactttctctggttgcatattgtgaacaaaagttctctgaaaaggaatttggaggaaaaagacttcattccagtgaacagtttgtaaactggggagacacatccttcagtgtaaaacaaaagtgcacattccagagaccaaagagaggattctggtttctggttgtttttgttttgggacagagtcttgctctgtcgcccaggctggagtgcagtggtgtgatcttggctcactgcagcctctgcctcccaggttcaaacaattctcccaactcagcctcccaagtagctggaactacaggtgcacaccaccactccctgctaatttttgtagagatggggttttgccatgttggccaggctgggctcagactcctggccccaagtgatctgcccaccttgggctcccaaagtgttgggattacaggcgtgagccaccgagcctggctggattctggttttagtgcaaaagttcccacctaggttcctaagcaagtgttatgcaaatgaaagactgaaatttgcttaattccaattggttgactcagctgggccctgattggttgatacaagtgagccctgattggttggtacaggtgagctctgattggttgcttcaggggagttctgaaagtcccaaagttaaacggaggtgggtgttttcaggaaactcagaggaagtatgtcacctttagctagcaaatgaccacttgattctattttaaatttaggcctagttaaccacttgggatccaccttgaaggattggctctttcaggttcacatttgtttacaatactgtggccatcattttaaggattgggtttacaggggcactggaaaatgcaaagttaacgcttgtgtcactttgcactgttgttttctgtcctctaggtggtctgcaaaggtaccagacaattagtgctaaagcctttaggcttttatgaaaggtctgagtccgctctcattttcatagagaccacagaaatactgtcatttgattggtgggtggctcaagatgaagccccctggccttgcaatagtaaaactctggtttagcaaaatatggatggaatgcatctgtcaattggtgacaagattccttcccttgccaagcctttatcaatggtgaccgagtgggcaggttgtctcaaggagaggagggtcctggctgtgcagggagcaagtgcataggctggccagggagattaggattgtaagcaaatgcagcctgagtgataagtcttagcagttatcaaaacaggatgggaaggagccttccttgccacatgctgctgctctgagaacagagtcttccgtatttcaagaaagattgttttttcagaattttagatgaacactgtgagataggtccctatttcttttttttttttttctctgagacagagtctcagtctgtcacccaggctaaagtgcagtggcacaatcttgtctcactgcaacttccacctcccgggttcaagtgattctcctgcctcagcctcccgagtaactgggattacaggtgcttgccaccacacctggctaattttgtatttttagtagaggaagggttttaccatgttggccaggctggtcttgaactcctgacctcaggtgaactcacccgcttcaacctcccaaaatgctgggattacaggcgtgagccacggggcctggccagtagatccctatttcttagtttgttcagaaattcaaagtcctaatgaggaaccctgaggctggggtatgtatagagacactagctcggatgcctgacaattttacctagaggtacatgagtagctgtgacatcccagtgtttctgggttacaagcaagtatttttagctattttctaatgtggacccctcttctgaagggcatactacatagccatgacaaaggctgaagtcccaagctctccatttaatgcagtgaactgactgcattgttgtaaattgggagcaagtttgtaggcaaggggcaagtttgcttaaatatgaagactaaggtgagccctactttaaatatgaatttaaatatgaagattatggtatatgccctattttaaatagtataggcttactatattttgtttgtttgagaccgagtctctctctgtcacccaggctggagtgcgatggggcaatctcagctcacagcagcttgtgcatcctgggttcaagtgattctcctgcctcagcctcccaagtagctgggattacaggtgtgagccaccaccacgcccagctaatttttggatttttagtagagacagggattcaccatgttgctcaggctggtctcgaactcctgagctcaggtgatctgcccgccttggcctcccaaagtgctgggattacaggcgtgagccactgtgcccagcctcagcctactattattataagggtaagttttctgattaagaatataagtgtttaatttctcttacaatggctctaatgatccatatgctaggaggcactcagggtgtgggctgagctgcatgagcttatgatagggcaaaccaatctttatctaaacttagctttaagtttatgggtatgtgattgtctctgctttatttttatttttacttttttttttttgagacaaggtcttactctgtcacccaccctggagggcagtggtgtgatcacggctcactgcagcctcaacctcccagccttagatgatcctcccacctcaccctcccaagtagctgagatcacaagcacacaccaccatgcctggctaattatatattttttgtaggagggagttttgccatatcgcccaggccagtctcgaactcccagcgcaagtgatctgcctgcctcggcttcccaaagcgctgggactagaggcgtgtgccaccacacctggctaatttctgtattttttgtagagatggggttttgccatgttgcccaggctggtctcgagcttctgggctcaagtgatctgcctgccttggcctcccaaagtgctgggattacaggtgtgagctgctgtgcccggcctctgctttagtttagaaacagataaagcatttgccatttttttaccagtaatcttttagtgtttctcttggagtgctgagattttcttggttgcttctaagctcaagagtgaagtaatatacaatgagattctggggataagcatgcttctctctctgctgggtctgtaatgaaaggtttgttaagcaaataaatggtgtaaatattatatcaggaaatgattaacacctacatagggaaagagactattcccaaacacctcaggaacaaccattgtaatcaaaaccattgtgttaattacaaaaatatctgtttattaaagtaggtctttaagttgctttagttgccaatacttcctgcggtcactttgtgtttgaaagtgataagttcgtgtttctttaaaaatactgtataattcagcccatattccctccaataagtcaaatttatagaagacatttctgtaatcgaccatattaacgagagactaatggcaactcggctgttaggacaggatatttgtttttcttcttgaagtcctagcagctgttttatcctcatattttgcagaaaggaaaaacaactaaaaaaatgagatgtgtttttaatgtgaggggaatgcaagctgatcactaagaataaagagaaatgattgcatttggcgcagttattgatttcagaaatgtctttgaatcatgttatatgcatgagtgttatgccaatgctttgtggcttcctggggtgacatttagggaatgtagatttagatcctacattttgccaaatataaattgcctcaagtattaagtcgttttctgaacaaaaattgatggtaaaggaatttatcgctattttcaacagttactagatgtgtgatcagagagttgtgtcaaaccttgaatttttctaatgttgtatatttagtagtgtatgctgttgttgaaagtataacctcaactgcaggcagtttcctagggaccattaatttgttcttaaagtatttcagtcgtgatagtcattttcttttgaaatgaaggaaaattttgatcattaagaaagaataacagcattttacactaaataaatgtaaagtattggagatttcttctaataccatataacttaggtttcttagttatattgaattctgtccactgaagcaattgactttgtgccagtgttccttttcaaacaatttattataaacttgacctgtcctttctcatctcatatctctcttcttttcctaatatttgttttcttttaatcagtcaatattgattttttttcattaagaacataaggggctaacatgatttcatcagcccgctaattgctttagtaatagaaatctgttggtccctcaaacatcaggggtgcagttttaaaaagaagtggtaactgattcttgaaccatatgtctttaatttttacaaaaagtctagcagggcctgaaactttaaaaaaattcgtaccattctcttccaaggtttaaaaaaaatttcatttttttatttttgagatggagtctcactctgttgcccaggctggagtgcagtggcatgatcttggctcattgcaacctctgcctccagggttcaagcaattctcctgcctcagcctcccaagtagctgggattacaggcatgcaccaccatacctggctaattttgtatttttttagtagagacagggtttcaccgtgttggtcaggctggtcttgaactcctcacctcaggtaatacacccaccttggcctcccaaaatgctgagattacaggcgtgagccaccatgcctggccataaatttttaattataatataaaccctatctacttaaaattatttgatcatattcaataggattcgtacaatcatggtgataattgttattaattattaatttaataacaataggtaacaactactgagcactcactatgggcctattttgaacgcatcatgtagattaacccatttaatgtaaacagaaaataaaaaagatggaggatggagtggagaattttaaatggagtaaagaattttgaaaggctattacagtgaatgaactgtgggcttgcgggtagctgggggtaaaataggaacaccaactggttatgcattttttgtttatctgataaaaagaaacatgagagctcttcaggcaaggtattttcttgttgttgctcaatctagaaagaatgtattatggaggctgttacgtaaatgacactaaacagcttaataatcagtgttgtcaacataatttcacatggctgtttcttctactgatcttccaatagaagatcaaccaaaacaacaggtgagaaagtcaggattttaggtccatggtgttgtcttgggtctttagactaaagaatcaaactcttcctgtctttagtggtaactgcttctttcttgtgtatgagttcatatctcttagtctctgagtcagggttctcctgatgagtagctaccaacaccatgatgacaataataaatacagccacctccagtggccagaaacctggaaaaagttgcacactggggaagcaagaacctgtgtactgaagccactttagaacttggaagtgaaataattggggtgagctggacagcatcttctcttcttcttcagcccctcttttctccttgccctgatcaactctgctctcaggactttgtacctggcactgagagttgtcatactgtcataagacctccagagattatggtttatcataggataaatgttttccagttgaagagatgatagaataacagtagtgataagagtaacttaggtatgttttacatatcacgatccagtcttattcacctgcatatatacatatatatatatatttttttttgagacagaatcttgctctgtcacccaggctggagtgaagtggcgcagtctcggctcactgcaacctccacctcccgattcaagcgattctcctgcctcagcctcccatgtatgtgggattaaaggcacccgctaccatgcctgactaatttttgtatttttagtagagacagggtttcaccatgttggccaggctggtctccaactcctgacctcaagttatctgcccaccttggcctccctaagtgctgggattacaggtgtgagcctctgtgcccggtgtgcatatgtttttatatggcttaaattgtggtatgtattactgggtgtatctcctgtttttaatataacaactgtaaaaatgcttttgtggttttatacagttaaaaattgcaaatgactgaataatattcccttaagttaatgtactgtaatctattatatgtaccacaaatggatatttagattatttttggtgttttgaatgtgtgtttttttgtgtttggttttatattcgaatacagcaatgatcattcctgtgtgtttggcttctgttgaataacttccttaagttcaattttatgatacatttctttttttttctttctttcagaaggttgaaaggaaggaaactttacccttatgcctaaagtctagtctaacatcagcacatgccaaattcctctgcttacaggtgtgtaggggagggaaggaaatacgaagttgaacccagggcattagttctgagagttcaggttttgttttttttttttttctctctctaagcacttcccaaattcaccctttttcttagttctggccaggaacctgcatctactctggtttttaaaaacctagttcagcaacattcccagaaacagctaaactgttggctggtgggagagtgggttaaacctgaactacaaattagttgcttgaagggtagtgccttttcttgtggttcttctgtccttttgattggaagagggtttcccacatgtctgtgtgtctcacttttaaaaataaaacaaaggaaagaaaccccaaacaaaacccttcctaaaacatttgtcatctgaacagaacttcctagaaagcagtgtcattgtttctaaaaggaggagctcgtaataaccctccattctccctcctctcccacttttttacaatgaaatgattctatgactattagttgtgaaatggcttaattcagtttcttattctttattgaaaataactttgctatgcctagtgtctgtctctggtcaaagggcgtttcctgtgtcattggcttccacggtttgtctgctttcagctttgtgatccggagggtacagtctcgccttttaaattgtctgcctcatcttttatctttcaacgggtcctggaaagaaatcatccaacggcttctttccagtgtcagtttttgaaagatccatggcttgctttattttgacaggtggttggtgaaagaggtgctcaaagggtggggtaaaggaggagggctatataagcggaaggagaggaaagagtttagccgcttcttttggggctgtctgacaaatggcaagtgattattatgctctccttttttttttttttttgttttgtttttgaaaaggagtttgccaataaagcctgaagttgggtgacagctgtatcctttttaggaccatttctatgtctttctttaccttaaaaggctggggcatccccaatggaaacacaattgggacatacaagatgcagctgtatagattaatttcctgtaatgaacaagagtgataagtcattgaaaagctaggtgtccttatcagtaggagctgtctcattggataagccacagggtccacgccagtgtggttatctcagatggtcccagggtgttcagggatatctcccagtagccctgatttgctttagccatgctttctttagtttatcccacctctaggaataacagattgactgttgactggctactagatataagatagtgcctctctttattgtacgttaatatttatttatttattttgagacagaatcttgctctgtctcccaggctggagtgtagtggtgcaatctcggctcactgcagcctttgcctcccgggtttaagcaattctcatgccttagcctcctgagtaactgggattacaggcatgcaccaccacgcccagctaatgtttgtatttttagtagagacggggtttcaccatgttgcccaggctggtctcgaactcctgacctcaggtgatccaccagccttggcctcccaaagtgctgggattacaggcatgagccaccatgctggacctattgtaagtgaatacaactcctcacctcttctaacctttggtagcttccctagattgtcgtttgtagagttaatgggcctttattatgccacaggagtgagaatgatgaatgtttccctttaagtcttctttctgtaccagactctcctcacttcttatcccaccctttccctgactctgcaataacgtcagctgccctcagctgagccctcagttcagcttatatcttgcttgatgtgcacagcccagaattatacaataatgttccaggtgctttgcagaaaggtagtagaatgtattcttttctgattcccatgccctccttgtgttcacgaagcaatttttttgggtattgttgactgcagtacatttaacagattaaagcctgttaataattaagaacaatatgtaaggtccaaatcgatttacaaaattaaccagcagaaaaccacagaagctccaacaatacagaactaaaaggatttgggatccaggccattcttttccagaccttctcttcttgttctatcccagtcctggtttacaagtggcctcttgggaggaaaggaagcgatcagtaagggtggaaaccaggagcaaaaagcagcccacattgcctttttgtactagaactgttgttaacaaagactgcttggaaagagggccatctgctgaggcagagaaagctttctgttatgaagggatgtttgttgcatggccttttagggattcactgtaacttagagccctcattagggaaggtgtctcaaactcataagcgtaggcagatgataacaacaacagcaataatcaaaatttgattcgggatgggtttctagaaacttgacagtatacatagcttttaattccttttactgaccttttcagaagttctaaaatattttctttccggtctgatgttatcaaatttcaatatttacactagactgtaggctgatttcttttttcctattctaagtggacacagctataacatgagcacataaacatcactgccaggcgggagaaagagcctttggggatcaggaagcctggatgctagtccctgccttgctgctgaccagctgggggatgggcattcagcaagtgagcacatcaaggtcttgttcccggtgttcatgaaaggagggcgttaaacttgattatattactaggatcctttccagctataatagtctgtgtttcactgcaaatgcgttgagagctgatgagatgatctggaaagataaggggaataagaggaaagctctttcctcattgcatatgtattcttgaatataataaaaccttgaaatgagcagttctgggtaactgagctttctgaatggtttttgtctccttccttgctgtcagctgtcattctgtactgctgttagcttgctcgcttttagcaactcctgtccctccttggaaacttcccttgtgctctttggaactatagcgttaagctcatcaaaactctatgccaagtcagtatacataaagctgtgaggggagggcttctcctatggctgtggtgcatggatttttggctgatgaaaccctttgggggcttatatttaggttccagataggtaatgtgttactatgttcccatttgtcttaggctagacattagttaatacgctaattcattatgaaagatgagtaggtgggtgagaggaggaaagggaggcaagttatgtgtacatcagaagagacctcattttagaaaagatcaaaaaaagcagtttgaggtgaagaagtaggctgtggagcttttttgagacagctggagttcgaccggtagcttagatcataacgagaacgctggcttgggtgtgcctctctcacttcaagcttctctgcttgaagttgcgcactgggaagaacatgctgcctcagccagtgcctggaatgttgtgcatgaacttctgaaagactggagaccctcctccccttatgtgagtgcatagtcgctgagtgtgaatttgaacccagcagttcttccttcagaaggttaaatgtcaaggcattaacattcagataagtcgtcttactcaaaatttgctttaggatgctcctgcccgaaatctaacacccatgagtgctcattatgttcagaagagtctttcaggctatcaggtccaacagcagtatgtacccacggtccgtggtgctggccacatgtatatttcatggtcacaacagagtcatcttgggtagagaccctgggtaatttccatcccatctttctacctttcccaatttgatgtccccctcttcccactccctgtactctacatatagtgaaaccagatgagctgtttccccaaaacagccgggactgtcttctcgtctcgcccgcaggcctttatacacgtgttcttcctttagcctaaattttgccctccctaattctgctgattaacagtccttctcatctcttgtagatctttgcatctgttttctcagatgcccatctggaaattgcttttgacccatagcattttgccatgaatgaatgaatggacattagaatgatgaattgttcattcatttattctgtaagcatttatcaaatatctcctgtgtgcccagctaggtgtcagttattagggatataagagagagtaagacagacgcagttccagtcttcaaggcaatattctaccttatattaaaattggcagctgggtgtggtggttcatgcctgtaatcccagcagtttggaaggctgaagtgggtggatcacttgaattcaggagttcgagaccagcctgggcaacatcatgaaaccctgtctctactgagaatacaaaaaaattggctgggtatagtggcgcacgcctgtagttccaggtattcaggaggctgaggtgggaggatggcttcagcccaggagatggaggtggcagtgagctcagattgtgccactgcacttcagtctgggtgacagactcgtaccctgtctcaaaaaaaaaaaaaaaaaaaaaaggctatgggtagctgtgctggtgctgaggcagaaggatcacttgagcccaggagtttggggttatagtgtgctagtattgtgcctttgaatagccactgcactccagcctgagcaacatagtgagagtccatctcttaaaaagagttggctggctgggcgcggtggctcatgcctgtaatcccagcactttgggaggccgaggcaggtggatcacgaggtcaggagatggagatcaagaccatcctggctaacacggtgataccccgtctctactaaaaatacaaaaacttagccaggcatagtggtgggcacctgtgtgaacccaagaggcggagcttgccgtgagccgagatcataccactgcactccagcctgggcaacagagcaagactccgtttcaaaaaaaaaaaaaggagttggctgttggttttattacttctacagggatgtaagctccttgaagccgtcaggcattatatcttgttcagctttataatcccctatcatgccttacatatagtacaggggctcagtaagtgttactaactcagtttggaaaatgcccagtttcctttccgttaagaaaagtcatacatgtccagaagcctattccaaggcatcatctttgttgtagcactttgatataacaacagtggttatgttaggctttgaagcacatttttccctcaacatcaagtggactaaaaacacagaaggttaagaccggtcactgacaggtacgtaaagggtcttttcaccgtgaagcttttaaagtaagggctttgcccatttgtggtcccaggtaggtgtatattctagcctgccacctaccttatggccagcattgctaaagtccctttagcaacaaatctgtgtatctatctattgaaaagatttgttgtcatctatggcatagaagagccttgcagaatacttgtcccataaggcttttagacaacacaaagttgtgggaaaaacagttcctgatccacctagttttgagcttaagtcttaacatgaaaataatatagctagggatgatttactctgagctggatggatacttaatgttagaaactgaagaagctattggggaactcaattcaagcatttgagccctatcggtgctgcactagagttaggaaaataaaaagctatgacctcagaagtccaatgtaccatgtaattaataatcaacaaacatttcgaagtatgattatgaaatgaaatctagcgctcatttacaggaaacactgcctctattacaaatgatagacttattgggtttatctggcattgcctgtcctttaagtcctatataattattcctaaacctttcaggaaagaatttgagcataatatcttaaactcataagctataattcactaacaaggttgaaatgaaaatctcatttagttttctgtgcacttttccttctttttttctccttccttctttcctttttttctgttttcttcttttttcttttcttttctctctctctcttcttttcttcctttttctgtcattgcttttctttggtgaaatgcttccaattctctactgtttacattctggcagacaactataaataagaaggaattaatatccctgcaaaatgctttgggacattattcgcagcatataattgaaacccactgttttctttcatgcagcattactacaataacaggaaatactgggagaccaaagtagagcctctcagcccaccctaaggatatctgtaggcctttgtccataaagccactttgctcttgtgaactgaggctgatatgctatagccaagtaagatttagtggatgtatgtgaaaacaggatcctgtcggggtacagttgaatcccatgtcagcacaggttgaaacagccagcttgctagcggtgtaggtattcctttttttatgtagtgaagattccaacttcttctgacaccagcatgtcaggtcgcatgaaacttcctgattcaacactcagagggagggactatgggcttctggctgcctcctccttcaagtattaagacagaaccttccctctaatgaccatgagaattagcttggtgtccaaaagcattgggtggattagcatgtgggttattttttcccaaaatctaattctgcataaaattggcttttgtctcaaaaccataaactaaagggattagaaactgggggtggggtagtagtctttgtactcagagaatagatacttttagttcaagtatgtcagagcgaattaggactattaatgctctaacaaaactgctagttattgagatggtccttaaaacaagggaggccagggggcatctgaatagacagatttctgacttaatagccatgtctcaggttgttctttagtctccgagaatatgcacctgcctcccatttccattaatgtcattaggagctgcatattgtatataatacagggtcatcagggtctttattgctgttctttgaaacagaataaaatcatgtccctttcattctatctgaaacattttgtattaaaattaagatcccttaggctttgcccaattacttttcagataaagtttcctgataatgtgcctagagcagttttaatttaaacaagcaaatatgtattctttgtttaaacattttcctattccatttgtgtccctggtagaatcatctgaaagaactgcttagaatctttttttttttttttttttgagacagggtctctttctgtcacccaggctggactgcagtggtacaatcatagctcactgcaaccttgacctccttggctcaagcgatcctcccacctcagtctcccaaagtgctgagattacaggcatgaaccactgtgctgggccagagtttttttaaattttatttttattttttatttattttatttatttttattttttgagttaaaatggactccagtgcttactgttaaagctatttaaaagccccctcctccctaggcccccacataggaaagttgctgcacagaaaacaaatatcagcaaagcctcgatcccagtcctgtccccttgcctagctggtattttggggctgtcctttcattttagcattagcctaataatatgtacacatgtataatacacccacaaatcaaacgttagttttggctgcctcactgttggggtggtgatgtgggaaaggaataaaagctcagcaattagatgacttgcattttaactagtattggaatgcctgttctgggttaagcttggggccaggaactttaagtacttaattttgatgaatctgttattaacttcacaagcatctcagagaggagtatttttatcttcattattctgatcagaaactgaacctaagtttctgtaactgtaaaataggataatgccttcaagagttatggtgcagacaaaataaaatgataatatacgtgaagatgctttaagcaccatatgtatgtgaggcattgccattattatgacaattacttctattctgatgataaatactttcaagtaaaaatcaaaagcaaattagccagactttttgactgttcccgatgtttaacaactgaattcttcggtgtttcttacatttcttctaagaccatgtagatcatgaacacttttatgctcttttccccatgtcccccaacctgacaacccataaaaattgccttgaagagtatatggcttgcaaatgtcactgcaagtcaccctgtttgcaatcccaagcaatactgagtccttgaactgaatgctctacaacaaatcaaaaagaatgccttcctgtgagatagaggctgtgttgtacttaaatatacttactttattcactcacagctggaaaggtgcaggacagtgataacgaggtaatcctagactcttggggacatcagttagttacctgtattaagatgcattttaatatttttgtacaaacagatgtgagttcattatgagtcctgatttagggttctctggctgtgacctgaggcctgtggaagtttcagagggcttctgcagagatcccaaaaggcagtgctttcctgctgggttagagactatgcagagagagtgtttaaacagagtccagcttgacagctagcacagatactctttctgttgtgttgggagccagtggtaggtcagaaaagggaacactggctattaagagatttgcaggaggcgtaagggaagggtttgcctgagatctgactgtcttggtagcttctcagcactcctttttacccttgaggtctttgatgacacccttgggaaatgatgcccgacctgggacctttcatggttcctgcttgtacctgtcacgctatagcccggggcctgagccttctggagccttccagaaatgcttcacagaaatgctccacatgtaccaggacaatgctcagagtctgcttttggattgggctctcactcctactcaggtaattgtgcatccttacgtaacctttcaaaccgaagactgagacatttatagcaaccctaaagttcctctcatctcctctttcctctttcaaagtttgaactttgagattctcaggggaaacaacttttttttttttaagaaatgactttaattcactgcaggttttaacaacagggtatggccactctcctgttttcatctgaaggaaatggctttgtttgacagagatccttaaaacttattaacttttgaaaaatcaatagcactattccttccaggaaaaaagaaaaagaaaaaggctgtatggctcctttttacaaaggagttaaaattgtcagaatttgttaggccttttacatttttatcttgcgcatagccatttgctctgggtagtggggattgtctagttcatttggacacattaaagtgtatgtctctgtgcatttccagttccctgaagaaaattctcgagttgtattgttacaatagtacagagagttttcatgtaccttctaccccaacacatgcatagcctcccccgtgattaccattccccaccacagtggtgcatttgttacagtcagtgaacctacattgactcatcatcatcacccaaagtctgtaagtttacagtagggttcactcattgttttttgagatagtcttgctttgccccttaggctggagtgcagtggtgtgatcttggctcactgcaaccttagcctcccgggctcaagcaattcttctgcctcagcctcctgagtagctggaattacaggcatgcaccacaacacctggctagtttttaaaatatttttagtagagacggggtttccatgttgcccaggctagtctcgatctcctggcctcaagagatccgcctgcctccacctcccaaagtgctgggattacaggtgtgagcccatgtgtccaggcaacagtagggttcactcttgatgttgtatattctgtaggcttggacaaacatatagtgacatgcatccatcattattgtatcagacagggtagtttcactgccctaaaattcctctgtgctccacctattcatcccttccttccatcaactcctggcaaccactcatctttttgactgtctctatagttatgtcctttccagaatgtcatatagttggaatctgtatgacattccatatgtcatatagttggaaacagtacgtagccttttcagattgacttctttcacttaataatatgcatttaaggtttctttatgtcttttcttggcttgatagttcatttcattttagtaccaaaattctcttgtctggatgaaccacagattcacctactgaaggacatcttagttgcttccaagttttggcaaattttggcaattaggaataagctgctataaacatctgtgtgcaaggttttgtgtgaatatgttttcagctcatttgaataaataccaaggagagtagttgctagatcatatgataagggtgtgtttagttttgttagaaactgccaaactgccttcaaatggctgtaccatgttacattcccaccaacaatgagagtttctcttgcgctataaccttgccagcatttggagttgtgagataccattacatgcctcactgttgttttcatttgcaattccctaatgacatatgatgttgaacatattttcacatgcttatttaccatgtatatatcttcagtgacgagttcgctgagaccttttgcctgtttttttgtttgtttgtttgtttgtttgtttttgagacggagtctcgctctgtctgtcgcccaggctggagtgcagtggcgcgatctcagctcactgcaagctccacctcctgggttcacgccattctcctgcctcagcctcccaagtagctgggactacaggtgcccgccaccacgcctggctaatttttttgtatttttagtagagacggggtttcaccgtgttagccaggatggtcttgatctcctgacctggtgatccacccgccttggcctcccaaagtgctgcaattacaggcgtgagccactgtgcccggccttttttttttttttttttttttgagacggagtctcctctgtcacacaggctggagtgcagtggcacgatcttagctcactgcaagctccacctcctgggttcacgccattctcctgcctcagcctcccaagtagctgggactacaggcgcccaccaccacgcccagctattttgtattttttagtagaaacaaggtttcaccatgttagccaggatggtctcgatctcctgacctcgtgatccacctgccttggcctcccaaagtgctgggaatacaagcatgagccaccgcacccgacccaccttttgcctgttttgtaatcaagttgttttcttatgatcttaatactttttcatcctatgacaagtgttaatttggttagctggacattttggttttgattacatattccatttagatatgtagggcttaagtcagattatgccaggtatatgttcccttgggcttgctgaaggattcacttttattaacttgattctggtgaaagggcgtgtaaaaagtgagactgatcaactaaatgtgccatttaacccactgaatgcacaaaccttgcaggaaagtatagtcagttcactataacacaacatagtcatttctaaaaatcaccatgctatgccaaattgtgtggtaagacaacagtaggcgttatgggaaaattggggttagggcacaacactaacaaacttatccactgacacattaaaaaagtaaaaaggaaccaaagaaacttaggagcacagtttcacacatgctaaatggttaagaaatacacaaatattgccatacatatggcatgtgaccttgaagacatctgaagtttaactgtggacagggaagtcagaagggttccagcttgtgtgagttattatgaagtggtggatggagagttatctgaaatctgatggaaagctgtagcactaactgtggagataggggtggctcataccactggactgagggagctggtggatgtttaatatatgtgttttgcgtatttctacatggctgggtacagctggttgcggtttcctgcattcacctcctatttctggaagacaagctcacgcataaggaaacgtgaaattttcattatgctcaacttcttccttaatatatcaattgcattgaaacaaattcacattttcaaaataaatgtgatagcataatagactgtaactaatatcctttgttgcattcttgagcatatgttcctttcatcctcatagtagctgctcacgtatgatctcctttgtatgtgctgcccagaagtgttggtatctggggcccactgaccccggttcttttatcacctgtccattttttctaccatgtgcctcttgtgctgcttaggagggccagttagtatgcaaagagtagacttctggttctatgttgagggaggagtgcagggctggtaagagctattgcttactaaaaattgctggtgtggatgaggcatccgccagggctgagctctagaaggattatctggagcttgtctaactagggctcactgcatatttgagccctcgaatggactgtcttcataaagtaattaaaagcatattggaagcacatcttctttctaatctctggcattggatcttagcaggactgtattcagttgtgtctacatctgttttgtgtgcaatttgcctctcacggattatggaaaccatctcttgctggggaagctttcagtcgtgttaaagactcatttaccaagggaaaacaacaccttagaaaggaatttattttcaaaaatagacatccacattgcatataaatgtatatagataagtgtttcaacaacaacaacaaaatgctgcccttctgttccaggaaataaataccttatattcagtttggcgggagggattcttctcaaactaaaactgttctcctctatgtatatcatttcctgtaattccctcactaaagacgctttggattcagaggggctatattattcttggaaagttttggagttttccaaagattgactgagatagatccttagccttacaacttcttgccatccaggaactgcatcacttttttggggggtgggggtgggggtggtgcgggcagacagagtcttgatctgtcgcccaggctggagtgcagtgatgcgatctcggctcactgcaacctccgcctcctgggttcaagtgattctcccacctcagcctcccgagtagctgggattacaggcacccaccaccacgcttggctaatatttgtacctttaatagagatggggttttgccgtcttagccaggctggtctcaaactcctggcctcaaatgatcctcccaccttggcctcccaaagtgctgggattacaggtgtgagccaccacgcccggcccacatcacatgtataagactccactgcttgattaggaatgggaccttggagttaggatctggcactttcgaagtttttgtaaagaaaattcaggactcctcagtctccaggtcaacgaagtccagttttcatgttattctgttattgtttgctatttaggattgctgtagtctacagagatgtaactgtttgaggtggaaaatagaacatatggtatttttgcctagagagcgagggcagtggtttttattcttggctgaccaattgtttctctttcttaagcactttctatgtgccagcattgtgatttttatgggttatctcctttaatcctcacaaaaccctgtaaaatgacccctccctcactttccatataatggaactaagacttctctaagtcacttgcacaggatcagtcagcatggatttgaacccagatctttcatttttaaacgatttcattttttttgttgaaactcacataacataaaattcaccatttcaaccaacttaaagtatcagtggcatttagtatataaacagtgtcatccaaccattaagactatctagttctagaacattttcgtgacttcaaaagtaaaattctgtacccattaagacaccacttctcattcctgcctccccccagcccctggcaaccactaatctgctttcagtctctctggatttgctcattctagacatttcatataaatggaatcatacaatatatgacttttgtgtctagtttctttcacttagcgtaatctactggcactttattcccttcatggtggctgaagaatattgcactgtatggacacaccataatttcattatccattcatcagttgatgggtgcttaggttgcttctgccttttggctatggtgaatagtgctgctgtgaatgtttgtatacagctttgtatgtgaacacctgttttcagttttcttagattggaattattgggccatatggtaattctgtgttttaccttttgaggaaatgccaaagcattttccatggtggcaactacagtttacattcccaccagcagtgtatgaagtgaacccacgtctttctgactccaaagtctgtgctcattttcttaggccatgccatctcctcattacttctcaagggccctagcaattgcctgccaagccacacctccagccaacaacagaagcatgctgcagggtgtctcatgttgtgaggggatggtgttggtaatagggctttttggcttggtgaaagaacatgtgtcagagatttgtcagtggacaacctcctcttcctctgtgtcaggtaatagttaagagtatgggctctggaaccacattttatatgattccaattctttgaaatgtccagcataaggaaatccataggcagtaggatcagtggctgtctaaaatttagggagtgatggttaagttatgggatttctttttttttttttttcttttttttttttgaaatggagtctcgcactgtcgcccaggctggagtgcagtggtgtgatctctgctcactgcaagctccacctccagggttcacaccattctcctgcctcagcctcccgagtagagtagctgggactacaggcacccgccaccacgcccagctagttttttttgtatttttttagtagagatggggtttcaccgtgttagccaggatggtcttgatctcctgacctcgtgatccacccacctcggcctctcaaagtgctgggattacaggcatcaaccaccgtgcccggcccccgggatttctttttagtgtaataaaaatgttctattaacgcttgtggtgatggctgaagagatggttcaactttgaatacactaaaaaccattgcatgggctgggcatgatggctcatgcctgtaatcccagtattttgggaggccaaggtgggcagatcacttgagcccaggagtttgagaccagcatgggcaatgtgacaaaaccctgtctctacaaaaattagctgggtgtggtggtgcacacctgtagtcccagctactctggaagctgaggtcggagggtcgcgtgaacccgggaggttaaagctgcggtgagccatggtcacaccactgcactccagccagggtgacagagcgagagcctgtctcaaaagcaaaaaaaaaaaaaaaaagaaaaaaaaaagaaaaagaaaagtatggtatactttaaacagatgaattgtatggtatgtgaattatatctcatgaaagaattttttaaagtgtagtctctagagcctcactgccacttattagctctgaacttggacaggttccttagtgactctgttccaggattcatgtttaaagggggggaggataagataatagttctgtacctacctcattgagttgtgaagatcaaaggagctaatatagataatatagtgcttggcatggtgcctgacacataacaaatgctcaatgcatgttgttaactattaatataagcatcataaaatatttttttgaagttccaactgatggatggtgttcatgatagggcagcaaagactggaaacacatagcattcctcttaaaatttaaattctttgttcaaccctgctgccaagggaaatgagcactataggacaatgtaatgggacaataatttgggtagtactgggagatgaggtcatatgggagtgggtgttgggtacacttaagggctgaaaaaagaactggtgctgttgcatgtgaggaaattgtattaaaaaggctgctctaccctcactgacaacagatgttgggaggtcttaggctctgggctccagggcctctgacccccttgaaattctctccaggttctttggaggtcatgatcccacagttggcagagccctggtgtagattagcttccttggatatgttttcctctctctttccctaatgcctcccatcccgagggtctcgaggaactagagggaggtgcttatgctagtaaagaaactagcaccttttcaaggaaaatgaaggaaaaagctgggacagtagggaaggcaggagtctgacccatggatctaggagtggaaaaagaagaacaaaacaccaagctgttctgcttgtccagttgctctgaggttgaaggccttccaggagaagcgtcctcactgttgtctgtgtccatgtttgcaggccacagacattgactatctgcccggtgcctccttgtcaatgtcccatgtgggggagagacaaaagcaaagacagccagccttcccagttccttcaggagacagaacccgaaagccaacacatgaaggcatggaagaacacttccagagaaccagctcacaagtgcaaggggatggggctgtcgaccccgtgtgtatagtgccaaggcaatccaggtcatggttgcagagtgctttactgccatttttattgcctcctttcaataaaccactgcagtgcatgaactggttgtgttttatagctaggaaaactctgagctaccaacacattaagttacttgacactgagagaaccctcaacatgaatgtcttatatctgcaaggatatttgtgttagattccatcatggaggtaggaatgcttatatcagacaaagatgcatatgcacacatgcacacacaagcacacatatgcatgcacacatgccaggggataatgatgtcagatatggggacttaattgctggaagcgagtgtaaaatgccattggtgagggctgggggacagagagagcagccctgtggccctgggtggcaggggagagcccggggtaggttgtgtgcctccctccccaacatacacagtgcccttctcagcctgctgtctgtccattagctgcacggctgctggcctgagcacacgggctcttcttggctttgagccagtggcgagctgggagcctgtgactttgagacttggcccttttcagttttctttgttcagaaaaaagtttcatcctggctgtcttcagtggctgccgaggattaggagaaccctggggagacttggctataggacggctctcaaagctgtgctgggaaatttgaagagggcccatttctctctgtcttatttcaagttacattcttctctcccttcctaaacgagtttttactgttgcaaaccctactgcataatcccctagtgtacttttgtgattctgctgctatggaagggattagaccagtatcaggaccagtaacatattttaaggactgttgaaatggacagtatgaagtaaggttcaaatttggatactcattttaaatagttgcacaagttagaggcaccacatgctttcctgggttagcatttgtcattcttaaaaaaagaaaaagtatgcttttcagtggctggaaagaaaaagaaaggaggaggcttggctcctctgagcagagcatgagaattggatttctaaatggccagagactatggtattcccaagtacaagtggtttgttttcaaaaatttgtaactacttgcagttttgcttgtttaatattgttaagaaatggaaattgcctcagttgtaaagtggttttcccattaaggattttttctttttagttttgatggtttttaccttttaaaaatagtatttatttcatgattatgaacaaattgtttttgcaaatctgattgtattacagtagataggtagatgtttgcatttttcataagctacccattagtgtaaatgtacaaaaaaatgcctttatacatctttttaccatgtttcttgtggtacttggggaggacttaactctgaactgcctccattagcattgtttcccagaggacacattaacagatcaaaaagctatagactactacatatacacataccaggagtacgtagttcagtttctgtaatcccacagtacgcaaatgttggcagaatttcaatgattgtattaatcctgtgagatactttgtcatgcatgatagatgatatttacaaattgaggtctgaaatggtcagaagctttgaagatgctttattgtgcagtatgtggaagtggaagtgtttatattgttttagaccatattggccaaccaggcagcaaaaaatatacagtctcataatagagtacaacaatttcataacaaacctgaaggttgctggggagtttttccagcctaaaccaacaaggttcatcaaaagttttgccaaggtcttaaaaccctatggataattggagcgtttggatatctcatgtgaaacacaaatccatttaaatgccatccacatacctgtgaaatgactttcttaatacatttctgtattgtagactcagagcagaatatgatagccctgctatgaggagctcctggttctttaagggctccacttgattaatcagagaggatctgagcataattaagaatcacattgtatttgaagactgggaagtgggagcccaagaagggtcactgattttttctcaaggtcatacagtcagatcaactcacgaggtcttgtttcctctctacatgtataacagactgtaggttgcttttgcccctttcacccccaactcctgcgatttaacacttttaaattttgaaaggtttccttacttaaagaagttcttggttcaccctggccctactctttgtgactttgcacatttcctttctctttccctacctaccttccacctttagtctgttcctcccactgggcttctcccttcctattcctttaatttttgctgcccttctctaaaacttttcttcatagtgttcatgagtttgagaatagcacatgtcactctaggcacaagcaaattactcttttgtataaagagcaggcttgtttcatccctttggtggctatgggttttctcagactctcccccacgttgccaaacacttgcagctcagcactatcatggattggtgtctttcccccagctttactgatatataattcatatactataaaactcacctcattaaagtgtacaattcagtggtttttagtatattcatggagttgtgcaaccattacctcagtctatttagaacatttttatcacccccccaaattaactgtgtaccattagcagtcacccctcatctccctccctctctttctgccctaggcaaccattaatctgctttctgtctatggagtgatgttttgagggcccagtctacaatcacttccctgtgataagaggagtcatgtggctactcacttgctcaccttgacagtggcctgcctgatgtttgctcattttcctccattaatttgacatgtcactaattactttagtgtcaaagttggagatagtttacctctcctttcctattctagagactccagaaagggaccttggacaaccttgaagtgaattgcctttctgatctctgactttctacaaccccgtttttggcagatcatcaactaccctttgcccctgagccctggtgatgggaaaccccaagaactggaagttcccttgaggttgggattttgtaacctcagcgctgagcctgatgcctgcctgcctgccacatagacactcagtgtcactgaatgaatgaacttaagcaatactgttaagatggaattaccatacctttttgacacatctgtcactatgaactaattgagcttatttatgctctgtgtgtgtgtgtgtgtgtgtgtcttcaataacccaactgtagaatcattttaaaaatagcaagtaaagctgatctcagaataaattctaggtgcatcccatcttgtgtacgtagcagaaatggatgcatttctccctaccttctgtttcttgtgttgtatgttcgattcctatccaggagaaaacaagatgaggctttatgttttagggaagaaaatggaaggtttagagaacatgtttttatttattgttttctaaaaatgctatagaaaacagtactccaagtagctgttttgattctctttaattcctttcttcttcatctgaggatgaacatctggtagggagtgcttttacttgcaatccagtacactcctattgtcagtccaaaaatatgtggaagtaaagagattccatctcagacccctccaattgccataacagtgggcctgatatagaagttgagaaggtgtcaataaagtgttaatggagatactcaaggaattcagagcatttcaaggcacagcatatgttcacatccctctggtatcagcaaaaactcaaaagtgaaacctgtagggtcatttggctttcatgctgtccaacaataggactttaaaagccacacactaaggagcagaatattgaaaattactttgaactttcaaagctaactatctaaaatatcctagcaactttcaaaaagtgtgataagcaggaagtgcagcactttgtaagacacgtgcatgctcttaagcagaagcctaaaatgctcctaatttgtaccagagaccttatcaaagggcttcgcaaaattccagttcagcaattatgaggtattagttgagtttaacctctgaatcatagggtggggagtggagaattgtcatttcattctactttcaactatcaaggcagatggacctttctaaaagatggtggtgggtgagtagaaaaggaattgataagaaaaaggagggactttgaaagggcttctcttttcagagctggcatgactgtctctccagtactctccctactacacatatttctgttttgtaaggagcccctaaggatacatatacagatatccttgggggctccttgcaaaacagaaatacctttggaaagttaaaagaaaaaatggggtttcctataacctcttttttttttttttttttttttttaaagacggagtcgctgtgtcgcccaggctggagtgcagtggcacaatcttggctcacagcaacctccacctctcaggttcaagcgatcctcagcctcctgagtagctgggattacaagtgcctgccaccacacccagctaattttgtatttttagtagagatgtggtttcaccatgttggccaggctggtctcaaacttctgacctcaggtaatctgcccacctcggcctcctaaagtgctggaattacagatgtgagccaccgcgcccggccttccatacctcttttaagctgttgtcccagggtctgggtggagtggcttgtgtttgggataggagcagcactcatttcaatgaaatcacctgcagaccttggctccattttagaatgacttagaacgtcctgagaagtaaattgcttatcttggggcctcagtttctgttggataagttaattgcctctccctatgaaaaacattttaagtggtataatggcctaaggtttgttatatttatattaacgaatttggacaaagagaaatcaactcaagcaatttttttttctgtcaaagaaatgctatacccattaaggacaaattttgtgtataaagatggctttatttatatttagaaatgatggctgcaggcttttatttgatgagtttgtttagattacaaaacctgagcatattttagcatcagggcaggggggctgctgatctctccaaaaagacaacagtgatttgagtaaagcaagagtttgtagtaatatatgtgtatgtgagtttttaagttctgaaatggatagtaatttaaaataatgaacaccagaattcaaaggactacatatttgccttaagaaaataacacagagcaaattgcctcttagcgatttatagttttatactttgtcttgtttgttccactggtcatggcaaactctgggaagagattttgaggctagtctgagccctagaagtcaagaataaaagtagacttttagttaacagtttaaaactttgccatagtttccaattacatttatatttgaacaggaaggagtcttaggacttttcttcatttcttaatggtgctcataaaacatagtgaatgggaatttgctttaagactaattgtatgtgtgtgtacgggtgtgtgtctgggtgtatacacacccacagagacgcgcatattaactaagttgggatgccatagttggatgagttttcaaatattttagcaaaggtttctgagcactcatgaaacaaaagcattaaggattgcttgtcatagctaataaagttttcttggatctcacttaatttttctgcttcacttcacagagtaattgaaacttcctttttgctttgagttcccctcaccccacccccaagagctacagtcttaaaaggacatctcttttggttagcagttctatggatttttttctgaatgtagaactaggtcctcaaatagttattgagctagtggtcattcaatccttagaagggaaattagttaaatctgtaagtggcttctggaggttgaagaacatccaaggagaataaaggcttattacaactggagcatttcaagcatctgttgtgtaagcctggaaatgtgatccaggttgaaaagtagagatgatggaactgttccattggaacagtgaaggtatgaaaaaataagctccaatctcaaaaacaaacaaacaaaaaccctgaagaactttataagtataggaattatcagttgatgcagattagccaaaatgatgaggttttcctgtgctccatcaatagttatttgcttctttatttcaaatcattctctagaaaattgtctttctccatcaaatgaaataaccttggaagtcttaaccaattcttgcaaaatggctcccctctgtcttccctccagccatgttttgttttgggttaacagtaaaagacaaaacagattgttgactttttgccagaaaattttggggacagattttgctgctgttgcttctgacgtgaacaaaaacctcagattgcatatcttctattctcagggcaaaaacttatttttgaagcaatgtgggtgggttttgaggcgtgctcttctgtttttgttttaaagcatttggtaagaagacacttgactttgaaattttattttcatatgtactggcttgagagagctgacctcccacctccactccatctaccttgtcaactttgatttttaacgaagtaatcaactagttgatgtaacatgcttattttaaaagcaatcatatgggagtgatttaacctttttttttatcaagttgagtgttaattattttgatctgcctcttgaatggtgggttgttaatagtaatattagtcacagctggtatgtgagtactcaactccagattccttggttcaatatttcataggtcattaaacaattttctgatgaaaatgatttatttaaactccaattctcaacctcttgcttttcacaatcccttaggataattaaatgcccagtactgcacccctaactagttacttacttttcaagaatcctcacttaaataatcatatcatatgcagaaataattatcctgcaaagaaagctttgtgaatacttcggtgtttaattcagtttaaattcatttaggagagagtagtacaaaatggctgcattataattcacattgtgagcaaagtatttttaaaatattttgacattcttgactaggttttcatgtcactctttatcaaatgcatcgtactactatattaggtttctttgcttaactcacactgtctaatgggaaaaagttcaatatcatttaagacagactctagttatctcatttgagcgacaattgttctgggggaactgtaacttaacagaaatataagaaaaacaggaactagggtcaaaagccccacagggtataaaagggtcataacctctctcagaggaggcaaatgtaactgatatactagtttttaaagggcacttgattgcatgaaggaatgcagtaacaggatttaaagcaaacatacagcactaacaaagattaaattaatggtgtgccctgctctggggggattaaaagaggtagttttatataaaattattgtgagtagactaagattaatttcctgattttgcatatcataagatactgtaatttatgatatctgctgtgattcttacgtttaaagtagtacctagactttgatatgcgaacaaaattaagaaaccatgtcaaagtataaaaataatgttactcggtcgggcgtggtggctcaggtctgtaatcccagcacgttgggaggccaaggcaggcagatcacctgaggtcaggagtttgagaccagcctgaccaacatggtgaaacctcgtctctactaaaaatacaaaaaattagctgggtgtggtggcgggcacctgtagtcccagctactcaggaggctgaggcaggagaatgtcttgaacccggtaggcagaggttgcagtgagccaagattgcgccactgcactccagcctgggcaacagagctagactttgtctaaaataataataataataatgttactcaatgttatattgaagtaatttttctttatattcttagatggtaaaattaccatgctcttaaaaaaaccttaaaagtgaagttctaagtgaatcaacacaatttttagatgatatgtcatgagaacacaaaacacatagaaaaatggtaaattttattaacagtgcttttatgaattgaaaaccttcccttagtgttggatacggaggctagaatgaattccacaatcaccgtggatgtttggagtcctgggaaatgtgctgcagagctgtgtaaatgaagtgttgctgcctccaaggtgtcttgggcctaggttggctatccacataattgaaattaaagtaaaacttcatatgctgccaagaagacaacaacacatccagttaatctccaatagtgttttaagatgattcacaattggaagataggtaacatggtgtttaacaggtatgccatgttttttgtcattttattcaaaagaatctcagcaaatagataattttctttttacatttttaaaaaagagatggggtctcactttgtcacctaggctggagtgcagtggcactgtcatagcttgctgcagcctaaaactcctggcctcaagcagtcctcctgcctctgcctctcaaagtgctgggccactgtgcctgccacttttcttgaaaaattataggtaaggaaaggggctcattgttccagtttcgcctagcacagttcagctttacacctgctgtcctagcatagttgttattgttcttgtttggagacagagtctggtctggctttgtcaacttacccggagtgcagtggcacaatcatggctcgctgcagcctgaacctcctgggctcaggtgatcctctcacttcagcctcccaagtagctgggactacaggcaggcaccactatgcccaggtaattttttaattttttgtagagactgggccttgctatgttgcccaggctggtctcaaactcccgggctcaagcattctcccgccttggcctcccaaagtgctgggattacaggcattagccaccgcacccagccctcagtataattgttagtggcaccttctttcactctcccatgtgtcctggtttggcctataatttgtggtcaccctaagaacaggaaacagtatattcacagaaagaacttgctaattaaaaatgatttaaaatagttttgcttaggaagaaaacattatgagaactttacattttttcctagacataacttagcctaaggttgaggaaggagacaccatcaagtcgatctcctggctaagcaggttacatatacatcgcaagagcactttacaaagaggcaagaaagccctataccccaatgtctgaaaaggatcacacagagtagaatttaatctgattttgatggtgttaccaatggagggtattgactgcaagttgtctgagttcttggcgttttgaacaaaggattggacaaaactcacagcaaagcaaggaataaaagaagcaatgaaagcagagatttattgaaaattaaagtatacttcacagggtgggagccacctgagcagcagcttaagggccctggttacagaatcttctggagtccagataccccctagaggtttcttactggccacttggtgtacaccccatgtaaataaagtagtggctggcaatcagaggctgaagtgaagttacaaaggttacaccctatacaaccaatcagaggctaaagtgaagttacaaggttatactcctatgcaaatgaagacttggcttgcaatctgattgattgtggaaagcaaccaatcagaggtactttcaattttccatctgccactctgtaagggatgggggtttgcaaagggagtagcctctctggtccttttgttacttaggtgtggaaagttggggttttcctttcaattcaccgtgaattggccttaggttccctgcctccagaccctattctcctgcctcagtggcacctcagggccatcatttcgaatatcacttacttctaccctggctacacacacagatgcagtaagaggccaggcccacagtctagaaggaattgttcaccatcctattataaatcattttgataatttttcttaagtgcactggcttactgaggtttacctgccactttttctgcccacagagtctcacaagctggcctgtgttctgttctctgaagatcccatgcactgtagtgcttagtgctggctgtagtggagcccaaccttttgtagtctgagaaaaccagtggtgtgctctataagtgagacagtattcagtgtgcagaaggtacttggcagaactataaatccatagacttttggaaatatctctaagatccataggctgggaatcacagaactgaaccattgaaaacatgtgtgtgccattatgtaataacatttggagctttggtcttggaacttgatattatgatctgacatgcttttacacttgaatcatctcagtgcatacctgattcatgccttcattacatacttttgacctctgaaatccatgaagctgataaggacttgggaaggctgctctcatagcatgtaaacacttggaaggctgatgaatgttctgctgtagtgttatatcctttctgtccagctcttgagggattgcttattaacatttcattatccagtcatctgccatttctgttcttactgactaaaaaatgtgccctgtaacctaacatccagtataggacgttgctccatctttttgcaaagaaaagtatgtgaaacaactgtaactatttaggaaagatgtgtaatgcagaaaatagtgcatatttgtaggttttaacaggcttatttcctcttctaccaaaaactaaagagaaatcagtctgcaggtttagatctttgaaaataaatgcattctaacttttatatctttaatagagattcctaagatgttagtgttctgaagcatctttactatcattgtttgcatccagcatcagattaaaaatcaaataatttgagtgtgatagagctgttcgttggagggtctgcttgagggtagggaggctcaagagacccagatctgaaactcagcagcctctcaaataggtagttttgacttgggggcttggcaaaatattgtcataactgcaatggaaatggaagtgagaagaggtggatttatggcatgatccacattagactctgagctccctgagggcagagaatgtgctcatttttatctttagcattttgcactgtacctgatgtattctagttactcaataaatgttggttgagtgactagagaaagaaaagaaagttggtgaaggtcgaggcaaagcaaacactgtagtggtgaacggttgatgaaattgtcataaaaagatgaagttttaaaaattaggtggaaaccacagggtgtgtctacaggcagccaccaaaactgcagttgcaataaaataaaacattaagaaaaaaaaattgagaagctttaacaaaaaaaacttacttggctttggagctaaaattccacagctgtaatcagggaaaatgctctgcccagcagcctgagtaatgaataaaaagaattttcagagagaaaagaaatcaacaagctctgtgactccccccagaaaggccaattgctgcctcccaccatcttttgacaagaatgacattttacccacccatgccaggcttctaaaataagttgataatgtttgcactcgctgtattagtagaacatcttgatatagaatgaaacagtcttaaatttcttagctactaggaagcacgttttttagctgtgtttggaacagtgagtattcttagattttcagcagcattcgtgtctagatatctttggaataatttgttgtgttctgatcctgagagttgattatgtgttctctttaccatttctgaaagatgtaattcacatgaaagttattaaacagaaggttatctgattcttatttactatttcattctacttttacaattatgtgtgtatattgaagttcagaatgccctgtctaaattttaggttgaaaacaggaagtagtgactaaatttaagtgtgttttcttatttgagggattaaaacccttgttttggagtttgttttgttttgttttggtcatcacttccaatttaaatgctattgttgtttctggttgcctgagcagtatgaaacatcagcttgtggagaccaataacttgtgttaagcttaaatttgaggccagtccagatggaattcttcactccagaatgtctgtgaatggcatttcctcagaaagtgtaacagaatttttggtccgtatgaccaagcaattccattgctaggtataaacccaagagaattgaaaccctatactggggtgggggttgggactcattctaactttggaaattcttgagattttagtgttctaaaagggtttctatatcaaatatatacagcatcagaataaaaatcaaataatatagacatgttggtagcagcattagtcacagttgccaaaaggtggaaacaacctaaatatcaatatcaactgttgaatagataaacaaaatgtggcatacccatgaaatggaatattatacaaccataaataagaatgaagtactgatacatgctacaacatggatgaaccttggaacactatgttttatgaaaaaagccagttcagaaagattacaatatgcatgaatctttttatgtgaaatgtacaaaataggcaaattcatagagacagaaaatagattatgcttgcccagggctggtgtgtgtgttggggaagggttggaggggtgactgctgataggcacaggatttctttttggtgtaatggaaatgttctgggattagatagtggtgatggttgcacagccctgtgaatatactaaaactcaatgaagtgtacactttaaatgagtgtattgtacaatatgtgaattaaattttaaaacatgatgggggggcaatttctggagaggggagcaagcaacatgcccagcaggacattattcacttgagtttcagatttgtagtactctaatgctaacagcatggtttgcctagctgatgagggttggggaaaaagaaaatcaaaagctggaccacaggagaccagggttctcgtcctgatcaaatgcatttctactgtgcaaccttgtagatagatgttgggaagagaggaatgagaaaaactgtatatccttttcataattaaatgattgagagtgtttggggaaggacaagagaaaaaagagctgtatgtttaaaaacagaaataggccaggcaggtgtggtggttcatgcccgtaatcccagcactttagggtgactgaggcaggtggatcacttgagcccaggaattctagaccagcctgggcaacatagtgagacctcattcctgcaaaaaacaaaacaaaacaaaagaaaacaaaagcactaaaaataactaaaaaatgataataataaaagattttaaaacacagaaataaacattcctcagggcgaggatgtgcatgtgtggttaattcctaatactgaacaaggcagggttttgactacagcttagccagacactccttggcctctctgccatggcattcccagctctctgtcagaatagcaaatcgtagctgacatttgcttttccagaaggaacacccttttgccccattctaccgtcagcctggcttttttgtccggatttacctgttctttgtagtgggagacagctgtgcaatggatgggagcttgagggagcccagaaacctcttctaggaccacagcagcactcattcatcactcagagaggaaacaagtagtttacgagctttcactgaaaagtcatcattgtgtaggttttcatgaaataaagattgtgtgagccatcacacagggctgttttcaggacaactctgacagaggatgtttgttccttccagaaatgctggcaatattgtaagcttttcatccctttaccagggcattactctggtgctgttagtgtctgattctgctaagaagtaggaaatgttaagaaggcattgttctaaagaaatgatccccaaatatcagtgctaagtgccatctatgaccacacacatgtccatttataaaatgccttataaactgggagcagtgctgggtttatatcaaagttcaatctcaaaatcaatgccatttaaaattgtaaaaccattcttaacttgttctttcaaatgtagaacatttgtattatgtttatgttacatgtagggcacagatatggcatgtgacatttggtacattgacatttttagaacaaaaatgagtgacccactgtttttccttgcctcttctgttcccttctctgtctgtatttttccttcctctcctctcctcccctttccttcctttctttttttttttgagacagagtcttactctgtcacccaggctggagtgcagtggctcaattacagctcactgaagcctcgacctcctgggctcaagtgatcctcctgcctcagtctcctatgtaactgagaccacaggcgcaccccaccatgcccagctaatttttaagttttatatagagacgaggtctcaatctgttgcccaggctggtcttgaactcttgagctcaagcaatcctcccgcctcagactccccaaagtgctgggattacaggtatgagccattgcattgggccttgtctatatttttcaagctctttgcttctattattgtatttaatttgttttggagtttttttcttactcagaatcctgcctcctcattctttctctttttgagagaagagcaacttttgctttcgggcactctaatttacaggaaaatgaacgatacaatttatgcagttttgtgttctagaaaatttattatttcagccttcagggttacccaggttttgtatcatttcatttccctggagcactttacacatttaatggcaaagaccagcaatggtgcttttctggtgtatgcagcagcttgttctaaggcatgtggtttgagagttggcgctacttaatcatcttgtttttttttttttcttgagtgttttggatctatttcctccattgagtccaagttgtcttgagagaactcaagaatggtgtgaagtgtatttagcagaatctctcttcccaaatggcaaactgtgtttcaagaaataaataagcccattctaagatataaaccctattttcatgtttacttagctcttttcttctatatcttctgggattgatatttttagtaatatgaaccagctatttgatgccctttgaaagtaacagccttgctgcatgggtcagttttctggtagcgtatcaccagcaaggacatcacactcaggtagaagaaaaatgaatgttcttttttggaatatttcaaaggttataaatgtatatcaaacaaaccagttttccttaataaatcacctcttaggtctgttttctctaacatctagaacttttgtgaagctgttaagttgcagcctataccaactgttgaccttttgcttatagctttaaaataatgtcttagttatcttacttcatatgaaaagaaaatgttatgagtaagagatttttcccttacctatcaaactgtcttttaaacatgttttaaatatttcaatgaaaatatttctaaagtatttattctcctaacttattaaacagaaggataaaaaccgtaatcagttaaaaaacactcagggtcaccattatgagaatcatttaataaatgatgctctaatgcagcaatgtccttagggctctttgaagtatgaggaactatttgcccctaagctaaatggccccagactgttctgctgcagttgcttctgccttccttttcagctgtcacttctgctgtcattgatttgggttcactctttgaccctttttaacccagtgcagaactgaatgtctagaaatcagacagtagagttggttaaatgtgcaactggagtatttgtgtacaaaataaaggctatgttccagagggtggcttcagtctcctacagtaaatttcacagactttgaatatttcttcttcttcttcttctttttttttttcggcaaacccaaggcttcccttgcttagtgggtcatcccacaatttgaagtaatgtataagcaagccattgctatacttctagggttgtttattgaataaatttagtatatcaataggtgataaaagagacaaccattttaaagcctctccatatgtttgattaaaagaaataatattcctgtctttgcacactgaaccttaatctattttcatttgtcttcataacctcttataaagcaaataattgccctgacctttttatctaacatctgaattttccttatctcatttgtgtgtgtcctttaagattcaatgacaatgcacagtaatgtagataacgtgataatactttctgttgtgtttttagcacgctttgtataaatcatatcctcagggtcccctttattcatatattctacttgcaccacccaccccaagagtcctggtttattagatttttctcctttgccaaaatatttgggttttctctccccccccagcataggccttattttcataaatgtgtagtgatttcacctttcccgtaaagttggccagcctgcttgattatggaaattagatttactggtttctacttcccagggtcccttctagaaccccgcttatgaataggaattacattgacaagcaccagtctcgggcacagtggctgtttgtaaagacagcctacacatgttggccaaaacagtttcacccttgagttacttcaaaactggctggtggataccatctggtcccagtgatttatctactcctggtttgttgattagatgcagggcatcatgtttaccactatttgatctagtacctctgacctgccgagttcagtgttctggtttggaaatgcgcatctccttacaagacaaagaattcattcagtctctccaccatctccattttagccctgtgactgtgattaagtggttcctctaactggcttcctccctttgatagagcaaaagagcctcttactatagcctttgcaatctcttgcaagttgctcctgcctagattttattttgtgtttaacctgctgtgccttacaggattttctctattccttctctggactatttttttttctttaatcaccactgctttttcttctgccttttaaccacaaggaaggttctcttctctctccagtccccaccacctcccccgccaatataagtaattattctggggcgactataagtaagtttttttctttcccctttttaaaccagtctccaggcatcttgagggttgtttactttccgaactccctcagtaatgccctgcttttgtcacagattcttactctaatatagcaaaaactatgtaatggggtttgtacttttcctctcccatcaagttgttaaatttaatattgctgtgtggtcaccagtacacatttgtttatccacacttacttggtgtcctaagtcctatgtactactcaagaccaaggccaggtatctcttgggacctttcttcccttcccccctccatccctcatactcctgttctagaagcacttgttcaggaagtaatcatttttcgtgtctccagatcttggctgtagatcttggcaggtaagtattatgctgatgattttttttttcattcatgtctgtgaatcttcacacacaaatgtaagaggataatggagggaaatctatggtaccaatctaaagctgagtagaggaagacctatttgacagaaatatttaagacataaagagagtataagggaggtgatccggtgataaactgacagacgctctaaggtcgatatactgtcatcagcaacataaaaaaaatcagcacttaaatgcatcacaatggtacagagagctgtcatttccatctttgttctcccttcctttgatgtgatagggagccaactcccttcatctccgggtggaatttttgtttgtttgtttttatttgacatacatttatccttagacagtctaaatttccaaagcatctgcctttatttcatagagcggagagttctttcaacaaaatgattggctattaggaagaaattgatcatttgtcaggatagtgcagcagacacagtgcatattctgggcacacaatatttttgtaaagtcagatgcatatctactcaagcaaatagtgtcttgtcttaatcttttgaattttattcatgagttagatattctaggatgcaaatgaatcatatttatctgtagaaacctttggatattgttgctaagttgattccccaaaatattcagtcagactatgtgaaattgctgatatttgacctatttggcctaaaataatggcactctcataagaatcaacctttaatattttgtttttctttaatctctcaaagctcataacagaaccatttcaaaagctaaagaaaagattctgtagctcataatcctagagcagtattgcaggttgtagcctgaatttttatcaagggactgttttgtctttctgctaaataaagctaaatttccatttggtctgtaatttttagaaataaatatttccaaagactaaaaataatagtaatgataacaatagaaacaacaagaaaacaaacactcccccattggttaaacatagctgaactctgaaacatagaaagaatcccctttctgagaaatatatagcatcttctgatatcagtgttcataataatagctgctattgattgaggtatactgtataattttaatgcttctaacaactctctgaggtaggttctgctcttgtcctccttttacagaagatgaactagtctcagagaagttaggagggtggctcaaaattgcacagttggtaagcaacagaactgagcctaagctgggcatggtgacgtgggcctatcatcccagccaccatgaggtggctcgtgcttgaggtcaggagtttcagactagcccgagcaacacagtgagaccctgtctcttaaaaaacgaaaaaaataccagatgtgatggtgcatacctgtagtcctaactgttcaggaggctgaggtgggaggatcatttgaacacaggagtttgagggtacagtgagctatgatgatgccactgcactccagcgtgggtgacagagacgccatctctaaaaaaaaaaattttttttttttttttgagagagtcttcctctgtcacccaggctggagtgcagtggtgctatcttggttcactgcaccctccacctcccaggctcaggcaattcttctgcctcagcctcccgagtagctggaactacaggcatgcaccactgtgcctggctagtttttgtacttttagtagagacagggttttgccatgttgcccagactggtctcgaactcctggcctcaagtaatccacctgcctcggcctcccaaagtgctgggattacaggcatgacccactgcacctggccctaaaaattatttttttaattaagaaagaacttagcctgaacttgggcttatttacctttgaagctgttatgctttccatataacatgatgcctccctacctcagagactcagaacagagagtccagtcaaaacatttatagctaatttcccacactgttctgacatacatactatacagtatgtagttagatagtaaatcatgctccagacaagcttttctgttctcttgagtttcccacttgttgtgatttatccatttgttttttactgaactgttctgattgaggatccttggtgatgtggagtgtcttagtccatttgtgttgctatgaaggaatacctgaggctgggtaatttataaagaaaagagatttatttggctcatggttctgcaggctgtacaagaagcatattgtcagtatctgcttctggtgagggcctcaggaagcgttcactcatggtggaaggggaaggggagcaggcatcacatggtgagagaggaggtgccaagctctttgccaacagttctctcttaggaactaagtaagaattcactgccaggtgtggtggctcacacctgtaattccagcactttgggaggctgaggtgagtagatcacctgaggtcaggagtttgaaaccagcctggccaacatggtgaaaccctgtctctactaaaaatacaaaaattagtcgggtgtagtggcaggtgtctgtaatcccagctacttgggaggctggggcaggagaatcacttgaacccaggaggtggaggttgcagtgagctgagattgcgccactgcactccagtctgggcgacagagcaagacttcatctctaataaaaaaagaattcgctgctgcgagatccaggccattcactaagtatctgccctccacaatccaaacatctcctgccaggccccacctccaacactggggattagatttcaacatgaaacttgaaggggccatacaaaccatatctatgccatcgcacagaataacctaaaattcttggttcttgaagtgcctgactgttacgccatttttgcatcactataaagacatactggaggctgggtaagttataaagaaaagaggtttaattggctcatggttctgcagtttgtacaagcatggctccagcatctgcttctgatgaggcctcagggagctttcaatcatggtggaagggaaagtaggagacagcatgtcacatggtgatagcgggattaagagagaaagagtggggaggtgccatactctcttaaccaaccaggtctcatgggaactcagagcaagaactcacttttctcccgggggatggtgctaagccattcatgagggatccacccacacaacccagtcacctcccactaggacccatctccaacactgggagtcacttttcaacatgcaatttggatggtgcacacatccaaaacattttcattgacccttcttgttctaagttgctgcttactgctacttactggtggaataaaaagaagtttgggttctgtatgcggtcccaaggctaccaagtgtgtcagtgctgttagaagagttttaaaccaataagcaaaatgcatcatgactatttcttaatataggctcattttgtaatagtgtgttatgtttgtagccacaaatcatggagctatgaaggttcatctcataataacgaaacaatgcttttttataagagtatattttctacttgcccataccaccaagtcattcggccaaatggaagctcagacttggtgctactgagcaccttttcctatgtatatttatgaaactcgagattgaactattgttctttttcaagctcatgcagttctagtatagtcattctgcatgactgaacttaactctagtcaagtaaatttgggttaggttagttggtctttgtactggcctatgttaattgtcatatataaaaaatattaatagaaacactcatgggcaaaaacataagcatgctttctggatagcctggtagaactcattcttatttaggcagttcatttggaaaaatcaggtcttataatgctggacatttaatttggcttcagcctttgaaaggccgttcttccccacattgaaactgatttcagaatatgatttaatgtatgtgctgctgtagcattgcatacaatttaggattatgctgtcttgactcagagttaaaacataagagtagctagattaaaaaaataaaacatggccgggcgcggtggctcacgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaataaataaataaataaataaataaataaaacatgaccttgcatggtttatgatccagtgaaagataaagagaacaaagtgggctgttctctgttctttcatacttctggtactgatactttttaaagtacactacagtgtttactatttcaaaccgataagcacagcactgctgccaagtattatctttaaaacaagaccgacatttaattcagttgtcatatttgttctcatccttgaaggcagtttaaaaaacagttgcctctcattggttactgtgggatcaggaaaaactaggagcttatgtaaatatgcgtgtatctgaaaggagaaggtttatttttttattttcctttgaagtacctttaagtgtactcttaaagtatatcccgaactgcataccattatgtgttttccacataggatgaaacatcctcaaggagaggggctaaaaataagtatattaaagtaacttactctttgctggcagaaggtcctggtacaaaattaggtccttgaattttccaaatgaggttgtatttattgcccttcttttctaagaaaggctattttaataatttttgctatcacatcaaagacttttcatgataattatagtcaataattgcagtagtaatgctgcgtgccatctgcaggctctgtgtaatggaaactagggagaaaaacgtgtccctgtgcttgatgggagttaccacagaacgaaagaccctggtgcctgatcaccacttgcatcagttgtaggtgactctcccactcctgggcccttggtcatatatactgtcttttttttctccctttctcctttgacccatttccttccatttctttttctctcactccttcaggcctctaatgtgcaggagtaagagagaaagaacttccccatcccccatgtttgttgctcatcctaaagtagctgacaggccacattctaggagtagaggagtaattggaacttctttgggatcaagtgtttgaccaaatcaattggtttatgagtgagcagttggcccattaccaaaaagagttagagagggcaagctagacattgaagtaacggaatgagcacccactcacccagttgcaccaggtcagagaaagctgtctgatactttcaatttgtgagcatccggtctcaagcttgtctgtgggccagatttctgaagtgctgatgtttctcttaggtcctgtgacaggcattacattgtatagtaactccaatatcagccccatggaagcaaccctaagttcttacaggctcaaattagagtggctcctatcctttcattcatacccaaagcaaaaatggtaagatgcagccgtttcattcttggttagttctgcagtaaagaagtccaggacacttgcagcgcactttctggagcatttgtatctatctctttggcccagtggtgcctaagagggccctggtatggttagggttatctgaagatgactaggaattgaacaggccttacttgaatgtgtagtaaatgactggtttctctcttttctgtgtcacttgctgacaaagaggcaataacttttccatcttcttctctaaggaagtaaatttttttatgtcataagtagacacattaatactttaatatagcacctaagatctggctttatttttccttccctgtggtacttaagaaaccagaggaaaatggcgggtggctggatggcagcccagttgaagaattggctaatcaataccttgcctttgagttcaggcacctttttatcagggttttttagagcctagaaaaaaacagggattattcctagtgtgtggagaggcactgggtggtatctcaaattgttcgttgttgagtatatatcagtcacttgagggcatagaagctctcctctggtgagacctctactacaaaaattgaacggagctatgccaataatttattgactatccaaatataagtttagggaagcttgttatcaagtgaccaggttagggcctttaaaaatcaaagcactaacattgtctgagttttttttttttttcttaaaaggagatttgaatgtttagtgacttctgatttgtcaaaccaaggaaatgaaacagcatgtgtgtgggaagtctttgttctgccgattttgctttgttgaccaagaaaggcagcagaactaggtccccaaggagttttattcacccttgccttgtcagattttgctctgagtccgagataatgccttcagtagttttggttgtctcaaaaatggacatagtatatatggcaatgtataggttatatctgagtgtgtgactctctcctactttgtccaaaggcacctcctatggcacatctgttgaagttccaaagtgagaagaaacatgggttgagttgatttgcctgatttagcatcatctctcctgtcttttggacttgagttgttccaagataagattagaggacctcagagatcttgtggtggggagggggttggaggaattcacattatagagtaagaaggagagagaaaaagcctagagaacaacaataaaatccatgtctgttcatcttgtaattttcaagagggcggagaccaagccatttgtattttctgcactgatggatggcatctggcacataagagtcacttgataaatactgcattaagcaccaacaatgtttttgtgttgccaaatcgggtcaaaggttagtttgggagaagtgaatcaaatctttgacttagacttggggaaaatgttagggcagagttccattcccagataatctcttgcagtggtctagttgaagtaactagttcacgaagtggtaaatatagtggattttctaatcataatgaataaatcaaatgtagttaattaacaggtctgattctaaaggaaaggttctgaaaggtgagattggagaatcaaatggtgttaagaagccactaggataagtcccagtcagacctggggtgcctcactaataaaggcaagctggtagagtctataataaaggctgaggacattgaaaacttaagcaaactcagtcttccaggaaaggcaacttcgttaaataaggggaatctgtgctttgctagtgaccttgtgtttctcaggtggctaatgcatatgtagagaatggaaaaccattgcacgtgatctatttaggttttcaaaaagctttcttggtggcggggggcagttgatgggggggttcacaccaagccaaggaaactcaaagtaactggcacaccatggaattgtgggactgtttcgtcaaatattatgattgactttgaggcaggaaacaaagggtaagggataaacacaggtaattctctgaatagcaacatagtggctttcactccaaaattaggactgagacaagttttacttaaagctccaggaactgacctggaagaggaagtacacattgaaatctttacatttgtcaacaaaacttttctaaataacaaagagcctattaaatggtaataaattgtagggcatgtggcccaggtgctagggctttagataatgggtgaggaggagtttttgtttttgttttgcttttactgaaaatggcatgcttcatattgcataacatgctgcttgaagacttcatggccagttgccagggttggggaaactcagccttgcaaaacgatggggagtatgaggagggctctgcctctccctcatctgcccattccaaggttcagaagaatttttctctcatgttataaaattaacccctggtcaactgtggctcatgtccatatccataggaactgggacttattaacagtccttcagtgcagatctgtatcagagtaagccgtaacttaactatgacttttagcaagaattttgtgaagtgggttttaaaggatgtaattaagcacagacattaaaaatgtaaatcttactttcctctgcaccattttattgatgcctagctagaattttgaggaatggtttgcatggatcactgttttttgttttttgttgttgttgtttgtttgttttgttttgtttgcagaatgaaacattcccccccaccccactccaaggcttgagtgcagtggcatgatcatggctcactacagcctcagcctcctgggctcaggcgattctcccacctcagcctgcctgactagctgggactacaggtgtgcgccaccatgcctggctaatttttaaattttttgtagagacacggtctcactatgttgcccacgctgatcttgaattcatgggctgaagcgatcctcccactttgacctcccaaagtgctaggattacaggcatgagccactgtgcccatcccagaatcatttttctttatgtgaggaagtggactttgccattggtgggtttacataaaggctttctagatagccatttggagaaatatcttttggagaattaatgatgaatgaatatgttattcttctggtatattttttctagacagtaaatttactgaaaacctcttaccacgctgtattttgaggggagaaattttgggtatattgtgaaaaggagggttaagagaagctaaagacagcttttaccttcccttttgtttaagctgaaagcaattactaaaaaagagaaaataatttgatgttaaaaattgtcatgactcagccgagtgcagtggctcatgcctgtaatctcagcactttgggaggctgagggggaggattgcatgagccaggagttcgagaccagcctgggcaatgtagtgaaaccccatctctacaaaaaatacaaaaattaaccgggtgtggtatcacatcccctgtagtcccagctactcgagaggctgaggtgggaagatcacttgagcccaggaggtcgagactgcagtgagctatgttcacgccactgcgctccatcctgggtgacaaagcgagaccctgtgtctcaacaacaacaacaaattgttatgactcacacaatccatgaaatgtacgtaagaaggcagactttaatcattcaattagagcaggtgtctgaaatgtctgatatctgtgagcctccccactcaccaactgtattttcttctacacttgcagcaaattcagctgttaaccatttcggatattcctgtgaattctaaatggctgtggcaggctatctgagaatgagattcccaggatcttctttagagattatttggaaataatatggaaaatcatctgctgttggaagtcagtgttgattcagcccctaggggaggaggaaaggggtgtgtctgatgtcttcctgaggataccttcttccttttgctttctccgaggtcttctgtgatggtgtgcaggagactgcccactggggcagtcactggagatgcaaagaaagggcaaagtgctggcggctagccctcccctactctgagaatcaccatgaccttccaagccaggtctgatcagctgtctcagagatggccctgctaaggccttggtctaccagctattatgatgtgtggcttggggatacaggttccagagggaaaaaaagtcctcaccaatggcgttttctgtctaggctgctttttattcatagctgaatgtatcactggggctctaacagacgtgatcaaccctgggaatctcagtctccatacagtctctcatctcactctctgtaaaaagaaaacctcagagttaggggagtgggagtatgagaaaaattcaccaataaaacaagaaggactttgaggagagttgtggaaatcttaatttcataggcactatgtaacaaacaccttcaaagtctgtgtatttgtttttctcttaaagagcttgaaactcacatgtgactccttcatatcacttgaatgagtatgaaatccgtagaggcatttggaatcatttatttatccctaggccttctgttaaattatgagcctagtgaaaatcataattgctacttaagagaaattctcaaacgatgctaccaagatatgtgcacctgaattattgacagaaaagatctcctttgttagttgcaaaacaagtaagagagctccatcttttcctgtctgctccttgctatcccgcaaggtcccccagcacacttctgtgagccttttattagcactgcttagaaagtatttacaggagcctcagaatttttggagagttttgggttaatcactagtagtattactattccttttgagtcctggaggtagtggttgtaaatgtgcaaaatagatgcagttgcttcagctgctcagaagtgatggcaacacaaggtcaaagtgtgcatttcaggccattcactcagtttggtttggtgtgccttaataaacctttggtatagttaaaatggggatctaagattgtcagatattaaccttggttgacaatttgcttatcatttgaaaagcagtaagaagccttggttgatttctgtctggagtgcagtttaaagctattataagctcattgaaatgaagtgtagagttttaaagtagcaaccctaactcttccaactacacttacataaagttattcttagaaaaatataataaaactgattattgaatgtatgtgtttctgactggccttctctatactaccttgcaggattagtggacctagaaataattggcagtcttaagccctccagagctatattttggcaaggttttgcaaaatgctaactggctgcatttctcctactgattagtaggtgatctcaaatcatacatctgcataatgactgtaatttacgtgctttgttattaaggtcagatgactccaggctttggatgcacatagcacattttatgcagtaatttcactcctttttggaaggagggaggatggattaatgtacacgtccccccacctccctggagttattaaaaacctttagagattttctttctttgttcccatgaagcagagcattgtatgttcctcatggggtcttaggtagcttagaggggctggagttatatagcaacctgcattttagttcactttgtggctacatgaatttagatctaagaaatgaacagaaactattttggtaatgctttagaccaacagcaaggaattattttacgtttagaacaataaaaattagaaaaagagtaaagtagcaattgagggattaggaaaattgctccagcaaataatagcttaatacagctccccaatattagaattacatcaagtatttatatttttgaaagcatgatgaaagtttttccccgctggccacatgtatttatgctttttaatttgaaagccaagacttgcttttcttaaaaaaaaaaaaaaaaaaaaaaaaaaaaaaaacttctaatagaagagttttagatttacagaagttgggaagatagcacatagactttcctatatctcacccccagtatcccgttattaacatcttacattagggtgggtatatttctcatgattgatgaaccaatattgatgcataattacgaactaaagcctacacttaattctgatttcctgagttttttggtaactgtcttattgggatatagttaatataacaaataattcacctatttgaagtgtacagtgacttttagtatatctacaaggttgtacctccatcaccaaaatcaatttttcatcacccccgaaagaaaccccgtaccttttagctggcatcctcactttcattctttcccctctcccccagccctgggcaaccaagaatctacattctatctctagatttgcttatgctggacattttatataaatgtggatttttttcacttagcagtgtttttgagattcatccatgttgtaacatgtatccgaatttccttccttccaatggctgagtaatattctatttacagatacagtagaccacattttgtttatccattcatttgctgatggaaatttggctattatgaataatgctgctatgaacatttgcatacacctttttgtttgatttccttagtttttttccccacaatgtacttattctgttccaggatcccatccaggatatcacattatatttcctcatcatgtctccttaagctcctgtggcttcgcttttgatggccctttgaatcccttggttgatggcttggtcaccatcagttcaccatcacatatgcatgccgttcagctccttgatgtgccctatttccacatctttctgaactagctagaaaagaaaagtttgttaaaagaaaaactttggacatgaggcaggagaatagggtctggaggcagggaacctgaggctgattcatgctgacttcctataactaaattgaaaggaaaaccccaactttccacgcttaagtgacaaaaggaccagaggctacttcctttgcaacaccatgccccgccccgccttccccctttttctgcatggcaggaggaaaattgaaagtacctctgattggttgctttcccaatcagacatttgcataggagtgtaactttgtaacttcattttagcctctgattgcaggccactacttcatttgcatggggtaaacaccaagtggccaatagaaacctctagggggtatttggaccccagaagattctgtaactggggcccatgagccactgcttggttggctcccaccctgtggagtgtactttaattttctgtaaatctctgcttttgttgtttcattctttccttgctttgctgtgcattttgtccaattatttgttcaaaacaccaagaacctggacaacttgcagtcaagaccctctactggtaacagacaaattaattttaacagaatttaactgagcaaagaatgatttgcaaattgatcacccctccccacaaccagaatatgttcagagggattccagtactgccatgtagttggagaggatttatggacagaaaaggaaaagtgatgtacaggaaacggaagtgaggtacagaaacagctgagttggttacagctcagtgatttccttatttgaacatggtttgaaccgttggccacctgtgattggtgcaagagcaagttacagtctgtttacacacccagtttaggttacagttcactgtgtacggggaaacctttaaaccaaactttaaatgtgtaaggaggcagctttaggctgaacttaacaaggtgctgcttttctggcgcccctccctcacctagtacaagttgtcagaaatggttcttaacacgaaacttcagtagcttatcagagcataagagatgttcatttctttctttgttttgcaattgtactgtcttacatttacataatgcctccttgttttcaaagggcttttttcgttttaaggttccagtggataactgactttcccaagagtctttaccaaaagcttcccaatcatgtagagctgggcttcaaacccatattcctgacttctagataaaacttaattatccctagactgctgctgttatctctgcagaataaaagaaccaagtagttttaaatatttggaaccttttaaattcactccttaaaaaaaccccttgtaaagagctaagttttcttcataactcaagtgaggcactcttctagaaaggccaatgcaaaatcatagtctcttatgtttgcagttttcatagtgctttccagtctgttcttctcaaatgttcctcactgcggtccttacccttaaggaacagtttgtctctcttatttaccataggcatttggttgctttattggtaaaattagtccgagtaccaagagtgtctgccttaaaaatcccactggtgcaggcaaagcctgggttctctaccagtgtcttgcaatgttttctggctctgttttctccatttaggacactgggggagtaaacactagagattttctttatttcccgcaggtacagaaagaaagctgacccctaagtggtaactaccggtattcctctattactgccccacctcccaaaaaagtggggagaattggagagacactttcttggcatctagttggatttctaaatgtattttctgagagagatatagaaaatggttgttagacatagttgaaaatagtcaccgggcgtggtggctcacacctgtaatcccagcactttgggaggctgaggcgggcagattacctgaggttgggagtttgaggccagcctgaccaacagggagaaaccccgtctctactaaaaataaaaaattagccgggtgtggtggcgcatgcctgtaatcctagctactcaagaggctgaggcaggagaattgcttgaacccgggaggcagaggttgcggtgagctgagatcacgccattgcactccagcctgggcaacaggagcgaaactccatcaaaaaaaaaaaaaaaaaaaaaaaaaaaaaaaaaaaaaaaaaaaaaaaaaaaaaccagaaagaaagaaagaaaataaagaaagaaagaaagagaaaatagtcaagttagtagtaaataagctgagggctggcctgagcacctatctaccatttataacattttctatgggaagctgagttatgagcaactgaaaataaacgaacattagccgcaccccatttgtacatcagaggcagcctttggtgagaggagtaaatgagataaaatgagaaagcacagtttcacagattgcctcagagcgctgttaaatgatggaatagattcctcatattcaatgcctacttctttaaccattgatttgaagtgcctcaaaaaaaaagaaccaatacacactcagcaggattgagagtaatttattgtgattgtctttgttcagctttgaaaactaaggcattgatattaagactaaagagaaattacatagagctggtgtgattgaaaaaagtttggctctttcgagtgattttttttgttttgtttttaatgccagagagttaagctttaaaagcacgcttcattgaatcccatccaagcctcctaggacagggctgggggaccttttttctattgagggccactgacccacaaagaaaaaaactaatcaagggccatgtacaaaaagcaacttaatttaggtgcttccttggaaaaccataaagcattgaattcacctgctttttaaattaagaacaaggaattctcaacaagtacaacaaataaaaaaacccttcagtttcatattatgcaccacttaagaggtggggtgggataagagagaactacatggttagagtgaaaagagagtggaaagcagacaggagagtcttaatggactagaagcgatacatgaagaagaaactgtatgtcaagagccatggaagcaggagattgaattagggaaataggggagagaaatggcagttgtagatcataatctactattcactaaggtagtagactaactggttaactgctatactcagctgttccacagctggaattcagaagcctttctgacaacaattcttaaggaagggtcagaatcacctagagcccttgttaaaaagtgcaagtgtccaatgctacccccacagtggctgtctacctgtcccatctttattctgttgtcctcgtgttcagctctctcagcctaaaggaaaaattgtggcatctttcttcagtgagaagaatataagatcaccgggcttagaaaggaaatctccagaaagaaaagatttctcactcaggcacagcattttagaagcagtctcaaacacataagacagaatgcctttcaaataatatgcacgccctagccttcaaaataaaccattttgggtgcttaaagtagaaatattcaagttaaaaaaaaaaacttaattagttgctcaagtcttcaaagattttttaccagaacatggagctataatttcattttcaaatgtacccagacttgtcctccttttcctccctgtgcttctcattagcactaactagttgtggcaccgaatccccagtagcccaagaatgtcttggggtttaattcacaagtgtgtcttggactacgtgtgtcacagggcttttggcaagaatgtcaaattacattttcaagtaacgctttttagaaatgcagacaggataagtggtgcattcggggctatatggcccaaagtgtgaactttgcactgaggggcagacgactttgccagcagaaacattagccaagtatctaccctgttgttgtcctttacataaggcaagcctttcaccattagacaaaatcttcccggaaagatctctctgagatgaaagtgcactatttttttctttttaaaattagatattgcaggccgggcatggtggctcgcgcctgtaatcccagcactttgggaggccgaggcgggtggatcacctgaggtcaggagttcgagaccagcctagccaacatggtgaaaccctgtctttactaaaagtacaaaaattagccaggcatggtggtgcacgcctgtaatcccagttacttgggaggctgaggcacgagaatcccttgaacccaggaggcggaggttgcattgagccgagatcacgacactgcactccagcctgggcagtagagtgagactctgtctcaaaaaaaaaaaaaaaaaaaaaatagtgccaaaacaaagacgtgccccagtgttccagtatcagcaagtctcgataaggttctgcttgagggtcactggtggagatgagatgggtggagtgcatgggccactctgggccttttatgtgtggcagtgtaaatggtgccatccactcggaccaggttactaggaaaacttttattgctgctacccgtttttgaagggtgtatccttagtataaattccctgtgggtgagtttaaacctgtcaacatctagcaccttcttcaacagagaaaattattatttcctgctgtctcttagtattttcttgctttgaggtgtatgtgtgtgtgtacgcatgtgtttgtgcatgtacccatgtacactgggggcagggaaaaatgatgggtacttttctgtgaacttagaaacctattttgataggatccagtaagtgaccctttattaggtgtgaaccctgttaacattaggtgagtatagtttattttccaaactgacaagttattttgccttgaaaattcatgcataccacaatggaatctttgcaggtgcttgaaaaaacagcctatcctatgatgaattttagcttatagcaatctttaaaaattttatttaaagtctttattatgaagtaattcatttaaatcaccctatgtgggttctcattctgagcattccaattcattttctacagggggtatgaatataatatgtattatttaatatagtgacagcactgtactatttgggggccttcatattgttttatgtgtttagattgtaatggagggaacccttacctcaacactgaaaccaggagacaactgaatctttctgtgttaattatgtgtcccagtaccgaaggcctgctgtgaacttgttaagccagtgaagagggagttttgtttttggttgtaacaaaggtgtttccataaaaccgagccttagcaacccctcttctgtcactaatgagatctaagatattctgcagactcacagctctaaacttgattacacaaccttttttttcccttttttttctgttagtagaattatttattgaccaaggttttcagaaatgccaaaataaacttttagcagtttctggatgaggaagttatttgaagattgttgctctttctgccttccttacatggtcctttaatgctgcatactccccttttttgggggcactaacattctccctactttttaactgccaggaaggaagaatgatcgggaacatatatgattatataattatttgcatatgtgcagttgacaatctagtgttagtcaaataaattgccagctcaattttatctgaaataccctgctaccctaaagctgctttgatatctccattaggtgaagccctatttcctgtaagtacacatggccaagaagcagcaatggccagctcatggaccatttcgttttccatgattagtgttgtttgaatgattagcttttaattccccatccctttgttgattggtcacacttaccattgacaggttcacatgtcttcagtatactcattcctgagttcctcagatcatctctcttttcagaccccttttgacttgcatagaacatggacagcaatagcagaaggaacagtgagagtcaatccttgtaaacgtgtacaaaattataccacaccaattaatattggagagactgaagtgatagtagctagtggggtttatttttgagtggcattgcatcttgtggtcattataagagaagagacatcgtctcttcaaagcacaattttgttctgtgacagaggagaacaagggggggaactctggggcatatagaaaaaaccccccgcccaaccctcacctccaaactgcaagccaaatgcagttggtataagggagggagatacttcgtgggttgggttgctgtggagtgatgtgtctttgacatttcccttgactcttggggctgcatcactacataaaggtgtttattggaagttgttggtctatactgagatgatgctacatacacagaatcatagggtagatatagtctctgacatctgcacagaatacattggataaaaaaaatcttaaactcaaggattgaggattaccatcacccctttgtgatttatcataggctcagattatccagcataaacccctatagtttcctctttgctggcaacccttgaaatgcacaaatccctttgtttccccacagtataactattgcacatgtatttgctcagtttttggctgttgtcacatattttataaaccattcgtcattaaggacagtctctcttggagtgtaaactcccaaatctggaaaaactgtgtctcgtttgcatgacttctgcagtatttagcatagaatatgagaatctctgggaatttataaaagagactttagttgacatggaatattatattgtttattgactacaccagttttcctgttggtttagccatctctctgattggaaagttcttttgctttttggagagggctttattattttattttctcaaaaagggaatgaatatttttagacttcctggaacttgttagatacacatgttgcctgggcctttgcaggagcctcacaggttgaaatgaacctaaatcaaacctttccctcttggacttcatgaatgatgatagacattgactgtcttactttttatcttgcaggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatggtatgttattcaagtcatatgtaagaaccggcagttaggtctgtactgtagctttttcacagctcctctgctccctcagtgcttaagttttctcccaagatgttgtccttgttggataccagagacgagtttaccctgtagctttatggctagaatacttccggatgcactggaatctgtatggtaggcattatggaaatatggtcacaaggagacaaaaaatagattagtttaacttaaatgctttgatttattttcttgggtgaacacagaatagtgttgttgacgcaagtccctttaaaaaaaaaaagacctcataataaaaagcaggcatctgaaaactgtcttagtcaaaataaagagaatttacagatgctggacttcaaattaaatttcaaaatggatccccaaagacaactagaattcctaaaagttttgcagaacacaggcaggattaaagttcttgagtttccatgcagcagagacccaaaagtagccattttactatagtcttcattaagctgggctccatccaacctcacattagctgaagctctggcatagtctttccatgtaaaagccacgacagaacccattctaatcacctatgccagacgtggcttcttgcaggcacactttctcttaatattgaagaaatagccaatatgagccaattgaaagtgtactttgatcctatctgaacaatggtacagataacagactttaaaaaatagaatatggagtccaaaacacctcaggattcttttccctggtgctgttcactcagtttgaagatttttatgaagtagatttagttttaagaggattgatttcctttgtgcctgttttaaaggccattctaattacatagtacctttgaagcatgcttttcttgacattatgtgtggtgaagaagtacaagacaaattttctagatatgaaatgtctttgagtatttctgcaaagggcttgttaccatggtgagaaagttagactaaattagatttgatatagctgataaggcagtcctcagttaaagaacaggttgtatttcaaatgttggctttgagatgtgttatttcaaacttataaccaatttaataagtgttaggttcccaggtgagaccacaaaagcatatttaatctataatgtagttgaactaaaacactgtctatgtagtatgccgttgatcctacccattttttcaaacacgctatgtgcaaaattatgtcttagttctatcacctttccctggatgaatgggaacaatttatatatctgtatatccttcttattacccatatccccctacatatatgctgtagctgttaaaagtatttaacaatatgttaataccatgtgaaaatgggtgttattggcaaaatctatcattagacctcctctgtctctcctgatcactgaattattattattgaaaagaatggtgttttcctgaccatggcatttctcattcaagataataacctaagccttttcttttactttggggagaaaacttagaaagctaattaaatggtcatttttgaaaacttaagatgttgatatttaaaaatcaccacttaggggcttcataatggaatttagaaggaaaaaaaaatctgctctttagaaatgactctcccgttggcagcacaatgtagtggagataaagttgtttccaagttccaaggccttctactgcaagtcacctcatttcttgttagacttgtatcttcctggcagggagcccacagtcattgcctatgggcctactggtttagctattcttttcccttctcgctccccatggttttatagcactactatgattccaatgtgtagtgttttgttgttgttgttgttttcttcttaaaccatacagagaaactttatcagtaagtgttaacatgtgttttttaaaaaggatagaaagtttttcttgctcttccctaccaggcttcacattcaataaatatgttaacactgtgccttgatcagtttcaaaactttaatgattatgaaactccagtgttttttctgacttcaaattaaaatatggcataggctgggcatggtggttcatgcctgtaatcccagcactttgggaggccacggcgggcagattgcttgagcccaggagttcgagaccagcctgagcaatgtggtgaaaccctgtctctactaaaaatatgaaaattagccaggagtggtggtgtgcgcctatggtcccagctacttgagaggttgaggtgagaggatcacttgagcctgggagttcaaggctgcagtgagccaagattgcgccactgcactccagcctaggcaacagaacaagaccctgtctcaaaacaaataaataaaataatataatataacataaaatatggcatagacaataaagttagggaacatagatacaaggtttttttttaatgggtagtagctgaaatgtacttgatctggagatcaatatactggaatgctggaatactggaatgccagaatactttgcacattttctccatgttaggttacagaaacaatgagataattttatatggtaaaaccttagttgactggtacccaccaaatcatagtcccctagtgggtgctgcattgattgattaattttttgtttgtttgttttgagatggagccttgctctgttgtccaggctggagtgcagtggcgcaatctcggctcactgcaacctctgcctcctgggttcaagcgattctcctgtctcagcctcccaagtagctgggattacaggaacacaccaccacgcccagctaatttttgtatttttagtagagacggggtttcaccatgttggccaggctagtctcgaactcctgacctcaggtgatccgcccacctcagcctcccaaagtgctgggattacaggcatgagccaccgcgcctggcgatgattgactaatttttaaggctgtcaattaggacttgccagtaattctcaatgcctgccgatccaagggcattgattaacaggctataggatatgtcttgactctcagaaattcaagggtggatgctttggccaaagaattatccaaactattataatagctaaaccctggctcttggtgtgaattgaagagagaaagttgggcagactaaaaagatggtggtagggaaccaagatggagcagtgaagttgcacagagacagctggggacatatagtaaggaaatagtaaaaggacacatggaaatattatgggtcaggcaacttcaagggagtaccttttgtcatctgcaagcttacagtgtaaattcaaagtggtgaccttgaccccagacaactttgtctatcatcaaaacctgtctatgtctatgagataccacttctttctaaggtagaaataattacttttaaagtaattattgaaaaaaaaccttttcaacaaaaataaagtttgggggcttgtagagagttagccttctgttaccagaaatcatctcattatcccagttttccatcattcttcctcaattgaccctggtcagggttctagtgccagttctgacatttttatagtcattggatttgagagatgagtcccttctccagttcccttacctctaaggcccttttttattctgtacttttaatttcctatcgtttgcacatctcaagagactgtacggtctatatcagtttttaagatataaactcgtgtgtgtgcgtgtgtgtgtgtgtatgtgtgtgtgtgttcggatttgggtgacgtacaagagaacacttcctccccctcaaaaatcatcagatttcttatattttaaatctatatcactgagtttaaagactggcctctgtgtttttctatgctatcattttttaaacccactttttaacttaggatgtttaataccagaaatctgtattctgctggagacatagagccagattgtggtagtgacagagctagctgctccccctcttggccaattctgggaattttttgatagtagagctgctaattaacttagctgaatcagtcatctcatgaatatgctaatcacatacttaattcaggagggagttagggaaaattgcttggcaaagggaatagaaatagaagtggggcataatccgtgttttgggaccacagcataaagacccgcccccaaatgcctggcattttgtgagaaaatagttgtttttaaaagaagcatagttaaaatcccaaataggttaaggtgattacagctgccatgttaaatgtatttctgaattacatagtaaaaatgatgttacagctatgaagtaatgtcattgctacataactgcctgtatcaaactgtagatattctgcatgtttaaataactaaggaaatggttgttgtctgatgctagtctattgggaaaactcctttaatttgtcattttcagagcaaatttaataactttggatgggaggcagtgcacagtgaattatcatcctagttctgcagtgaacccactgtgactgtgacctggggcaattaaatgagtctcagttttcccatccataaaatgagggggttgagctagatgctctctaaaacccttttcaatcctaccaattctgtgaatcttttaaacatgtgactagaccagctgctttagtgaaaggccttacaagatgttaattagccgtctgtatggtaccctctattttccctctatcattttttaactctcagctactttcaccaggtctttgaaaaaccctcccatgagcctgaagcttgttaacttgaataatagtagaaattttctgaattagcttaaaatgcacacaaaagaaataattgtctgtcccatctatctgcatgggccaagtgtaaaccaagcagttacccttcccttaagccctaaggccccttgtttcctatcacttcacagaggcagggcacgaagcactcttcagacttagcagaatctgcattttaatcactaactgcaaattttctgtagttcatattagccattaaccagtgcagaggatcagtgagtaggaggcattaaaatttatatgcccatgaaaggcatgacctcagtggaagcgagctatctgctaaccttaaaagacaaatatgtccagataagcttcatggccattgactaagctgaaatttctggaattttcctgacccctgactttaactattttctacctatatagataattgtcgtttatatagccacacttactaaagatcccctgagagggttttacattggaaaaagtctaaaacaccctcaaagtaagtgtgtcatagatatgcatagcataatatacaacattgattggtttttaatcctcacctcacatttcattaagacattaaaaaaatcattgctttctaaaacctctgctgtagtacagcgggcaacatttcataggctgagtagcctcgaaagtacggagaaagacatgaggccttctggccttcctgcaaatgcagtgtttcttccagattatgccagtggtctccgatttagtttgaaagcactgctactctttcctttatgattctattttcttttctttccatatgaaagagactaaaaagccagctacttttgctaattcttttataatctctctgtgaaacttgaccagaatgagccactgccagcttactgtaatcaaatcaaaagctcagacaaaatgcacacatttctctattgacaaaggttttctgccttttgagttgttatctgaagtgtgaccaattgtgactttagcattggctatctcatcggattgaaaatgcatgtgcagctttacgagcccaaagcactttaactttgggcctctcctcttagctttgacttcttcagaaggcatgacatcagcaagaagcaatggatctgtctggagggaagtaaatacatagaagagcttcagatgaactgcttttatcaactctgttggttcattgctctttgggcctgggagtttggaatgttgttcatcactgcctgctctacttctatgtgtctgtctgtccaggcaaagaacagggcttagttgatctagcactgactccaaccgattgattgagagaattccctgtgcaggcaggcttcagccctttcttgttcattgtccacacccatcttcatcaccctctctcgaaagaattagcagagcaatggaaactcttgtaataaatatgactctaacagcaaggatggtacatggacacaccctttctgcagatagatttggcagtgtgtcagcagttttgaatatgttcatactcattgatttagtaattccacttctggatgtgcatcccaaggaaagaaagatctgcataaacacttatgtacgatgttaataggatgttcatcacagcattatttctagtggtaggaaattggaaataagcttgcatgccccacaatgattacactattctccgtccatgtggtgtcattgtatgcagccattaaaaatgatggttctgctgggtgcagtggctcacgcctgtcatcctagcagtttgggaggccaaaatgggtggatcacttgaggtcaggagtttgagacgagcctggccaacatggtgaaacaccatctctactaaaatacaaaaattagccagatgtggtggtgcacgcctgtaatcccagctactcgggaggctgaggcaggagactcacttgaaccagagaggtggagattgcagtgatttgagattgcaccactgcactccagcctgggtgacagagcaagactctgtctcgaaaaaaaaaatgatgcttctgaagaagttttaatcacatagaaaatgctaaccatatagtgttacataagaacacggtgtaaatacattttatttcaaccacgtagcaacatgtatttcataggaaaaagggaggaaggaaatttgataagccattgttactgtcttttagcagtggggattatatttatattttcttcttacctgtccatatttttcaagttgctataatgaggaatactatttaggaaaaaattatatatttctttatgaaaaatatggaaactgctttggtgaagttttaaaataatgtttttctttttattaagtattacagtgctcactgtagaaaatttggaaaagtagaaaaatacatcaaatcctccagtggttaaatagaatgaagggaataaagggaaatagttacttttgaaagcatgaaggtatatcacttttctgattataaaatgtcactgaaatatctgggggaacaaaatcaagaaagatagaatgaaaaaaattacccttgatccccagcacccaaccgtcactcttgtatttacctaatctttttgtgtacgtagataatgcatatacatacatgcaaattggtatcataatgatttgctatttcatgttctgaattttttttttttttttagacagtctcactctgttggccaggctggagtgcagtggctcaatcttggctcacttcaaccacttcaagtgattctcatgcctcagcctcccaagtagctgtgattaaaggctcatgccaccacacctggctaatttttgtatttttagtagagacagagtttcaccatattggtcaggctggtctcgaactcctgacctcaggtgatctgcccaccttggcctctcaaagtgctgggatgacaggcgtgagccactgtgcctggcctgatttttctcttgacattagattattaacagatagactctattatgagatgtgtgtttgaagctatatggtacctctctgactgatccacatagaggttagtacatggaacacttgcaatggctcctccagctccctagcttacttatacgtgtctgaaaccttctctgggcatttccgaatgcacagaactctgggcatgctaaagccaattgcctagctggtactgagagtgcccttagtagaaatggaatgatgcccagcaaaagggaccttacaatactgagcctgtgtccctggccacattagccaaagatgggggccatcagtaaacattgtatttattcccttggagccttagcattcaaaatgtgttcacgaataaaagcaactttgggaagaaaggctgatcttattttggcagaatcccctagtactctgtgatatgctaatagctcctaataagagctacagctggtgattggcctgtccaccaaggagcagcctgttttttgtttgtttgtttgttcgtttgtttgttttgcttagacttagggtctcactctgttgcccaggctggagtgcagtggtgtaatcatagctcactgcagcctgaactcctgggcttaagcgattctcccatctcagcctccctagtagctaggactacaggcatgcagcaccatgcctggctaagtttttaaatttttgtagagatggggtctcacttttcagggtagtctaaaactcctagcttcaagcagtcctcccgccttgggctcctaaagttttgggattacaggtgtgagctgctgcacctggccaaggagcagcatattgatttgctatcaattgataaacataagttgagtatatgatcttttggtacactagccttagcaggtactctttagaagagtgagattatgccgtgctcgagaaaaaaatgcctgtttaaaaaaacaaacaaaaaaacatatgcagactttatcaaaaaagcaaaacaggaggagatagtgataaatcaaatttcaggttgtcagtaaaatgcttgatgcttttcctttttttccttacatttttatatgcttatgtttgctgttcttcattaattacttgatcttaggtgaaagagtcgatgggtgtaactctttaaattttcttagaagtttgaaaggtatgatttgtagcatttacaaggaggcttcttttttcagcacttctgttgatctagtaacttaatgtttgcatgccacaccaggggtatgaaatacagcatttatagtaagagaaaaatcaatccttatatgtaaaaggcagcttcctaataatgtaaataccaggtggtaatttatagcaccaaaaaaaatggatcaaatgaaaagggccccaatctcttaaggttatgggttaattctagaatgcattaatcaatagccagttgattgtttataaaggagtaactaatgtggcatttagtagcagaactggaggttctttggcctatttcaagaattttgaatgtttatttgatgcaagacaagtagctggggatagaagttccagaagtacatggtgttcttctcttttttaaaagacaggatatttacatagaaaacatttatatggaaaagttttgtcttttcactctagtttttcccatgttaaattagtactacttgcatttagaatgattagattttagaactggaaagtacttacacttccctagctcaatccttataccaagtggacttctggcaaagaaggtagtatgcaaatgaaatacatgggtggggggtgtcgacctgctgatttattcttattttttatatgtgtgtggtgtgtgtatggtattctcttgtttaatgtaatgtaagctctcttctcaagggtgaggtttccccattccctatttttcacccagcagtcactcccaccctcatagatgtctgggacgtttcacaacctttaaaggtagaaccattaagcatttcccttaggataaacagttcccaattttataaggccttgcgtcttcttagaagacctccagcagctttggcttcatttatgtcccctcagatggataatgtttgactccactaggaaagataaaaaccagtctttaaagattttttttaaaggattgtagatacaaagaaactctaagagtgacaacactatcatctcacatattagtaataatgtttatttgttgagcatctactttatgccaagcattatccatatgaggtgagtgataatagccccattttatggatgggataaaagaggctcagagagattaggccttttgcccaagcaaggtcatacagtccccaaatgagagatctcctgtttttcccactgtgtcctcctgctttagattcatagcatgttacagtgtttatttccatcctgtgttgagtggccattcatgagctcaaggagtagcagctgctttatctttagaatgtatatacttaagccttcaaactgaaaattgaaggggaaataaacgctgatcacagacactatatttcaaatccttgcaaaccaccacctctcaaactttctttcagacaccagtagctttacttaaaacagattccctgagcagcatttttacatgaatacaagcaattgctgcacagatctaacttccaatttgcttggcttttgatcgttgtggaatcctggtttacattgctcttggctggttctctcttagtcaccaagtgtattgtaattagtttcaggcataatgattatgagcaatgattgctaggtgtctagggcctgtacagctcttcttcagcagttaagatctgaccctgattctgagttctgagaatgattgaaaaaaaaatggagatgaacattgcagcgattactgaagttgctattgatggctgtggaccaggatctgaatggctaatttatgcttcattcctcattgtagaagtaaatgtcatgggaatagaaaggaggattggggatgtgaaagaattatgcaagaacatgcgagctgctagtttaataggaggaacagatgcaaaaggattttttctccttctttctaatagcaaattattatgctttggttgatattgtacccaattgctatggattttagaatttaaatgatgtctgccatccttatgaggtccctttgaggcaaaaggcataggtagaatagtcccaagcaacagggctagtaagaatccatctaaaaagaaatgagtctgggtcttctggatcccctgatttttgtctggttgactctcatagattaaatatatgaatatttaggaactttttgtatgtagtgagggattaacaattttatagatgtttaaaaaaatctctggtattctcataaaaccgtatgtggagagtggcagtgtatggtaaaggtgaattggatgggggaaatttgtcttaccagaaattttcattatggtctgattgtgcaagaagaaggttaagatgcatggcaaaacaccatgtgctttgatttgagcccataagagccactcagtacatacttgtcaaattgcatacccatttggagaaattatgacgttttaactcattattatcagttttatagaatttctcaagcatttattaaccatatgctcacccaaatggtcttcatatttgcaacttatatagccacattaaagagtcttttaaaatgtgaaggaaagaaaataaattttctgaatgatgaaatgaattaggatttagtatgtatatagcaccaacctaggctcttaaagtacacgctagcataaacacacacacacacacacacacacacacacacacacacacacacacacactttcctggacagaatgtgagtcatggaaaccaaagtatggtccatggtgggtgtcggacaggggcatgtcagtttcaaatcatttctcctcttcattaggccatttctcttgtactccaaagtagctatgttatatatggctgcatccacccataagctcttgacctgaatgaggaactccaagattgataatattttactttttctgtaaagtgttcagtgatttagtgtttgtttgacttgcagcactttgtcaaaaggctaaactttgacatttattagaagttttaaattaaaactaagcttgaaatgtcacaccgcacctcgccccacccctaaaaaccaacatgactctaggtgacgttccttaaaaatgcaagtgagttttgagaattacttactaaatgagtctgaaagcacaactcaaataattctgaatgtccaatttctgctgatatgtgccaattttatgagcaatataataaaaattcaatataaggaaggacatgtggtagctgttggaatccactctttttggtcatgaaatattaatagcactggattgacacacaaggcttgcatattgttctcaatgatggcaaagctttgtttttccaatatgtgatagctatgtgtgcaacacactggtcatataataacgcaatccacgtgtgccttttatgccctccatgagcaatcaccacttggcaaggatgctagcaaaattcaagcatggtgtgggacatggaccagatgacatttaaggtcccttctcaactttgaactctagaaaagtactgcatacatttaatcatctatgttaacacttagttgagagagttccacacaagaaaatttgtccccaagacaataaaaaagtcattcctaggaatgcaataaatttatttaaaaacacaattcattggaaagacattttctcttaattaaaacattaatgcttgtcctgactgcttcatactcaacacagcccctgagttgttggtgattgcaactgataggtgaaatgggagaagtttcagcagctagagcagttgttttccaactttagggtatatcagaatcacagatagctgaaaattttggcctgtccaccaagccatttggcctgtggacaagtcagttggctagctggtgctgagagtgcccatagtaaaaatggaatgatgcccagcaaaagggaccctccagggtttctgattcagtaactctggggtggggccaagaatttgcatttatagcaagtgtccaagtgatgctgatcctgctggtcccaggcccacactttgagaaccactcaggggattttggagaaaataaaaggccatcccaggtagctgattggtatgcttcttatattgttcacctaactctttgtgcagtttctgccctctcactttcagggagagagctttggtaaaaatgtcaggctgcacacttgtaatggggatgagttgacctgcctatttgtttactatgcagaggaagtccatttccctttctttctctgaagaaagcccagtaaataaaaggcaagcaatagaagggaaaagaactagataaaaggaaaaggagagaagcaaagaaaaaaaaaaaacacaagccatacctacaatgtttgaaaagctggaaccagggaggactgtggacttcatcctcaggcctcaaggaataactaagtgatgagttaggggctgagagacataggtatagaatctcttggcatgtcaggagagtcacacacatacatctccctgcaaaagtattcagtttcctcagtccaggttttgaaaagctatttggtattagtggccagtctctgagttgcccacccaatgtgagaagagaatggttttgtagaactattgcattttgataagctcaccaatgttctggctttgaagtaggtgtcatattttcttttctgttccatatttactcagaggcagtttcttatttgatgtggtccttatattttgctttggtatttgttatatttcctgcttataaacttgatatcatgaggtgtttatttttataccaggcaagagattctttaagaatgattaatgttacaaatacacttttggcttgttttttcattgaagttcctgaggaaagcttcagaagaaaactagtttgccatttgtagttaagagattaaaatctctaaccttaggctgtggctgtatggtggccaaaaagtaaatctgaaataaccaggtattctcatttacatttttcagtttttttcatgttgtctcataaatatgctatatttattattaagtccattatgcatgtgctctctctctctctgtctctctctcacacacacacactcacacacacactatcagaaggaacattgaaaagagtctcatgatgttattgtataaatcctttagaaacccaggatcaagctggatactcccaatttgtactactgtcacagagaaacacccaggaacttattttcagaaaacttatgtgcttgcttgtaggggtgtttgattatgttttttggcctcaaccattttccaggcagctatagtgcatgatcatatagataagtgaaaaggagaaatgaaaaaaaaattcaggcccaagtaaaataacgacttttgaaaacacctgtcctgctcttaggttacaattagaaggcatggttaactttggcttagattcttaagtaaaaagttgagggaaatctcatgttttagacttcatgtgcacattttttccagtttttctttattcacctatgacagagagaaagtgagagagagaatgagagcatgtgtgtattgtactgactcctgagaagctgttggtttaaattttcatttttttcctctctcagacacctatgtaagtgactttgtgacacagctttcctttcattggcaaatgatctgagatgccacattccccaaaagaaattcaccctatatacaaacacgttttccaatttaattgtgttttttttccagttttcaaatttactggaaaagcagttatttaaacactgaaaactctcgtttttccttttttttttttttttttttggtgttggtttcagaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaagtactccttgtcttctctgttttgtttttgttttgttttctttcatgttaaaagaatgtttgggaaaggtagaaaaataaatcaccaaaattctgttggttcaatggcagccttttcttcctctcttacctcttctctcccacacactgtccttacacgtgtacattttagagttactaaacaatactgtgatcagaatcttcacctatcattattattgtggggtttttttgtagctattcttagaagggggaatatatgtttactcaggaatcttaatttttaaagtaggttaatactgccatacccattttagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtgatcaggagctgatgaaatgaacctgtttcctcattgggaaattcagcgaattggactagatagactgtgttctttttttttgggaggtggggacagggtcttgttctgctgcccaggccagagtgcagtggcaggatctcggctcacttgcaacctccacctccggggctcaagcaattctcctgcctcagcctccctagtagctgggattgcaggcgtgtgccagcacgcctggctaattttttgtatttgtagtagagacggggtttcaccatgttgttcaggctggtctcgaactcctggcctcaaatgattcacctgtcttggcctctcagagtgctgggattacaggtgagagccaccatgcctggccgatagactctgttcttgagcaggatattgctttaggggcctcattgagcagaagcaacagagaaggaagtcttttgtgggtgagaccgtgcaactgtgcctttatctcccagttccaccagagaatctttgctttctttgacttcacacagcagggatctgagcaagatttcaaggggaaaggggttccactgctccttcactgccactcccctcccccaaatgaaatctgaaaacttcttgaagaccccaccacctctacctttccatgagtcaataccagggaagaaacataaatatactggggcaaagtgatctttgcaaggctgatcttagtgctgtcaactttaggccctcaaagggaaagccaaattgtaggccattgctaaaaagcctggatgcacaacaacagcagattctgctgaggccatttggttgttttgaggactggaagaatggacagcataaaaactggacagcactacaaacatgaaaatagacacctgattgcctctcacagtttatctacagttagggtgaccatataattttttatccaaacaggacacttactgtctaaatcgggaggtgcttattaacaaattattcacagacaacaggtgtcactttttttttttttgatagagtctcactctgtcgcccaggcttgagtgcagtggcgagatctccgctcactgcaacctccacttcccaggctcagacgacaacaggtgtcactaattttttttttttttttttggaatctcgctctgtcacccaggcttgagtgcagtggcgagatctctgctcaccgcaacctccacctcccaggctcagacgattctcctgcctcagcctccctagtagctgggattacaggcatgtgccaccacactcagctaatttttgtatttttagtagagatggggtttcaccatgttggccaggctggtcttgaactcctgacctcaggtgatctgactgcctctgcctcccaaagtgctgggattacaggcatgagccaccgtgctggccaggtgtcactaattgttagtaagcaaccaggactgtcgtggactggccaggatacacgggtcactctagttggagagaaaacttatattcaccagagtgaggataaagattctaaagaatggtttattatgaaaaataggtgctcatgggatttttcatattagaattgggtgataataaggattaattgattgattgcattcattatgttgtttgttctctctctcatctccaggccataaactgtcaggaaacaattctttctagtatgtttttgttcactccttctttgatattttcatcgtaaattgcaaatatttattggggcatatgagggtggagttgagggtaagtggggagatgattgttataattaaaggaataatatctgattcttgaacttctgccaaccccagcaaccattattaatcttggacatacttttgtcagagtccctaaaacagtgcacagtgaatcagatcaaagttatttgcattgtggtacacccagcacatttgccctccttcaacaattcctcatgttcatcctccactgaaagggcagaaagacactgctgtgtgatttggacatctgtgcatgcatgtgcatgtgcgtgtacacttgtgccaaagagaaagagagtcaagagccctttgctagtttgaaaagtactttctttatgttaaccctctccccttcctttgagtttcagtgttgattcttggagaaaaagggccagacagcagactcaagcctgccttggtgttagcctcactttgcaaggttggagctattttagagaactgaacctacaaacatggatggggagggtagccaaactgagaagtttagagacaattgattgcaggttagaggattgaaggctagaaaaggcttgcctttgttctgcgtctccctacctcccaggttacggggaagtaagcagttgtgccttccctgtgttgcattcttctggacgtcgttctcagaattaaccatgggaaaccaagaagcttgactttgatatttaagattcagacacccttacttatgcaacaaaggtatgtgacccaatgtgaaatagtcacaatcactttttctttctcctttcttttttaaaagaggcaggatcttgctctttcacccaggctggagcgcagtggcacaatcatagctcactgcagccttgatctcctgggctccagcaatcctcctgcctcagcctcccgagtgagtagctgggaccacaggcatgcgccatcatgcctgggtaatttttgggtttttgttgttgttgttggttggttgtttgttttttgtagagacagagtcgcgctgtgttgctcaggctggtcttgaactcctggcctcaagcgatcctcccacctcagcttcccaaagcactgggattacagacaatcactttctgatgttgcttttggtgtgaatttttcttaatagaaaaaaaaagatcccctgtctaccttagtattgttaaattctttgagaaatttacttttttttttttttttttttttgagacagagttttgctcttgctgcccaggctggagtgcaatggcgcaatctcgactcactgcaacctccatctcctgggttcaagcagttctcctgcctcagcctcccaagtagctgggattacaggcatgcgcccatacccgactaattttgtatttttagtagagatggggtttctccatgttggtcaggttagtcttgaactcccgacctcaggtgattcgcccacctcggcctcccaaagtgctggaattataggcatgagccaccacatctggccttgagaaatttactttctaaatataaccctaacaatttttgtttttagacttgatctctattctatagtcattgtattctcatgttagcctaagagataattgtgtagttgtatgggaagaccgtgaataggagcaatatgcctgaatttacatagagtgaaacataacttgccaattgtttagctgaaaataaagttttgtggctactttaagtattgtggtcacaattgggaatgcctaaaaaagacaatgtttttgctttacaactgagcttctaaatttaaggactgacttgaaatcaaaccctttaattaaattaattatattatctaaatgaataaagcatataggcatcaagtcagtttctaaaggcgctgaaacaagaattctataaatatctaccatctgtggaatgcatctgcatacaagcatgcaaggcatacttgcatacctgagaaaatatttattacattaatttttggagtatgacagccagttaaaaaatttgagatacagtggtattggaaagacaataaaggatctggctatcaaaaacagttcaaaatgaacatgttgaaaaattcatttgattaatttataaataagattctctaccagtttggatacccaagtaatgttttttatatatatgggttcccacctctgctaactcctgcccaagaagcacagtttgcaggtggatctagaacaacccaagaaatgaacatttcttcttttggtgcccagtaatattaattgcttcgggcctgaaaaaaagacctttcaaagtaagggatgtgttccctaattgaagagagccaccccatcagccacctcgtctacaaagaggtctttctttctttccttctttcttttttttttttttttttttttttttttgacatagggtcttgctctgtcacccaggctggagtgcagtggcgtgatcatggctcactgcagcctcaatctctgggactgaagcaatcctcctgcctcagcctcccaaatagctagcactacaggcacgtgccaccacacccagctaattttttattttttgtagagatgggggtctcgttatgttgcccaggctggtctcgaattcctgggctcaagtgatcctctcaccttagcttcccaaagtgctgggattacaggcataagccactgcgcccggcctacaaagaggtctttaaagtgaaatatgaaaagcatcatggtcttgtttgcatacttagagatgttcccactttctcttcgtgagtggatgtccagtttacttttgcagcaaaggggttgcagttaaaagttgagcaatgatttgattatcactgaacctttgcaaggccattagcaccagcaagcttaagttacttcaagagaaagacacttcatagttgaagtacacttgccttgcttttgttttttctgggcccacatctccagtgatttcagctcactccattgagctttacaattcaaacttcccaaaagcccctttaattagtaacaggtggttcaagagtaccctcgtactacacatctttgtattacttattccatcgttatttgtcatggttcatgatacatttcttatttacctgcttgtagcagcagttttgcctggaaggatgaagtctgttgtggtctttcagaaatgcacaagtggttacatgcatcatgaaaattaatagctcctatgccaaagagagttgcattctcatggtttcagttaacactgacataatgggactatgtctacacctacaccccaccccaaactacagaagctataattagaaatcagtgcctcaccattgggatgtctaaatgactgtcctgccttgaaaacaattttcattgctccctctttatttctatttgccttagttttgcatctccccacctcccaggttaaggggatgtaagcagttgtgccttccccgtgttgcattcttctggacatcattctcagaattaactgtgggaaaccaagaagcctacaagagtactaaacaaactattttaccacttcccaaaatcattataaatacaaatttaaaaaatagtcaatacaaaaagcttttaagaagcaaagtgtagacacatattcaactctcaatattctttttcactcacaatattaaaatctagaattgcaaagaggaagatgggactcaagctatggagtggggaaggggtgaggatggtaggagtacaggaggtgtcaaattgaatacattgagtttacatactcacaaaacaaaaatagagcccttttcaagggggttgacttataagtgttaactgagtctaatcatttgaaacaaagacaagacacatttcaagtatttatgaagcttcaattttatctacaacatctccagaaatattcctgactgaatattttgttatgctttttagattttgttattagaggaatcattaggaacttctcatcctcctttctttgtgtatatgcattgaattcaaaactggttaggaaattgttgaagaaactcatcacatcccatggcaagtgtgggttccctatcactcttaccgtaattctgggaatagttctgttatttctattgggtgcttttgttaccaagcaacagataaaatctagaccttttctgcttgcttgctactattggctgtgcaaaaaacaaaaacaaaaaaatagtgcaatgaatgtatgttaggaggtgaaataaactaaaaggaaatgcatttctagcttcagtacagcgtgttgactgtcatcactgtgtaatgtggcttaaggctcgttctgaattactgaaatgaaatccaggctgtgtgaagagttctgttccagcattttttttttcaggctgcttgcagtagtttttaatgtggtgtttggaaaatgcaggttattgggtagaaagtctcaatgtatatgaaaagagtctttgcagaaaaggctttttatagcagatatggcatgcagatgtcatgataaatgtatatatcctgaggaaggcaggaatgagtatttttaaaagagttttaataagttgagaaggaaatgaggcatcttcccccccacatacacactgacttttatcatgaaacatagattggctcctaaaatcttaaattttaaggtacctcctacagttaccttatcattaagaaagacctctgtcagtcttgaaggattttataggcttggaaatttggtatcaatgtattgtcattatgggtcaataactcagattgattttgatatatgagttaatatggaagtactcagtccagatgatattccctttctatcataccaccccacaaaagcaaatgaagcaaacctaattcttatgtaaataatgtagaaatctttttatttttatgcacattacgtaccgttttatagtaggaattgatcatctctgctacattagtatagttctttcaaaacattaaaattggtaaaatatgtaattgttttctggttggttttgttcaagtgaacttttttctcttcacatccagcagtgttttcttgagcctttgaattctttgtgagcagggactgatgagtaatacacatatattcatatcatttttctcacctgcggcaccttgaatagttctaaatacatagcactggctcagtaagtcattattgttttactaaacaatgttatctcatccaagtatctagtgagatattgctccatgtagaacagttgcatcctaaattaccctccaacataaaaattgattcatttggtcaataaacattgaaaactgaaaattgtcactagaaaacatccagctccatagtggagtgtacattgtacatggagatactgtactagttctaggagctctggtgaaaggattaggcttatgtactgccatcaaggttcctatagtctgttactcaaaagaagccatttaggtacatagcatggaagtcaagtacacctactctggaaccaaattgcctagattcaaatcctggtttggccatttactggaagaccttgtgtgagtcccttaatctctttggggctccacttcctcatctgtgaaatgagataatactcatgttatgtgattattttgaggcttaaatgagttaatacatgtagagtactgagaatagaacctggcacatactaaatactgtgtaaatgtatcatagaaaccaataaaatccagtaaaatctatcagtagtaactctgccatagaacagaaaaattttctcttgaatcttgacatcaaaaccctcatgaccacgaaaccataaaagctaaataagcattttctttaagagatcattaaaccattctttttatttaaagggggaagggaggagtgtacagtttttcttttcccatttcttcatatgattttaataaataactattaaatcattaagagaggtctgaaaaatgtgactttcgtaaaaagtagtcataactcctacccctgctcttaccccagccccaaggattctggaacttactaatatctaggctcaaccaacccttctaaataaaagaaaaaaacatatcaaatgttagtcaagagctgtgccccaaggtagcaatcaaattgaacaatttaagtggcacaccatgccatgccatggagaataaatacataactgaagattaaaggaagaccttttcgttaatccctgtgtggcatgatctactgcttggttttgggtcttacggaataaatctacttcagcaaataagttttggaagactcaaaagaagtaattgattttgagggttaccagggagtagaatgttgaatgaacttgaatttctattcaaaatgaataaagccccagaacaaagtctgacttagtccactgttatgtttgcttaagggtgagagatttgcccctaatagtgtggagagaccattgagagctaatgaaagagcccccagcagtgcctggtatattaccatgtgacagtaagtgccaccactggatccagaagatcttggactttcaccagaagctccacgagagaacttaaattaaagttgcagattgaacatgccaaatctgaaaatttaagatccgaaatgctctaaatctgaaactttttgaataccaacctgatgcttaaagaaatgctcactggagcatttcagattttgggtgttcggtttagggatgctcaaaccataattataatgcaaatattccaaaatccaaaaaaaaaaaaaaacccaaacacttcttgtcccaagcacttttgataaaggctactcaacatgtgccatatactgtgtagctttttcttccatggtggtggcatacttttggctcttaaagactccaaaagagaggcaaccattttgtttactcactagggtagtccagagtccttgacactctgggctcactgttctgagcctgggcaggtcgacaagggtggggaccaaaggcctgggcagtgctagcattattgctgtttcttctagggggatgagactttgcaggggagacctgtttctttaggtctcgtgactgttttaaaactcttccctttatattagggcctcatcccactaaaacggatttgcttcccagattctgaattcccttcatgtgaaatagtgcatggtggtctgactagtggttatgagacaaaagacagattttttttcctaactttgatattttatatgtcctttctctttccatttttcttataacttcctcatctctcttttcagttctggtattatttagtgtttccctagcatgttgtagctgagttgcctgtgaccatttttagtagttacacaacaaatcatgtacagagcatgagccagcacttagccaaataatgaaatggaagaactctgccaaactcagcatcataatttcccttaataaaactctactgtgtcatttagtttggtctctttttaaaacttgagcctccatcagcctattttaggggagggtactacaaggtctgttgcataaatgatttgacttgcaattgaactaagaatacaatgaaccacttcctagagttattttttaaaagaatgagaaaggacttctttgaaaaaagaagtgttttctgaatataactattttgggtctaaaatttttgctcatttcctaaagtcctgtaccacattggaattgctttgtattttgtagaacaggttttgtattctaatatagaaattcttaacttgccttgttacctaaattcaaatgcattccagaataatccctggcacatagtaggtgctcagtaactatttgttgaccccttagctttctacgtttcttcttacgagggcattgtctcctcttaagcataatattcaacaaatgccacgtgctattcagtgatttttcatttcatagccacttgcataacttttacctctttaaaatctagccattttgcagtctcatcaatgtggaacccaactaaaactaaagtaggaaataaccagtgcctaagattacagtttcctgtcatctggcagggaaacgtgatacatctgggaaatcttttcatcacaaatgcttgataaggtatagtactggaatccgatgttgtgaggtgactgtcagcaagttgcttaatctctttggctttggcttggtttttcttatctatcaaatgtgagagcaacactcagtgatctctctggtcccttccaactctaagacttctgtgatcctatgcttctcaggccacctcccccctccagtcctgtttgctcctttacaaaaggagagggggacatgtagggaagtcttaacaatctgtgactttaaaggaatgaactttcagctgtccagcaaatctggctatccagaaaaggccattcctccagggtatattggttagccaaaattttactgtacattaatacatagttaggactaatttagtgcctaggaaaacatttgggaatggttaaaactgtggaaaaatcttaattcttggtagggcagtgtatacaattaccattttattgttacacgtattccccccttttaggctagagccttgtttgggatgaggggaatggatgtgcacatgcatcacgtaggagcctgactgttttttttctcctgacaccactaatcccctgttcctgttcctaagggcactgctgataagtgatatccaaagtaacactccagagcaggtgaagtgcattgccgggctgccctgcatcccagcatctcttccctgtggtggtatctgcctccaaaagtctgtgttagcagaactggtgggtacttacacagaagaatgcactaatcctctgatactgactccaaaagaggagggtggggcagagagaaagaggagacaggaacttttaattagctgctagaatgctatacctagccccaatcctttctaagcattgaggaaaacaagtgaccggatggaatcagctcttctacaccccaaataatttcactttataaaactagatgaaatgaagtcccatttctctggagaggacagccagcccaatctgacttgggtaatgtttctgtctttcttcctttccttcctcacaaacttccagtcatagccccatgtgtcctgccatatggtgtccctgtttgtttgtttctcctttcttcctttctttctttttctttcttcctttcctttcctttccttcttcctttcttcctttctttctttcttttgagacagagtctcactctgtcacacaggctggagtgtagtggtgagatctcggctcgctgcaacctccgtctcccaggttcaagcaattcttctgcctcagcctcctgagtagctgggactacaggcacacaccaccatgcccggctaatttttgtatttttagtagaaacggggtttcaccatgctggcaaggctggtctcgaactcctgaccttgtgatccgcccacttcggcctcccaaaatgctgagattacaggcgtgagccaccgtgcctggcaactggtatcccagtttctgcctgatgtttaagcccctctaaattctggccacacgcatactcctgtgcacctgaccttatttcccgcaattccccaaccccattctgagatgcagtgacatgtcctgtactctcctacaggttttgttcatttcattgaacttaactcaggatgctctccctttgtttgaccacttaagtccagcccctttctcgaaaatttaaccaaagccccacctctttcatcaagtgttctgtgaacactctgtgctttagtactcccaagccttggaaaaccttcacacaccccctaagtttaagattactcatattctgccttgtagaatatattaactttgccttctgcacagctcttggcacagaacagaagacaccgtaggtacccttctaaaccttaatttggggttagggttcaaaggacagccttgtagtcaatgtaatgcagaagaagatgtgcttctgttccagtctggcaaagacaaacactgatggttgaggctattagcaggacgtgcatggtgggcacatgaagatagtctcctccactgcatctcatggctcaccctgcatagttatttgtaaaaggattttgagataattgagcaatttatgagtgtgtgagagagagactccaggagggaagggggtgggggaggaatgggtgtttacagggtgggagttggtgcaccttgtttgttttgggtcatctccctcctctcccctgtcccaacatgtatcttttatctaatctatgtcttcaggaggcagtccaggcttactaattgtgatcaatcacaactcattcttaagttcatggccaagccttcagtgtcaatgtgatagaagcaatttctgtctctattttagccccgccactactgtctttttttcttttcacacattaggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcataggtgagcaagtggttaacatatttgtgttgctggagatagcttagcttccagtcacaaggaatgttgtaattggcagctatgaaatttgtttgtttaagtgtttgctatttagtgtttgtcagaatcctgactacgctcaactactttgagaatagtaaaaacattactgcaagtgaatgttccctcaaactaatggtggcatttctgaaggtaatagatacagtggctgccaggttttaataatgagaaaatgcctttttcttggagacagagtctctttctgtcacctaggctggagtatagcagcacaatcatagctctgtgtaacctgaaactcctgggttcaagcgatcctctcaccctcagccccccaaaagccctgggattataggcatgagccactcactgagaaagtgtctttttgatatttcccgcctgaaagtcagttgtgtttatgattataggcttgtatccatgtaaatgctggagtacagtcctcatggagttgtaaaagtggcttttaaaatgttatatctattacactgcaactaaatcttctgcaaaccggccagatacgcatttgttatttggatcaggtgaaatctgattgagaaattcagggattctgtttctgtacaccatttagcagtagtagtctgctctggtgagagtggaaggactttagccctgagaatttaagggatacatattcctgcatatatattccacctagaaaaccattctcagaacccagacagcaatgtaaatgaagtggccaattgcagagagggttagttatgattttggggaaaggacaaattaaggagaatttaaatgtccagttgtcaattaccttgatgcctgaagcaacagtaaccagtgttgaagttccttatgctgagtattagtaggaccgcacacacatactaacagctcacaaaaagaaactcacatttttccccaccctagtcacctttgcataattgccgaatttgagtgtctttataagcacctgtttttcacttatttgtccaaatcatgggaacatgtatgcagtattctggcttggttttttggggggaggtgaggggtgttaatgttggggaatgctttttagtctgtgtgagagctaattaccatattaactccgtttgaaagtgcatcaataaattggctccaacagattcttaagaacactgacacagggggataaaaaaagatgtgaatattaagcacttcagcacaattgtagcctaaatagctcaaagctagaagacctgaaaaaatcttctacacacagaaaagcagaatctcatgaaagggaaggcataagaccagcaaagacatacaggccaaatggcacatcatgcccagaatgaagccatgggagaaattgttgattcaaaatatttctcatggaagtaaaaacccatagaatttccagatctaaagtcgctgtttttgttttctctctctctctttaatcccacactcatccccacacccaaatgtcaagtttgcagttcacttttgcaaaattgaatttttaaagaaagttggtgatccttttcaattgcccctataattcactgtttctccaggcaaggtagtagaatttgccatatggtacaaaaaagtgtatggtgacagtgatcgaattctgctgacttttctacagacacattgggaatggaatgcagaagggcatggcccttgccactattttgatactctaacatgtctagcagcaactataactaaactcatatccttatattaaaatacaaatgctcctacgtgtttttcctggagtttacaggtccatatcaaatcaaaaccacactctggctttctttattgatgttttaaatcagttactcgaaaacaaagaggacttaagttgctgttgttgttcttgttgggcatttttaaaattacatttgttatctttgaagaaacaaacccaagtagaagttgataggatttctgaatcgatttttccctagttattttaagtgataactttttggagggatgaggtatataattgtatctaaactttgtttttaatgggtatactattctttatttctaataagcagatataaaagaccaggagtaatagacattgttaatctccagtgctttttcatgaatttttcacaagggtttaattaatctgctttgtggttgtagaattcagtcccaatttacatgcctctgctgtaaattctttttttatttcttgtctctctctctttttttttttttctgtttgcaaggaatttttctttcccctttaaatgactgcagctaatgaatggtcaagggctttttcccccttctttaaatcagatcttggggttaagtcgggaaactgccttttgttcttccagtcaggtcgggaggctgaagatgtgggtttctgattattggcagcacaatgcaaaaggaatcgctttccctagtgagaaggggatgctttgttgctgggggtatggggggaaactcagtgccagtgtcttgagcactgaaataatgcagttggactagaccctttaagagactaaggatgaactggttttccaaatccgtcttcttgttgccatgctcttcctctcctctcttaactgcatctgcaactggccatgaattgagaccctttagtaaatgttgaagtcttgtcagccttttatcaggatggatccaaatagttaaaacaccttagaacttggttttataagacgctggtttatatgaaaccttcacttggaaatataaaccaaatacctcccttgcccccaccaacaaaagtcagtttctggagaatcataaattatgctatgcaacttgttctccatcacatactgtagctgtgttaacactcatttgactcagggccaaccctattaatgtcgcatgttgctgccagtgggaatttagtattgggattgctggcggggacaccagccaggtcctggcaggaggcaggagccagtcagatatcccgcaaacaagggcctccgtggctcgtatcagccagaagaaaacccaaactccaaaccaatcatctttggctttctcttgaggcttcttatcagggctggctgctgttacagaagagccaattgatagccaatcatgacttcctccaggggttagaggcagctttggctcccgggctgcagagtgcaggcagaatgctcttcagttgcattcttcagctgcgcaacacacaacaccatggcaccggccccaacaaaggcccagcttccccctccattcccaggctcttgtgtatagccggctggctcagagtttacaaagacgccaaacagccagaagaattggggtttatgtttcctttcagtctttcacaaacacattagtgatctggccattccttgccactaggggaataaggagttacaaaatgcactgggttttgttgttgttgttgttgttgttatttaaacgtctgcattttagatgtttattttctgtctattcataatatttttattgggagcaggtgatttcttctcagcttacgaaggaatgtgctttctgtacgtggcagccctgatgatttgacaatgatgaacacatttaagttgtgctccacttgtttacaaaagtctccttttgctagcacatcaaaagcattttttttctctcctgtagtacaatggtatattcatgctttcagcccttacttagagttagaagcatcacttgattggcgcttaccacaatgcattctgaaacttcatttgttattactgttttaaaaattgcatttcatggaaatctatttgtggtttgtgacatcggaattgtagtttagagaaatgaccccgtgcattaaaatgttgtgtagcatttgttctaggttgaaggtgaaagcttgatgactagatttggtttcattgatatgctgatgcctatgctgctttccactagaaagcttagatagaagctcagctgggggctgcaattgtcagctgtgttctttgggtaggacacaatcttccgggaactagctcttctttcaagtaaccatccttgcactacctgaagatgatagataatgtgggtctaactcctttcttgccatgcactaagcactagagtgtaaaggggggataaacaagtttaaaagttcactgtttgtcgttaatgaagcatcctttttgtcatttggggttttcatttccaagttcttctaattttgtaaaacaggtagcaggcaaaaatactaagcctcataatcctaagaaacatatatggcaagaaaacaaagacaatgtattttattgaagcgattcagtgcttactggaaaatgccatgctactccagagtctaaagcaggataatcggtgaagatatatactgtgagcccactaattttgtgtactgtatcttgtgtcatcttctcacttgcaaaaaaaaggaggtacatgccttaagataaattgaagccattgtatttgcaatgagaagtttttcttaatacaaaaattggattattcaaagttttagtatttgaaaagtcattagaattcctaggaaccctttcatttgtattatccaacggtgcactcaaggatctgaggggttttgtttttaaaaacaaaagaaaagaattaatatgccagcatcttaactgatttatgtttttgactcttgtaaatggaatgtgaaacgagaagatcctagggaagtctctgggagagctggcatgttattttgtctccagccttaggtttgtcatctgggagctaactaagagccttacagtgacagtggctgacacacgaataatcagtattgaggaaagttcctgattgggtttccttgctgtagaactaagccttcatctggccatttcacactttagagagctagtgatacatagtgactaaatgcagtttggtgtaagggaaatagacataaaaacaagaattcattatgatccatgccttacttcccctgcccccatgcaggaaacagacagaaaaaaaaatcagattgatttacccaaggccaaactaatgattgactttttatgctgtattgttcttccccaaacctcatattagatgctatgctgatggtggcagagaggctagagggtcctttcaacattgaatcggtcatggatcccatcgatgtgaagatttctgatgctattatgaacatgcaggataatagtgttcaagtgtctcagaaggtaatgaaggcaggatgctggaaaggggagctagggacctcccccgcctccgcctcccgccttgggagtgacttccctaacatgacgacacttactctaatgcaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggtgagcgttttggcaggaagggccgtgtttaatgacaaagaactgaaaactcttgctcaaaatgaatttttagctggaaggctaacaagtgtgggtctttcaggtgtcacttttcaagcaaataggatgtggatgtcagtcaatctgcctgtcccattttctagcccagaaagttcttgggtagccaaggagttatgatgcaataagtcttgtctcaaaatttctctttagattcaccatgcatttattgaacatctactatgtgcccatcactgtgctaggcatagagaagctcagagaaataaggcagatccttgttctcaaaaggcaccaacaaggaggcaaagagggagaagtagatgttccaggcttattaacataaaatgatgtttagtaaaagctgagatgggagaaaagtgagtaactgtaggcaaattgctttatccacagtaatatgctacaaaaatgtaagaaactattcctacagtagtaggaacacagaagagggagcctgaggagacagggatggagagaaagagcaatagcagctatgtttcacagagtgcataatatacatgcttgatcctgactctaaaagccttaggagaagagactgcatgttatctttgtgcctacagggcatggagactggtaggcctcagatggtacttacaatgaggtgggcaaggggtctaggccactcctttggagcttgcatttcaactattatttgagtggttttgtacttctaagatataaattggagttgcatcttcctcttctaattaaagttgaaaatgaattgcatatcactctggagatactttggaaatggccagaaggcacacttgtaggtagttttgtcttgtcttacaatgatctttttttgttgttgttgtttcataattaggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggttagtgtctgttgaatgaatttgaagtttctcccttcctagatgcctgggtgaccttcagagagggttctctcaattgtcaaccgaggcatcaggaagcaattcacagtaggtagcaacaacatggaaggcttctaggtgttcttaggaacaggctttgcactaggagtgttgagaaggcacccagttacttacaaagagtgctgagtcaaaagtttgacagtagttatagtctcgtattagggctgttccaatagtgtcattatttttaaaatatttaatgcctgtggctctttgtccaatggcctagcctcataaataaccagttctcaaaggttccattctctgacttgatgccctgtgtccctcccttagacgctcagtaacttagagaagtacccatacttttttttgtttgcttgtttgagatggagtctcgctcttttgcccaagctggagtgtagtggcacaatctcggctcactgcaacctccacctcccgggttcaagtgattctcctgcctcagtctcctgagtagctaggactacaggtgcctgccaccatgcctggctaatttttttttttttgtatttttagtagtgacagggtttcaccatgttagccaggatggtcttgatctcctgaccttgtgatccgcctgcctcagcctcccaaagtgctgggattacaggtgtgagccaccgcacccagccagtacccatacttctttacttcaacccaccatcctcctcaagagggatagctagcttccttccttccttccttccttccttccttccttccttccttccttccttcctccaacagagtatcactgtcaccctgctagaattcagtggcacaatcttggctcattgcaacctcactgcaatctcagctgctggaatgcagtggtgcaaccttggctcactgcaaccttcgcctcctgggttcaagtgattctcctgtgtcagcttcctgagtatctgggattacaggcacacaccaccacacccggctcattttcatatttttagtagagacagggtttcgctatgttggccaggttggtctcgaatgcctgacctcaagtgatccacccaccttagcctccaaaagtgctgtgatagctttgaagaaggtttccatcaaattggagaaatgaggaatccacaggaacaagaaagattagagttcattaggaattaaagaacttccatctaattttgcttagtggaaatactagaatctagcagaagtatttgataacctcttgtataatcttcataatcttcacgcctgtaatcccagcactttgggaggcagacagataaaatcttttcgctttacgaatcatcttactggggtcattttacattccaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtaagcatttgtggtttgaaagtacgaattgctcttgtatgtcttctgatgagaacaagtggaatgaaatttctattccatttttttttaaactaggtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacactgcgaagaattgacgtaaatttctaaagtttagttactgagtgttcaaaacctaacagttcacatgaagtaaaaattgtcatttgtgattacagaatcaaaataaaaataggtatgaatggtgctacacaaatttctgcttcccctttgttagcagaatatgtctatttacatagctaaagggtagtaggttattaggttagtgcaaaagtaactgcagtttttgccattactttcaatggcaaaatactaacagttatctactagaggagggtgtgtgtgtgtgtgtgtgcgtgtgcacgcacacgcgcatgcacatgtaatgtcactgctaagccaaatgtaactttctaccttttttgaaacaacaacaaagtactcaaaattcttctgactttgaacttcatgggaaaaaatataactgcataccgtgatacacttcacaaactcagtttctaatttttgactcctaaaattcttctaaaattcctttttatatatgtgaaaaatacctgagagatgacatttggtaacaggaattctattctatcaatgagccaaatgccaagtaatatttacttgtgtacttagtttttaattaggtaatatattgacagggtttaaaaaacagaacatacatcaagagactgagtgaattttcctcccattcctgcttccatctgccaagttgtccccacacctcaagtaagctcttactatttacttatgtatgtcttcttccaaagtttatttatgcatatacaagcgaatatgaatagaagtttactcctttttgtcatataaaaggtagcgtttttgtttgatttttgtttgtttgtggggttttttttgttttgttttgctttgttttttgttttttgagacggaggctccctgtgtcccctaggctagagtgcagtggcgcaatctcagctcaccgcaacctccgccttccggctcaagcaatcctcccacctcagcctcatgagtagctgggattacaggtgtgcaccaccacatccagctaattttgtatttttagtagagacaggatttcaccatgttggccaggctggtctcaaactcctgggctcaagtgatcttcccacctcggcctcccaaagtgctggaattgcaggcatgagccactgcgcccatcaaaaaggtagcattttatgcttataatgtcctattt

SEQ ID NO: 17197 - DNA, 58812 bp, Human
gtgatttggttgaggttatttataaagagcaatagtactgaaacagtaggagttcttatttggcataggattgctggacatggtcagactacacatgattaagctttgccttctgagtcattggatttggtaacatttttgtctactcaagggtctggccaactttacttttcctattaaggatgatgaaatccttgctgttaactttatactggaattgtaagtgtgaaaatccatccagtaaaaactgaaacttgtagttaattcttatgatttatatagacaaatttaagaaatgtaactttaaatagagtaattttattacagatagactttaaaaagctctttgttcttataaaataaaatgtggtattccctattttgaaatttactctgaataatgttaaattttcataatcagttaagctctgtttgaaactttataaatgaaaacttttttaaatagttaattttaaaaagtattcttaaaatacatttactagggcctcatcacctaggctggagtgcagccgtgtgatcttggctcactaccatctccgccccccgagttcaagcgattctcctatctcagcctcttgagtagctgggattacaagtgtgtgccaccatacccgactaatttttgtattttcagtagagatgaggtttcaccatgttgaccaggctggtctcaaactgctgctctcaagtgatatgctcacctcggcctcccaaagtgctgagattacaggcatgacctaccgtgcctggccaagaaatacctttttcttagaaaaaaatctaagaatgttgatgtttatcttcatggaaattatttttttttggttgactattgaatgtttgaatttagtatttctttgtatattgtacttacttatattttattgtagttactttcaaaatttgacagatagatacattggttcatctgctataatttttaactgattcctataatgcattattgccatgtttggtgattgttgcttaggggatactcaaaacctgaattattttcttataaatagagggcaagtgagaaacaaatgatgttactcagagaatattgaaaagatgttagttttgctttcttagtgtgtaggtccttctaaatcttcagttaaaaaaaaaatgttccagcccttttggcatttgttgatgcacttgtttcttttgtgcatttttccaacatgccttttcctattaaaaataatcattatctgtagtagcttatgtaggtgttttgagacaattccttaaatctatctaattttactaaaaagaagtgttatgttggattgaaagtaatatttcattataaaatggtagctaatagttgtatatttactagggcagtggttattttgattccatttattctttaaagagaaaccaaaacacaataaataatgttgtcgcttataagaattttcatgaaaaagcaatcccggataggagaaaaaaattaagattttgttttaaatatttgctcccagttgtcacaatttattttagaaaattagaatcagatttaatgattgtatctgtttttttgtgtatgtcattattttgatgaatgtaatttgctgatctcctcactgatgatgtcataaatcaggaatgatttatcgatgatgttgaagtttgttgattagataatgtcagagaatcttaatcatggattataaagttcattttatggaagtttttctcaatattgaaatactttattgatggcatgatttttcttaatcatcaatatacttttttgcgttgaaataattgtcatttgaaggttcatcatttggcagtaatacaaccaatttgagtcatctattttttcgacagctctttgtttagtcttgtgtagataagtaaaccagaatattcccacgggtttagtgaggtctcaattactgtagtgagttgtaaaatgtgagcatttgatatcttggtaaaccttcttttgtttccttttgtctttgcagataaattattagtcataactgtagcaacaaaagaaagtgatggattccatcgatttatgcagtcagccaaatatttcaattatactgtgaaggtatggtatatcctttaacctatgaagatcctataatgtgtgcctaaagtatgtttttcataacagcagtgcaatctgtaatcctcacaaggaagatagcatttggttacataattactgttagttcatgtagtttttggctttattaatatttcctaacacaaagaaatggtggtaaatgcttgaggtgaggggatagccaaagtattctgatttgatcattacacattatatgcctgtatcaaaatatcacatgtaccccataaatatgcaactattatgcacctgtaataattaagataaaataatgctgtgccactcaaacaataatttctgaatttttgccaatgctttgtataaatatactctataaaacagcaaaaaaaaagttaatatgtatttgcatatatatatataatttctttctggcaggtcatgtacaaatacaatgtaaataagatttggcagggatttttttcactgactgcataattttttctgtaatgggttttgctatcgtaggatgattctttgtttgcagggaattagaaacaaatgtgaagagggtgccttttctgtctattattgagaattgcttttgtttttgctttttttgtttgtttgtttgtttgttttcatttagaggtatttgggaggattgttaatgtatttttaaccaaagcattttagaaaacttatctccaggtgaacatctcattgacaagtgatcagaggaaacttggggaaattgatagaactattaaactcagctatgagaggcctgccattttatttacttacttgttttttttaatagaaagaaggatctgtcagccaagtcttttctacaaataagaggagaacaaggagatacctaggtaggaacacaaaaagcaaaaaactttttttttaaaaaagaagaaagattactttttggagaaaaactgatccatttgagtatgtagtatattaaaaaggtagtttttattaaataaccactggaatactaagtatagatgtaaatatagaacagctaagtgttaatatagaacagctaataaacagctaaactttgctgaaaaagagatgtagtggtaacaactagatgtttaatataggataaatgaaaaacatgttagaaatatgttactatgatagatggaaaatgtagcagtatgcactgataggagacactgtggaaataaaattaggataaaataatgctgaaatctagttggggaatcgttagggttcagaatggagagagagtagaatgtttcttatgtgcaaggcaccttgtaaggaactttatatatgatatgctgttaagtcactatatgaaccatgtaaggtagatactactttatttctggatgaggaaaacttgtcccaaggcaaataactatataaagtataatatcagatcttggaccccatccccacttaacttactggagtttatgatccttttgctctctcctcatgtaatgcagtggttcccaaagtgtggaccccagaccaccaacatctgcattgcctggctactgataagaaagaaaaaataatcaggctccccctcagaccgactgaattacaaatcctgggagtgataccctgaagtctgtgtttgaacaaggcttccatgagattcagatgcacactgaaatttgacaaccactagtgtagtggaaagaacatagagggtggtgcttaacatggtgtattgcacagagtagactctcagatgtcgttgggtccaatgttgcattaggattagggattccagatgggttgtggaacaaatctcagggccagaggaggccaatttttagagcaagtactattaatgcttctagattagcctagtttgaatccagatccaaaacagcttgagttttcttgggttgtgtttttccctcaacctgccacataggaagtgataagttataacaggacatttgaggctgggagccccacaggctttgccagcaagatttatctccggctcagtattaagtaaagttagaactagtggtatttattattaaattttattttatccttttcttgtgtgtttatttttaatttcattctccattaatttcccagatctcttagtagatcattataatggcaacttcagactttgttttgatgaaatgaagagaaaaggtgtgtgttgtgtgggggaagggacgtgtattgcactttctgttcccttagagtcagtgtgtcatcatgcatttccaattcagggagcagctgctgaggctcaagcaaatagtgaagagaaagggtacagggtaattaaaatcaaatttaaattaatcatacttaggcaatatcttgcattgaaaaatccttattaagctttagacaattacataagtttaagatgtataaggtaaagaaggtgatttttttcttgatgccctctgcaattccctgaaaaacccattttggttcagtaggaaaattgcttaaaggcccctcatcaaggagtcactgagcttcaatgttgatcataaagatttcctgccagattgaaaaaaaagtgatatgggaaatttattcatttttcttctttatggtctaaacaaataggaataaaatgatgtaatgtgagaaatactttctgggtctacttccttggattagactcacaacttttgagatggtaaaaattgagaagggcattttggggatggataacattgaagaattatgatctgatttaggcatctagatttttttttctagaatcatgattccatgaaacattagaagagtggttacggtacagtactgttcaagttgatgatgtctttaagtttttcatagtactttcataatttgagttttgctcaggaatgaaatgttgattttgtttataggtccttggtcaaggagaagaatggagaggtggtgatggaattaatagtattggagggggccagaaagtgagattaatgaaagaagtcatggaacactatgctgatcaagatgatctggttgtcatgtttactgaatggtaagagaaacaccctgtggattttaaaatctatattcaattactttttaaagagctgagatttatatttgtagatgatgtattaaaatatggttgggcacggtggctcacgcctgtaatcctagcactttgggaggcctaggcagctggatcacaaggtcaggagttcaagaccagcctggccaagatggtgaaaccctgtctctactaaaaatacaaaaaattagccgggcgtggtggcaggtgcctgtaatcacagctacttgggaggctgaggcagagaattgcttgaacccaggagcaaggttgcagtgagccgagattgcgccactctactccatcctggcaacagagcgagactccatttcaaaaaaaaattattgacaaggaattattgttttaaaaagtagatattactattctgtaggttgcccgttcactctgatggtagtttcttttgctgtgcagaagctccttagcttaattagatcccatttgtcaattttggcttttgttgccattacttttggtgttttagacatgaagtccttgcccatgcctatgtcctgaatggtattgcctaggttttcttctagggcttttatggtttcaggtctaacatttaagtctttaatccatcttgaattaatttttgtgtaaggtgtaaggaagggatcaagtttcagctttctacatatggctagccagttttcccagcaccatacagaaagggagaaaatttttgcaatctactcatctgacaaagggctaatatccagaatctacaatgaactcaaacaaatttacaagaaaaaaacaaatagggccatcaaaaagtgtgtgaaggatgtgaacagacacttctcaaaagaagacatttatgcagccaaaatacacatgaaaaaatgctcatcatcactggccatcagagaaatgcaaatcaaaaccacaatgagataccatctcacacgagttagaatggcgatcattaaaaaatcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctataaagacacatgcacaggtatgtttatcgcggcactattcacgatagcaaagacttggaaccaacccagatgtccaacaatgatagactggattaagaaaatgtggcacatacacaccatggaatactatgcagccataaaaaatgatgagttcatgtcctttgtagggacatggatgaagctggaaaccatcattctcggcaaactatcgcaaggacaaaaaaccaaacactgcatattctcactcataggtgggaattgaacaatgagatcacatggacacaggaaggggaacatcacacacgggggcctgttgtggagtgggggaacgggggagggatagcattaggagatatacctaatgttaaatgacaagttactgggtgcagcacaccaacatggcacatgtatacatatgtaactaacctgcacgttgtgcacatgtaccctaaaacttaaagtataataaaaaaaaaagaggcaaaagtagatattactagttataaaactattgtattaatcagttcttgtgctgctacaaattcctgagactgcataatttataaagaaaagagatttagttggctcacaatttcacaggctgtacaggaaacatgatgctggccagctgcttggcttctggagaggcctcaggaaacttaggatcatggcagaaggcaaaggaggaatgaaggtctcacatgattggagcaggaggaagtgaggggatgtgctacatgcttttaaacaatcagatctcatgagaactctataatgagaacatcactagggggatggtgctaaaccattagaaactgccctcatgatccaatcacctcccacccaaccccacctccagcactgagggttacgtttcaacatgagatgtgggtggggacgtagattcaaattatatcaactatggtctgagatgatgtaattaaagatgatgaattaccataaacactaatgagacaacatggcaagagctaacgtttttgtgaaattcatactttagtcttgagttaagaataaagatcatagtgagctttactattgagacgggtaacttaatggattctggttaaacagaagaaaaaagaccacgcaaagttataaatacaagtgagacattagaaagcctgtgttactaagaaagaagaacctttttaatgtaaatgtattttgtgtaatatttcactctcctaattaaaatatccactcttttttgccatcttcttataattttataataacatcaaattgtcatgagttattagttactacttcctttattttattttctgtgtcttatttgtttttgttattgattgctcattttaagtccccatgaattttcccctctaacttaggaaggtctttttacatattttttctcaatttgaaaatataaagacacaaattatttgcagatgaaaataagagtaatatttttatgcattagtataaataagaaagttgtaaattatgaaatgaaaatagatgttaatataatgaagtcccagtgccgtacacacttaaaaattttcaaaagatacataacacttgcatctgtaaaattttcctgttatattttacacaaaatattaagttctgcttgtggttacctattttgcaagatgaagtatggtaaggcaagtgttagccatagtgtactgggaatttttctacagcatttgttattttttttacacttagaaaaagaataccaagttcattaaaatagctctgtagaataaatactgggtatgttttggtttaaaattaccatggatttcaaacaaccatattagtcagcttaaacttgccacatgtacattttcactttggctctgaggcagattctccttgtaagagttactacatgtgagtcagaaatgattttacatcctcaagcttccttttgggttttaggaagaacttttctctaccatcactctcgcatcaccatcccccacctccggccccctatctaatatttgtccttgtggacaactggtatagtgagggacctatttttttctcatgagaagaaggacactgtgatatacctaaagcctgcttgaggttgagtttgttgatttagatgatactttaggacccagcttgacagaaaagataataaaattttaatggaagacacagtgtcttccaggcactgttagtgtttgggatatatcatggaaacaaacagataaaatttctgacatctcctgtgagaacagccagctaactgaaaacatgggtgcccactcagccaagttgttgtctaagaagagtcattaacattttctgcatcattacctaccatgactatcctgtggaaaaaacctaggggtcatgagaaagtaaccaggaggttaaagagggatgagcaattgaagccacataagaaattttttttacccttcttattttttaaaaacaacaccctttttaaaaagtttatacagagtaatgaatctagttgaaaattgtaatctagggcctgggagaatgaattaaactgtttgtaaatggtttgaaatatgatgcccattctgtaacacaattcctaaactcttaattaaggttagctctggtaaaggtccagaattcaggatatgttcattttaataaagcaaaacattcttattttttatgtggtatttttaaggacaactcaactgttttatggaagcataggtcactatcatatgaaaatatacacagatgtatatacttagtggtttagatgagccttttaagaaacacagctttgttagggcataatttatataacatgccataaacatttgtaagtgtaaaattcaatgaatttaattaaatttacagagtcgtgcagtcatccccattattcaattttagaatgtttccaataccccataattatcccgtattccatttagacatgctaaaaagcctgaattaatttagaaacaattttgtcgcattccttccatggaatatgtattctaaacttacttttggatgaacgtttaaaattagaaactggctctttataatctgtagggtaagatttattatatttaatttagataaaaaaatttagatatttggcaaggttttaggttattctcagaacaaaaggaaaactgaagatatccatatatgagtgagaccatctgatactgtctttttgtgcatggcttatatcattaacctagtaacctccagttgtaaccattttgttgttgcaaataacaggatttccttcttttttatgggtgaataatattccattatgtatgtactccatatttcctttatccattcatctgttgatacatacttagatttgttccatatatttactattataagtagtgttgcagtaaacatggaagtataggtatcccattgatatacttattttctttccaacagcacaacaaaaatatcccccatgatcaagtgggatttatcccaggaatgccaggatggttcaatatttatctgttaaaattgtatttgttttatgccaactaactccctttccctccctccaaaatttataaaataattttaatcattttattgtgattttatcataatctgttgtgcaaagtcaactgggtacgtgggtgtttttaactgtgtgtgtgcgtgtgtgtgtctgtgtgtctgtgtctgtgtgtctgtgtctgtgtgttttgagggtgggtggttaggagtggatccatagtattggtttgtgatgttaattatctctggaaatatagacatatgcttcaggtgaagatatgatgaaagaattatcaggtgtgaagctacttctgtgctgctaatagtttggatgattataatttttgctgaagtttatgccaataatgataaaggattggggctaaatgacaaggttagggaacacttctgttgctttcttttttggctatatgggagcttttgcttcttgttgagactcaagatgatggattctgtggcttgtaccactgcctgtttttgtaaaaagttttattgaaatgcagctgtgctcatttgtttacatattgtctgtggtggcttttgcaacacagtgacagagttcagtcactgtgacagacaatatggtcatcaggacctaaaatattttctgtaaaaggccagagagtaaatatttactgactcccgctttaggccatagttgagaaccattgatacagtctgggaactggcacagaatcatttttaaaatagtttgtcagacagtcttatttatgagtgaggaagagatgggtaatgtagaggtctctagggttttaaaattaatctagccttgtgccttctagtgggagtggagaggatttgaatgcaaaataaattaagtagatggaatcaataggattaaggaaaagattccatgagataggccatggaaagagaggagtgaagggtgaatgaaagattttcaacctaggtgactatgtggttgatggtgtcacagaagtagggaacacagaaggacaaaaaggaaaaacacttagaaaatctcaatcatctattgagatagaacactgacatgtctggcaggggactcagtatgaccacatcaggtagaatcttatggttttttcaggacccaggcatacttaccacagttatatgtggaaaattttattttcttcacatgtagatcgactcaatttctgtgagaatatttttatgacctgtgtatcgggggaaccacccccaatatttcaacgtaggttctttcctatttccctaagtgttggccggtctgagaaataaagggaaagagtacaaaagagagaaattttaaagctgggtgtccgggggagacatcacatgttggcaggttccgtgctgccccccaagccgcaaaaccagcaagtttttttgttttgttttgttttctatattcattttattaattcatcccccccaagttttctacagaatcctggaattcttctcagtgtagtcaatacattgatagtttgtcgattttaatgaagacatccctctcagagcctgtgctgttccgcagttgggattgatgcgtctctaggcctgcagggacttcccttcaccatcatatgggaatcctctgtgactctaccctgtgtggattcttctgtgccctgtttttcatgtcttcctctttcttagtttattcccttaatttggtggagcacgttctccagtagctacctctactttccttttccccactcttcgtaccaaattttgcagattgggttctccagaaagtagaatcttaggtggaaattagtgtgtgggaggcttattaggaatgcttgttggatcaatgcttatgattatgcagtttggttggattcatctgtgttcttctactgatttttcctggggtcacttttgtggctgcagtaatctggctgctccactgagagtatgtctggttgttagctgggactgttggctggatacttttgcttatctacaggtcatctcttcgaggataatttgggtttcttttgctgtattagtccattttcacgctgctataagaaatacctgagacgtacttggttttcagggcactacattgccttgaaaaccagcaagtttttattagtgattttcaaaggggaggcagtgtatgaatagggtgtgggtcacagagatcacatgcttcataaggcaataaaatatcacaaggcaaatgggggcaaagcgagatcacaggaccggggcgaaattaaaattgctaatgaaatttcgggtacgcattgtcattgataacgtcttatcaggagacagggtttgagagcagacaactggtctgactaaaatttactaggcgggaatttcctcgtcctaataggcctgggagtgctaccagagactggggctatttcatcccttatctgcaaccgtgtaagacagacattcctagagcggccattttagagacctacccctaggaaagcattttctttctcagggctgttccttactgagaaaaagaattaagcgatatttctcctattcgcttttgtaagaagagaaatatggctctgttccgcccggctctcaggcagtcagacctgatggttacctcccttgttccctgaacatcgctgttatcctgttcttttttcaaggtgcccagatttcatattgtttaaacacacatgatttactaacgatttgcacagttaatgcaatcatcacagggtcctaaggctgcgcacatcctcagcttacgaagatgacgggattaagagattaaagtaaagacaggcataggaaatcacaagagtattgattagggaagtgataaatgtccatgaaatcttcataatttatgttcagagattgcagtaaagacaggcataagaaattataaaagtattaatttggggaactaataaatgtccatgaaatcttcacaatttatgttcttctgccatggcttcagccggtccctccatttggggtccctgacttcccgcaacacctgtgtgcatttttttaaatttgacaatttgactttttacagccaaaataaatttaagtaggaaaccttccttgccctttgagaagttttaagtaagttcaaataacttttctaaagtatttaaacacagaaatagcagtgctactcgaatgagataggaaaggtttcagcaacgtgaaatttttcttcaaaggcaattatgtgataacttttgtcttaactttttgctttaaaataattgtgttttgttataaagataatacaggcttataaaacgctaaattataaaagttgccataactctttttcaaacaactgacatttattaatagtttgagctatactgtttatataatctgtatccatcattagggtttcaaagacaaaaaatattcactcacattccaaaagtgcatttataactttttttaatttttaaattttattattattttacttcaagttctgggatatatgtgcagaacgtgcaggtttgttacataggtatacatgtgccatggtggtttgccgcacctattaccccatcatctagagttttgtttttttttttttttgagaccaagtctcactctgtcaccaggctggagtgcagtggcatgatctcagctcactgcaacctccacctctcgggttcaagcaattctcctgccttagcctcccaagtagctgggattacaggcgcacatcaccacgcacagctaatttttgtatttttagtagagatgggttttcactatgttggccaggatggtcttgatctcttgacctcatgatccgcccgccttgacctcccaaagtgctgggattgcaggcatgagccactgtgcccagcctcatctaggttttaagccctgcatgaattaggtatttgtcctaatgctctccctctccttgccccccgcccaccgacaaactccactgtgtgatgttcccctctctgtgtccatgtattctcattgttcagctcccacttatgagtgagaacacgtggtgtttggttttctgtttctgtgttagtttgctgagaattatgggattccaccttcatccatgtccctgcaaaggacatgaactcattctttttatggctgaatagtattccatgttgtatatgtgtcacattttcttcttccagtttatcattaatgggcatttgggttggttccaagtctttgctattgtaaataatgctgcagtagacatatgtgtgcatgtaactttatagaagaatgatttgtaattgtttgggtttatacccagcaatgggattgctgggtcaaatggcatttctgattctagatccttgaggaattgccacactgtatgcatgctgctacctgcaaaatttcagactcagtttagtcagagtctccaatcgtaagatgctctgacatcacaagctatttttccccatctccaggcaatgcacaaagggtctgtttatcactcgcatggtagtcgctctttcagagactttagtttatttgcctcacttctcatggcccaattacccataaaactggtcttatttcccagtcttcattattaaaaaaaaaattatcaacaacttatagtcttgaggaaaatatcaccgttaaatccggttgaggaaatcagttgtacttagcagaaaaagtacagtgttgtgttttgtaatgtcagattaatcagtttttttttttaataaacagggcaaagtttgaggtttcagtcagaaaaattttattgtaacttaaagttcagtttcaaaagtacaagtatttggctaaaaataaaattttttaacatacacatttgtaaaaactttgaagtgagttttcctctgtctctcccttcactgtagtccctttcatgttaatttttaactttgttcagtgtttacagtgtgccaggagttatttttaatttttttaaattataacttgaggatatagatactacttttccctccattttatactttacacttaagtgtaaagaggttaagtgacttgtcctaaggttattctcatatcaagtggcagaggtgggattagaaacccacctggcagacttcaaattgtatgctgtgagtgactttacaattatgctgttagctacctgggatggtaagtcattaatttatcatcattggaaacctttggtcttaaggtgcactgatgtaaaaaaatgtaaaataatttgtgattgtaatgaataaagaacttattgcagagtagaaaaattttagatagtggctgttatacttcacgttttgttaagtcattgtgattctgtgaatgaaccatgaggaagaaagtcatcagaaaaatcaatgaaattatattatattaattaaattatagtgtcagtttttacaaaaattatagtgtcagtttttacaaaaattttctcccaagtgtattgagctttaaaaacctgcagttgtctgaacgcacttattttaagattccatgctaaacagtcattcagatattaaacatacattgatgacatttagcagttaaacacattttgtcaaaaataattcttcagaaactaatggactggtacaaatttacttgaaatattaggcagttatggcaacttccgtaaatgattctatctgtattataaagttatacaacaagtaactgtatttctaacattttaatgctgttttagaatttcaatttgggaataagtgattactgaaaaaaaaattaaggctaacactaaaaaagctgacttttatttggacttcatttgctaatgtaaactaataattcaatacaattcatataatttaagttgagagaaattttgtttggtgttctgtgtaaatagttggcacaggtattaatcttgcattgtattcttgattctgacttttgttagagaacttttcatggtttatgtgcctagattctgacaagtgtattttaaaacacattttttcctcattgaacagctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggtgagttagatactggaagaaaagtttaatgcaagttataaagactaatgaaacaaccatttttgtagatgtagtaactttagatatgaagttttaaataacccttattttattattagtatattgacaaagcattttcccatgtattatgtgagttggtgttcctaaaaacactaggtaatataaatgttataattaccaaattataagtgaggaaactcatgtttttcaaatttaagtgacttctagagatattctgttgttaaaggaagaaaagtatggatccagttcctttaattatgacacattgagaattttcttgctctaggataataagtttagtaagcttccttacttgaaaaaaaattattctcagtccgcaatcaagtagcttttaagaataggtattacttaatattatctgattttaaacattatgggattaaataaatgatttgtcttgaacccagtagtgaaaaatatctaacattgagtgtctgggtatacttaaaatattgcattagctgtgctaccacggattaaaggaatgaattaccacattcctcagtccagcctttagaaaattaaataaaatttgaccttggaaattataatggctacaaatttatttttactagtttgagattaatgtaaacatagggacaaaagacataaccaaataggatgaaggacatgttagagaaacaaattgggtacaaattgcaaaccacattggaaaaatggattttgggggtgatctacgtgtatataaccagtactatccaggctagttaaaataagtgctgcttcaggtagcagcatatctgggttctaggctttgcttagccactaggaagtgatttagtttcttggtaatgcctcaatttcagctctttgcacctgcactttattttatcaacatattcccacagttgtaccttggaactttgatagctcatatagattttgtacttttgaaaccttaaattccagtttgcactgcctggcttgaaatctcttttcctcttcgtctcaatatttctacagataatgctttctgggatctcttgaccattttcttttctccaaatctatctaccacctttggatttaacttccatattcaagtgagaacccaaggtttatcatattggttactctgtgcttcttgccttagcagtctttctctgttagatttccagcttgtgaaccgtcaaagcctctccctaatatggctacccaccatcacttctctgcttgagcatgcggctcatggatgggtgctgcttccacatcatggcctccatactgtcaagacctcagtaatatatggctaatcttgcaacttattctaagtcctccattgtttaaaaccaattttttaaaggaagtatgtagccatgggactctgagacatgttttattttatacttgttgaaatttttctgaagatgacttgcatagtgaaatctcgtaaatttatttcaaatagtgatgtatgtactcaggtggttaggtttcagacagactcacagtgctttggaagcagcaagaaattagcaagcaagtgcagttgtaagtcagtttaattaaggaaaaggtgttttaagtgggaaagtaatcataaaaggacatcgaagcatcatccttatgctttctgtagtcaaaataattagagaagggcagaaaatataaatatgtttaataaaagtttgaataatttcatagatcacatatttacagttatttaagggacatgagttgtttgtgggcatactatttagtttttaaaaatagtttttggccaggcacggtgtctcaaacctgtaatcccagcactttgggaggcctagacaggaaggtgacttgagcccaggtgttcaggccaggctgtgcaacgtagggaaatcccatttctactaaaatttttttttaaattatctgggcatggtggcacatggctgtggtcctagctactttggagactgaggtgaggagattgtttgagcccaggaggtcgaggctgcagtgagccatgagtgcaccattgcactctagcctgggtggcagagtgagagccccatctccaaaaacaacaacaaaaagagtttttaatagaaaaatataaatcacataaaatatgtaatgtgaaaatagatgtttttttttcatttattgaggacatttggggtctgtaaaataaggaaacaatttttgaagaacagtaatataaaccattggaaaatgttgagtgtctctgtgtggtacatttttcatcatagaaaattggccatgggatttaaaaaatgtattgtcttctccccagaatttttttatttgatgccaggcatggtggctcacgcctctaatctcagcactttgggaggctgaggcgggcagatcacctgaggtcaggagttcgagaccagtctgaccaacatggcgaaaccccatctctactaaaaatacaaaaattagtcgggcatggtgatgggtgcctgtaatcccaactacttgagaggctgaggcaggaggtggaaggcggaggggaactcgggaggcataggttgcagtgagccaagattgtgcctttgcactccagcctgggtgacagagcgagactctgtctccaaaaaaaaaaaaaaaaaaaaaaaaaaaatttatatggcaagaaccaaaaaatgagcaaccattgattggttttggtcatgttttcattttttcttttttctccaataacagtaatttccctggacctatttttttaattcttttaagaaaattttaattttgacagttaaaaaatagatttttcttcaactcacaggagtaacattggttcctttttaaaagtattgaatgtcaatgaaacatagcagcttggctgcatttccataattcagaggaagattcagacaagaaaaatgattccgttcgtgtctttaatagacaaatgttattggcggtcttaatgcttatgctttaaggccaaggagaacaatccaattttagacttcctttttccagactatgacacaaaaaacctagccagaaaatggtttagcaggcacaataatgactggccaaagtaatggaaacatttccaaaatgtcttagatataaaatttctttgggatgtttgcagttagtgacaaatccagcattcgtttgattgcattagcatctctggcactgacagtaaaaccactgtagtagagattttattctgtaagaaagagtgagttctccgcagagaatccaagaagagctttttagaaggtcagagaaaaaattcttgtctcagtctattcttttcctagtaaatctgtttcccttaggagccttggaaaacattagttctccctcttttgtcaattacttttggagacacatttatttaaaaagagtttggttattttctgttttgcagttggtagcaaacactctattggagtttatatataaaacaaggggcactcaataattcatatttctttcatggtgagctgtgaaattccagcctaagaattaggcttcatgacttcacaactctgttcaactggttagtgaaattaacatgacaccagtttcggtctttgaatcctaaattatctactttctctctgctgtgttgcaggatttattggctatgctccatatgtcaaccgtatagttcaacaatggaatctccaggataatgatgatgatcagctcttttacactaaagtttacattgatccactgaaaagggtgtgtaacagctgcaatttttttgttttattgatttggttgttttgtgtgttatattgtgttaatgtggagtggtcagaaacaaaggttttatgatagtatggcaaatggtaaactgaatttcaaaatgttgaaaacatattttaataggtgagattggtttatgtcacctggctggatatcagcactagcttagtatgtctttatggcttctcttttgtggccaagttggcaaacttgccgaacttggttggatcaggcagaaggaaagaagaactatataatgcagtgctatatgtattgaaacacatattgaaatgacttgatactaaaatgaaatggcagccctcacaccactgtcatggccctacctccactgcatactcacttaggctgccttaaaataacagaataggttgcattatcaaaacttctgagcttggagatttaaagagacaataatgaaatcctaaagattctagacaatgtcttcttttatattcttgaataaataactgtcatttattaacatagagcattagaaatgtgtattcttgtagtcactccatcttggcagctataattgttttctcaaaagctacaccaaagccatttgataccagagtgaacttttgcagtttaaaaaaatgcagtgtattctcatttgtagtctttagccttgcaaagccctttgtacctctctgagcttctttgatcctagataggctagaggctagactctgtatccacactttatcagtagagaaactgagaccacatagtctgtgacattgtagggactggatccttggttccctgaaaaccaaaatctggactttttttctgtttcatatgatgataacatagactttatgtgtttaattggctacaattttaaaagaacacattttctggtattttgaaatgacatgtgaataaagccactcaaaagacagtttttaatttgaaaattacctgtgatacccttgaggacagagaccttcctctgagatttggagcctggagattatgggtgttgagaaaacattgaagccaaaagccctggtcattgttcaagtgtttggtggcccagagtggatagagcctgtaaggatgggtgtgatcctttttaggagactttatagccaatttgtggatttcaaatatttgagaatttggagcctgaagattcaaagagatgataatgaaatccctaagaggttagagcctgaggatccacgggactgtgctatagacacaggcttttgtcttttattcataagaacacttaaactgtaataaataaagcaactcaaaatagcagtggtctaaataagaaatatgttttatttaagttttttccttctgtcacattgaaagtaattaagaagtagggagcacaaggctgttagggaggctttatgctgtcaagagggatagctcttttgttgctccaccattggtccatagctcccagttttaatcttacttccttgtccaaaattgctacttgagtttcagtcgttgcattcgtattctgggcagctaagagaggcacggtagtaaaaacaggccatctcagtttcatcactctctttaagttgcctttctagaagtcttaccaaatagtttctcatactttgatcagaacgtatgtatgtgcccactcataatacccaaaggaaaatctgtttttttattttaagcagatatatgctcctgaaatctgagttcccttattggggagttgagggaatgttgggtacaataagcagtcttccatagaccctagagagaatattcctgaaattgatgtgagtgaaactctggagtacagtaaagcaagattttctaatttgagaatacttttatcatatttaccaatataagttgatatttaataaatttactgtatatattggatacagatataaaagttacttgtgtgtttgtagttgctgtcattaggaaacaagattttctttaagtgtattttgcaatgagttgcaactatcgcagtttctaccttttagctaaatactttagtcatctaaatattttgattagacacttaagatataagaatattaaactttaaattccctcaaagaacaaactatattaatatgataggaatgtttgctgtttttgttgtcattttcaatatcatttctattcttatgttttaggaagctattaacatcacattggatcacaaatgcaaaattttccagaccttaaatggagctgtaggtatgcttcctaaataccggattgcttacgtatacaaacaaacacctgtgttttcaactatctttcctttgttatgtccatttgggggctgtgactaaggtcgacagtgtaaatattgtaattattgtaacttaacaaaaatactagacttgaacttaacatcagtacattaaattaaaatcatttcctatgactagtgtgaaaaagataagcttctggctttaggtaacttaaaatttagtgtctcaccatttgggaactttagataagtttataaattaattacactttattattacacattttctagtgaaattctttgtattacgaattacccagagtattagagtagatccttttgacccagctgaaagataactggtgacaactagacagtagactggggaagagtgtgtgtgtgtgtgtgtgtgtgtgtgtgtgtgtgtacatgctcgtgtggatatgcatatgtgcctgtgtattatagatacatatatcttgataaaatacattaaaactaatcaatacagtaaaatttaaaatataatttattaacacataaatacttttaaatatacatataaaaattgagaatatattgcaattcaatcaatacttcaagtcagtccatttagtaaaaagattcttaaaatctagtcaggcatggtggtgcgtgcctatagtcccagctatatgagaggctgaggattgattgatcccaggagttcgaggctgcaatgacctgtgattgtgtccttgcactccagccggggccagaaagtgagacccagtctctaaaaaaaaaaaaaaaattcccacaatgcaaaatgtttagtttggagtgctcaggaaattttaagacgatggctctgctcctctctgacttgagttttatcttgcttagtgtgctaagtctgatttttaagaactggaaatattatcattggtagccaattgtagaacccttgcttatgccagacaatattctactcaccatgcatatattgttattatcttcataataaccctaaaagacagacgtggataccatttgatagatgactaaactgagttactaatttaacttggcaagaataacaatactatgaaggggcaaaggcaggattgcaagatgaattattctgacagacagctcactggcttagcacctcaatcactttactggtgccaggttggagtgagtttggtatctgtatctgttgtcactgtcatccttcattttgggtatctgctggcttggagtagatgaagttactagaagtgttgtagcacttggaatattacatccatgagaaattttgtaatgatgatacacacacatacacacacagacacacgaatacagacacacacacacgtattttaaattactaaagcctattttctctttttaacccagatgaagttgttttaaaatttgaaaatggcaaagccagagctaagaatacattttatgaaacattaccagtggcaattaatggaaatggacccaccaaggtaagtaacagttacttttatttggccaattcttggagatagactatggattgatatgtggaatgtcatctattttatttttaaaaatttctttcaaagactttattttggtgctaaaataaagacttcatcttttacacagtatatcatctggttttatactaattaattaatcaaactgatttttcctcagcagagtgatagccttttattctatttacagcacatttggcgttttattaaataataacaactaacttgggagtgagccacatttctctcatactgggtatcctttctcattaggaattgctcaggacattaagagatcatttgtttcacctgacttgccgttttctaagttaacaacactgttaagattggggtattacaatatggccagaaagcttcctctttctcttatttcattaactacagttaatgaaagtgacataatttgaccaataaaattttggatgcctttctgtttcaaatgtgtataattgagcttgctaaaaatgttattgactgcaaaatttatagatgaaaagtttgttttgcttgggtccaatcaagctggaacataaattgcattgaaaaaatatagtaatactgtgcttacaacaaccttctgacatgctgaaatgcctggtttaagtacctagaaaagggattaacagatttttgttgtgggaagaaaatactgggggatgtgggcttctgttccagaggagtgagtgatctgaattccaggaaaagctatgtgaatggaaagaaatgcaaggaaaacgcatgctggcaacttctgctccatcaaactgaaagaagtagattcccgtctcttctagttaatctttcccctttggttttcatcccattccagccttcctacaaagcaatctctatcttgtgccctccttcagtctctatcttataatcagtttccccagctctgtcatctcctcattagcattttaaagaccagtaagtctcctccatcttacaaatgaaaccaaaccaagccaacacaaggtagaacatcctcttcaatccacactgccttccaggctgcacctggcttttctcctccccttcacagccaaagtttcttaaaatatagataactcgctgtcactactccacctcttcccatcacagtaagaaatgctcctgttaaggtccattgtgaaatctttgttgagtagtggacattgttcagcccttatttttatttcacctaaagacagcatctgacaattcattgatttcgtttggtcctacttgaatgctccttccctttgcttccacgatgctctgctgctttgtctatttattttctgggctttcctcttcaatctctatggttcttcaaaatatttattttaaaaattttacagctcagtttgtgtgcatgtagtgaccctcatccttactgttttagtaaatgttcacaggggcctgtctggggcctcttccttttcttttccatatacattgttgggtaatttgagtcatttcctcatcagtgaattctctcaatgctggtggttttcaaatccttcctctaactcctgtgtctttcctaagctccaggtcagaatactcaagtggtagatttctgtgttacatatacccagagattaagacttgcagcattacctccccttataacccagtggttaaccagaacctgggttttgttttggctctaggcacttcccactccaaaagccctctgttctaactcctgtgcatgctggttttatctgattttctcagtggccatagcaactttcttagttcaggccacctgcaacctccttctagtagcaatcacacccccagcagcctggaactagagtattctgccaaagcagaaaccctgtcactctactcacctatataatgattttctgtgaacttaggtatgaagttgaaaatcctcaacttgtcatacaaggctctttatgttgctcctgctttagtggccaccaatctaccaccccattcactctcccactcccaaccctacacatgcacaccctcttcacattcaatttcttctcctttctccctctccgctcagcaatactacattactttcaactttgcagaagtttcatgttgctgtgtctgcaaatcttctgtacatacatgctttttatatatcctggaatcctctccccctaattcccacctgctgcatctctacctgctaagtccttcttatcttttaggtgtcagtgtagtctttactttttgggtctcttgtatgcttttgtaatctctggagctacttctgttacagtatgtatcacacactggacaggaatgatatttgcctgttttctggtctctcttactaggcctttggtctaggaattacagaaaccttatctgtcttgtttacttttgtttccccagggtccagcacatgtgtagcgaatactacgctttcaacaaatcttaattgaatgttagagtcaataatctaatgacctagcattattcttgggagtagtaaggcagattattttctggcagggcaaaagcattatcaaattactattggttggctgggcatggtggctcacacctgtatcccagcactttgcaaggcttaggtgggtggatcacttgagggcaggagttcaagaccagcctgaccaacatggtgaaaccccgtctctactaaaaatacaaaattagccggggttggtggcacatgcctttaatcccagctactgtagagggctgaggcaggagaatcgcttcaacccgggagacaggttgcagtgagccaagatcacgccattactctccagcctgggcaacaagaacaaaactctgtctcaaaaaaaaaaaaaaaaaaaagttggtcactgtaactttccctaggcaaatttaatagatgaatccctttactatgtgtgtgtagtcactgttttagctgtctgtgatactgtcagtgccagttagtcaagagctggtagaaccccacttttcccataactacatagtgttctgttcctccttggtaatataatattttaatcaaatttaggctggtgcggtggttcacacctcatgtcacgttaggaggctgaggcaggcagatcacttgaggccaggagttcgagactggccagcatggtgaaaccctgtctctactaaaaatacaaagaaaaaaaaaagaaaaaaaattaggcagctgcttgtaatctcagctacttggcaggctgaggcacgagaatcgcttaaacctgggaggcagaggttgcagtcagccaagatcgggccattgcactccagcctgggcgacaaagcgagattgtgtctcaaaaatttaaatgtctttgaggagtgattttggtcctgagaatttagtgattatggataaggccttatgttcagtgatttcaacgtgatcaccaattccttccaaatttccaggatgatgctgactggagctttaaaaagtgactaaaggacatatcacaagaaaaggagcactaatccttaatcatttagaaagacctaggtgtactaagaaatattaagtcttcttggaaacattttcagtttgcactatcactgtttctggcatttcaagctatgtgatgctcctattatgttttctctgatattatcatatctagttcattttgttattctattagacaataaaatatgaagttttattatagatattatatttggtataatacaaaaactcgagaaaatttgaatatgtaaacatttaacactaatactttataatattaggttaaagttaaataaattcaaatgagtatgtcacgtattcttcttatccaggctgatggggaaagaaggctgattattacaaacattttttaacctttataaaaggtggaaggattttttggtatgattttttgtaagttagttttacttattattttgtttagtaatggatgtttataatgatagtggttttgagccataatattgaactaaacatttaagcagttttttcattaaaaatgtatataatctataagtggtgaagtgattatagtatgttgatgatactaaagtataaaaaatgagcttatttcctactttctccaaattttatgccattggaaaaaatattaacaattttaagtaattttaaaaatcatttatactgccctcccatatggttttaattcatagctgttttcagtttttatgtctcctcagtatatatctatgaacatttatattttcctttgttttcatagtagtatataaacaattttgtgtttcttaattaacattttatttaaaacatatttaggtattttaaataattattttcatacttggtctgtataaatctaatatgaatcaatttttagatagaaactggtttctaatttgaaggtttactttttcttgaaacccatttattgttagtaatgtataagatgcatattttaatgttcagccttttcttttaaatatcaaacaatatacatcttaattatgaatttggtagctttttaaaattttactttaagttcttggatacatgtgctgaacgtgcaggtttgttgtacataggtatgcatgtgctgtggtggtttgctgcacctgtcaatccgtcatctaggtttttaactctgcatgcattatgtatttgtcctaatgccctccctcccctttccctccacccctcaacaggctccagtgtgtgatgttcccctccctgtgtccacgagttctcattgttcagctcccacttatgagtgagaacatgcagtgtttgtttcccgtttctgtgttagtttggtgaggatgatggtttccagcttcatccttgtccctgcaaaggacatgaactcattctttttcatggctgcatagtatttcatggtgtatatatgccacattttctttttttattattattattattattattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggctgggcagaggggctcctcacttcccagtaggggcggcccggcagaagcgcccctcacctcccggatggggcggctggccgggcggggggctgaccccccacctccctcccggactgggcggctggccgggcggggggctgacccccccacctccctcctggacagggcgactggccgggcagaggggctcctcacttcccagtaggggcggccgggcagaggagcccctcacctcccggacggggcggctggccgggcggggggctgacccccccacctccctcccggccggggcggctggccgggcagaggggtcctcacttcccagtaggggcggccgggcagaggcgcccctcacctcctggacggggcggctggccgactccccccccccacctccctcccggacggggcagctggccgggcagaggggctcctcacttcccagtaggggcggccgggcagaggagcccctcacctcccggacggggtggctggctgggcggggggctgaccccccccacctccctcccggacggggtggcttccgggcggagacgctcctcacttcccagacagggtggttgccggacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgctcctcgcttcctagatgggatggcggccgggcagagacgctcctcactttccagactgggcagccaggcagaggggctcctcatatcccagacgatgggtggccaagcagagacgctcctcacttcccagacggggtggcggccgggcagaggctgcaatctcggctttttgggaggccaaggcaggcagctgggaggtggttgtagcgagccgagatcacgccactgcactccagcctgggcaccattgagcactgagtgaacgagactccatctgcaatcccggcacctcgggaggccgaggctggcggatcactcgcagttaggagctggagaccagcccggccaacacagcgaaaccccgtctccaccaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggagggagaggggggaggggggagaggggagaggggagaggggagaggggagaggggagagggtatatgccacattttctttatccagtctatcattgatgggcatttgggttggttccaagtctttgctattgtaaatagtgctgcaataaacatacatgtgcatatgtctttatagtagaatgacttagaatcctttggatatataccctgtaatgagattactgggtcaaatggtatttctggttctagatccttgaggaatcactacactctcttccacaatggttgaaataatttacactcccaccagcagcgtaaaagcgttcctatttctccgtatcctcaccagcatccgttatttccagactttagcgattgccattctaactggcatgagatggtatctcattgtggttttgatttgcatttctctgatgaccagtgatgatgagcttttttttcatgtttgttggccacataaatgtcttcttttgagaagtatctgttcatatccttcgaccactttttgatggagtggttttttttttttcttgtaaatttgtttaagttccttgtagattctggatattggatggatagatagcaaaatttttttcccattctgtaggttgcctgttcactctgatgatggtttcttttgcagagcagaagttccttagtttaattagatcccatttgccaattttggcttttgttgcaattgtttctggtgttttagtcgtgaagtctttgcccatgcctgtgtcctgaatgatattgcctaggttttcatctagggtttttatagttttaggttttaggtttgcctttaatccatcttgagttgattttttataaggtgtgaggaagaggtccagtttctgttttctgcatatggctagccagttttcccagcactacatattaaatagggaatcctttccccattgcttgtttttgtcaggtttgtcgaagatcagatggttgtagatgtgtggtgttatttctgaggcctctgttctgttccattggtctatatatctgttttgttaccagtaccttcctgttttggttactctagccttgtagtatagtttgaagtcaggtagcatgatgcctccagctttgttctttttacttaggattgtcttggctatacgggctcttttttggttccatatgaaatttaaagtagttttttctagttttgtgaataaagtcaatggtagcttgatgggaataacattgaatctataaattactttggacagtttggccattttcacgttattatgagcatggaatgtttttccattcgtttgtgttctctcttatttccttgagcagtggtttgtaattctccttgaagagatccttcacgtcccttgtacgttgtattcctaggtattttattttctttgtagcagttgtgaatggaagttcactcataatttggctctctgtctattattggtgtataggaatgcttgcaatttttgcacactgattacaaaagataaacaggggaagagctaattacctgatctacacatgaacataactcatttctgaaactaatttgatttgtaataaaaatagagatgtgaattttgtgcataaaagctgtagtacttgggtcactgtgaccttgaataattggatatgatttttaaaaggaagaaagaggaaaggatttgggcggaaaagtttctctgtcaatgaaaatgacatcatacttggaaacattttgatattgtgaaagaagaatcaggaaaatactatcacctagtagcccaggagtgcccagagcagcctaactgcataaacagccttctgcaccgtctagagctgccagcaaaaatgtctctagttttcatgaggaaaacagatgtaaatggggggtggtgatggtggataacctctgcctgtgtggtgagaggtccaaaagagggaagtttctagtcaaaagtaatgtttctaaaatatcttagttatctaggaaacaaattgagataaaaagcagagggtaggaaagtgacaagtttaattccgaaaactaaaagtgctgtcttttatgctctaacattttaaaactagtgatcattttaatattcatatagggattctagtagactgatcaataactcatgaaataaattttacatttttaataagatttctgagatggtggaaataccagtctttatatataatagagattttagacatggccaaatatttgggaaattttttctgtcttttaaaaaaactttttctcaggatattttaaataaaactatgcttttcacccttgcatattctttatctttttaagaaataatgctaaataggggatacatttccacatagatatttttccttcaaaaccatattttgtagaacacaaatgattaatgtttgcctttgtcatttgacaacagtaaaatatttatttctgtttttattatcaagacacattaaaatgaccacattgactcttgaaatgtcgttaatatcatgactacatctttcctgccttgtaatttgtttcctgaattatcctgtagtccagaagaaatgtgaatggcttacttgtccatgtcttctaattttgctgtagagattaaatgtagctatatctataatatctgtacaacacaaagtttttcccattttaaagttcttgtttcagcagtgtttgtttcagtgtttcagtacaataagaatatttgaacaggatcccaaatatttgagaggaatctggcaaaatggtacccaactacttcatgtattccacactttaacatcccctttaggactttaagaagctagaaaactctagttgacactttggtacattttttgatccccatgtttaacatggacttttttcttttgatttcattttacctttccaatgaaaaattattgatcatataatgataatagggattttaggtgcttttaaatagcatgaggcaaaattatagtttgtggaaagaaaatttaaaaagcctattaatatgaatgctcataccactactgggtattaaaattgcagaagatgtagtaatttcacttgctgtttactcagcaggatcttccctaacatgttcaaattctagggatattaaaaattttgtttgagggttcagagcaaatctaagtgtgtctacctctgtcacctatccttcttccttcacaccacccctccccaaaacacacagaagagcacagaattttttttttacagttaaaatgaataccaatagctgtttaagaacagatacctcacaaaggggatactcagagagatctgaaagaaaatgggtagagaaataatattgtactttagcttactgtcactaggatttgtcagatgactgttattagtggttgccctagatctgttttgatctgcaagctctcttttcctgaatcagtacccctgaatcactgcccagaagcttagcttatagtagcatagtttcctggaagagcttagtgtcttttggtgacaaagcttacttagtatttattttgtgtggcgttgtgttagttagaggtcacattactactgccccatttactgtaggtgtctgtgctcagcctttaaacaggtttatcttattactaaattactattcatgtgactcttatttgtatttttcctaataagtctcactagcccatttaaaactctatttcattgtttgctttttcttttttgatcatcctttccggtattatatctaatataatatgaaataaaatgacctttatgatttataagacttttttttttgacatttctagacatactttgtcctgctttacaattcatattctggagaagactattcagtgtgcacctacagatgatatattagtagaattactaaaggaatatacctgctgcagaaaacatgcttttaaattagatgattatggaatgaaaccacaccgatgagaggcctgctttcattaataaccttttccttcatttacaagattctcctgaattattttggaaactatgtacccaattcatggacacaggataatggctgcactctttgtgaattcgatacagtcgacttgtctgcagtagatgtaagtggaattgattatgtgtgaaatgtagtaatagaaagtacattgtcatgaaatactgtgatttataggaaaaaaggcaaattattttatagttttgattttatgatagataatggggatatagtgttaaaacatgatgattcagccatttgctagatttgtgtttcagaactgttttttgacagaaaaaccagctaataattgaacctaatgaaagagtcctgtggttaatatttaatagcttactacgattgggtgctcttgtgtttattctgttagcttagtcaaagcattgagaaaaaatcattacaaggcttcagcatttttattgactaattttatctgtgctggattttcaaaattgatatgtaaaaattaatactacctgattatataacaaacgactgttttaactactttacatataataactcatttaaacttcacaaaactcctaaaataggtagtacaattgactcagttttacagacgagaaaactgaggtgcataaatgtaagtaacgtgtttaagggcacacaattttaagtgttggagttgggatttgaatatagggagtctggctccagactactgtatgttcttgacactgtgcatttttacctgtgtgatgtgtatattctaggcatgttgctacttgtatgtatttcatagatagttatattttatcattcatgttttgagggtgaacaaagagttgaaaatattcattattaatctataaaacatttttatgtatctttgttctaacatcagccagagctgatatcttacaacaacatttttattccaaaaaattgctgacataacatggaagattatatgtatgaagcattgattctagggagttttgtcattaagactgattttttccttcattcactgtaagttcattgagtatctacagcagccagaaacgtagaagcaatataggcaaaaataaagctcttaggaatatagtactactaactcctgaacccatgcaaatgcaaaatacttttactgtaatatgttcaagctcctgaattaaatagtttctattcttatcattgtctgaaaggagtataaagagtaacttgtgtacatgtaggagcttatgaatagagccctattttacttgaaagtaaggtttttggccagtctctcagatagcaaactgtttcctatctgcaaagaatgccagaatatttctgaatgaagctgcatcatgaagatgtttaaaaatttatcctgatctttttttgccgaaagtagtgttgtcttctggagggcgagttaatactttttatctgtttcgtttccttttgtataaactttctggtgcaaagatagaaaaatatttatattaacattttttctttttgcatgtaggagtatgtaatttaatacttaagctgttttgtcttacagcttgttaaaatgtgatagaaaggaaaactattcattccattatgcataataaaattacgtgctatatacagctgtttttcaatagggatataaaaattaaaattgtgtaggtagttaaatcccaagcctatcataatgttagatgtgggccataggcaagtttctttatatgtaaagtcatagtgattatctcagagtgttggtaggaatgttaaatgaaattttacccacatatatatatgaatatacataacaaatatataaatgatattctatttgtataaatttaatatacatacacaaagtggtcagtattcaataaatgttaactgttataatgttgttgttatataaacatgaacttaggttaataatggtgatgtagtggattgaaacccagcactttaccctcaaatatatgtgttctgggttacttaaatttctctaaatctcattttcctcatgtgcatatttgggaaaataacctctaaggcttttatgtaaattaaatgaaatgcatcatctcatttgataaaggagagttgtgacctacttttaaaattatttttcctattaaattgagaactactggagagtagatattttgtgttctttgtatttgtttattcatttaataataaatatttgggcaagtgaatgaatagatgaagaaatatgatagtgtacaaggtgtacttttatgtgagcatatgttattatacagataatggagtaatgtgtgaggtaccgtgtatgaaaaaatggaagaaggttgctaattcagcacttaatgtataaggtatttaaaaatatttgtaattcttttgttcagactttaagacatggctttagtaagacattataaacaagtcttccatagatttctggtcatgacactgttacatgggtgtttacttatgttcctgtcttccccatctacttgtaagtctttcaagccaggaactttcattccttttgccaaatattgcccatcttgtggattggaatgtataatggctatttcagaattgtttgtgcaattaatgaaggataaactccacaccaaaacatatctaaagagaacttaagaaaatatattaaaatatatacattaagataagatatattaacattaatgaaagaaaatagctctccttatacataatataataatgaaaggaaataaaaggataaagtctcaggtctcccatgattgctttttatgtgctcaaaattaagccctgaactttaagccgaggaaacaaaaagagaaacacaattagtatttggtttcttagacgaaactttcaaaatagctttcagatgtgaagaagtttctgcaagggctattttaaaggaagcactgactagtagtgtaggcagtaccatgaattacattcatgtaataaataggataatttcatctttaaacctaactcataaccaagatgggattcagtaaaatcactttgattgggggggccacaaaaatttgtttcaagtgttagagaactgccatggagcaattcaaatttagcagattatgttgaattgatattctagtattttttatgtcatgctgattaacatttgaataaaatttaaaacaaaaccatactaatgataattttatttttatgtttggtgtaaaacaaaggtccatccaaacgtatcaataggtgtttttattgagcaaccaaccccttttctacctcggtttctggacatattgttgacactggattacccaaaagaagcacttaaactttttattcataacaaagtaagtatttgagaaatgaatattttatgtcaaaactatttttggtcttttttggaactatttgttatttatgtcaaataaaattcattgggttaagttcagtggaggatttttggagtaattacagccctgcctttttaggacctaaggattttagattctagagactagcaccacaatattgatatgagccacatgaaactgccagtttctgtagatcaaaaatggctgaatattagccatcatcatatagcttaaattaatatataatcaaggagattcaaagggccttaaatccctttgcctttgggttagttctggtactttcttctatagaattggtcattaaattgtttgtgatttaagacaataacatataagaacttgaaacagtttccagatagagtactgttttgattaattacacaagggcatgccattccccaaaggattttgatactgtcattttcttcaaaaatattcagagccccctacatacctcctacatattatccaaacttgaaaatatttttcctcagtatttttacagttatttcttgtctactaaaaccactggtatttaacattgtctagaaaaactcaatagctgtgaagtgtgcgattttctctcttctgtcctaatactgtttgtttaccattgttcctttttcctaatgtaaatgtcagctaaccattcacattgtccagagaatattttaactgcagaaaactagcttaaatggatttaaaatggtgaaaaattgagcatttgctttgtaaaatatgttgtaatatatatactttcactaaagtattttgtttttatgtattgtcttttgtttatattttccctgctttcatggggccttaaaatccttgatggcggacgtttttgtcttatctttggttatttagtattaactctatgttgcttttatgtgataagttattttaaaaatctgcaaaaagcaacagcttttcagaaaacttagagacttgacaaataaaaatctctgaaatgctctaatgatggagacagataatcttacctgaattttagcacagtcgaatcacactaaaattggtaacctttatgttgatggttttcccattaatctgtccatagaattgtgttaaatttttcctttttttgttaagtaaaatttttttatatatgaccatttattttactctctggtttcaaagggtattttgtaaaatgtgattatttaagtttataactcagattgatggctattatgcttagtagacattttttctagatatttcacaacatatatctaagatttctaggctacaggccgtgtttttcttctccagttggaaacattttatattactaaggatttaagtatttatgcaaacacctattaaagatttaagtatttatacaaagacttgtctagcagtagatattgacagaattttgaagcatcttctctttaagaatattgatatatatgtatttaagattattcatgtgacatttaagtgatatttaaatataccgtgtttaatatggttattattttatatgtaattgaatatctgaattgtagaattcatgaccttgaatgtgaagcactctctaatatgaatacttcagtcatctgattgtcttattctctaatttttgatttttaaaatatgttacaggaagtttatcatgaaaaggacatcaaggtattttttgataaagctaagcatgaaatcaaaactataaaaatagtaggaccagaagaaaatctaagtcaagcggaagccagaaacatgggaatgtatgttttaataaattaaaattaaattaaattattttactaaggaaacgttaagaaaaaataaacttttaaattaaaattgttatgccaaatttgggtgtctcaaactatttgtttgcgtatgcagtagccaacttagactgtgtctatgtttgtacgtatttatacataaagggctgtagaagttacttatgtttttcttttaatggctacgagtccacatatttaatcaaatgatgaatcaaggtaagatcaattttttttaaatgcagataaatgaatagtatgactttcatagcagtgacttaaatttaaatgtacactctgaaggttgtgtgtggtaaaagtgtgtttatttagactgtgggggaaacaggtgctcttactctccagttagtcactgagctagataatactgtaatcccaagaaacgggcattgtaggccttttgtttagccctgttaatgcttcattctactaataaaactctagtaatagtaaaaaaaatcgtgtattcaatgaatattaattgaatatgccaggaactgtgttaagagtaggtgataaaaaggtgaagacatgatccattctcatcaggaaataatcttatctactacgaaccctcatgcctgtgctgcagaagctgaggtcccagagggatggattctgactagattaggggtctagggatagacagaaaagaggcctctgaaaaaccaaactgatgttattactaatgattccataatttattcattggagaatcctctgggtccacattcagaacatattttctttaatatttttcatgattgtacctagtgcttctgtctggtattttgtttgatagttgcttcgaacaaatatggtgtggagacacacactgacaacagcaaaaagtgctgactgggaccgacagtgagggaggggagcccagagggaagttgataacccaaatgtcatctggtatctccagttgttcattccttgatattgctgatgataatgttacaaactgtaccagggaaagcaaacatagtcactgcccctggtaagaaggcaggggaataactatcttagaaaatttgatgaaaatcaagtttgtaaaatattaatacctgaaaagtcatatacttacatctccaacattcatttaaaactgagttgtgggatatgtaagttgcatttgtgtgcatgtgtatgtatgtatgtatgtatgcagaaacattttgatttgtggatgttttatgccttaaaatatttactggcttgaaaatatattttaactggcttaaaattttagaggtgagctccctgtgaatatccgtgttaaattgaccattttgaaatttaagacaatatatatatcgtttcagatattgttccactattttgatcagaaaagtatgctagagaaccatattttacatataaggatatacatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacaggtactttctaaaattcgatatcaatttattgttaaaatgattatttttcatattgatgtgaacatactgtagtaattgtgtatttagtaaattgagggaacttagttatgttctacagctaataaactttcaattcaagttaattatttttcatttaaaggagtcatagaaaacaacctgaatacatctggaattatttaatattagttataatcacaaatacagttacttggcccatttttctgtttaaagctaggtgaaattatgatacatctgatactaaaatttagagttgttttattctctatagatatttttaaagtagaatttcacaaaacttctgaccaagatagttattgcatacagagttgtagtccttagtatcagaaggaaatttcagaggtacaaatcatcccacagtcatatgtgtagctttatttactgttgaactagttatcacttcacagtgtctgtttgctcatttaactcaattgaaatgggaaaaagacaccatgtatatcagcttacaatgatactaagtttgtttgtcaatactactgctaatactaataataccatttttactactcctgctaagacctcacctttaacaagtgcttattaagtgccaggtattgttgtaagtacatgtattaacacaattatttctcataataaatagaatgtttagcgggtgaaatgttagaatgattgtttttattttgttaagtaagatacatgggaaatgtagtatgctttattaacccaccctatatataatatctatctatatatatatatcactagaatttgtaaatttgagaatttagttcttacttcaaaaatctaagacctctctgtagcaacctgtatatacagcccaactgtatagctgtgttatagatactcagtatctaagttaactatctatatacatcgtaggtaattttccaaagcatatgaatgaggttttgatcatttggcaaggaaaagcagttgtgacaccctagagatatgaaatagtgtatgatttgtaactcttaaaacctagtttaattcagtactgttttcttgaatttgcattgttttctcttaatttgattgaaatgctatagtgtgtaatgcccatatgctttttaataattagatattttcattttatgactataatttatatatttattaattattctcttagtgaactatttaatgaatttacactatgtatttgacatatatccctcttaatattaaacattttaaatcttctaaaagaaaaaaaattcccggccgggtgtggtggctcacgcctgtaatcccagcactttgggaggccaaggtgggtggatcacgaggtcaggagatcgagatcatcctggctaacacagtgaaacgccatctctactaaaaatacaaaaaattagccgggcgtggtagcgggcacctgtagtcccagctactcgggaagctgaggcaggagaatggtgtgaacccaggaggtggagctggcagtgagccaagattgcgccactgcactctagcctgggcgacacagcgagactccgtctcaaaaaaaaaaaaaaaaaaagaaagaaaaaagacttacctgccatctggggcccttgccccttaaagagtaaaactcaggctgtgtctccgtggaattctgttagttaatcaaaggtttaggtttatgtaatacctatggttcttgcttctgtatctagacatgtggtttctatagtctattgacatatgccaggaatgttgcaagatttagtagattggactgaagggtagagaaagagatttgacacatcttgggcatgtggctttctagcttctcatcagctctcttttttcctcttctctccctatctctatttgctcccttgctctaaattttactccttaaattgtataataatatgaatcattcctcagctgccatccttacatttttattcacaaaaacattgaggtatacagcagatgaattttggtttcccaaatttgttggtttaaaccttttcaggaggcagctgggattataaattacaagttctttttaaattaaatgtttgatattcatattgaattatttcccaaattaatgtatgtagattctaattcatgttattatttccagtattgtaggtattcaaaacaaaacaaaacatgtgtttctgattaatagtttagtaggaattcggaagaataaaccaaaatttattattttgcatgatgtgtatttatttttatttatttatttttttgagatggagtcttgctctgtcgcccaggctggagtgcagtggcatgatcttggctcactgcaacctccgcctcccgggttcaagcgattctcctgtgtcagcctcttgattagctgggattataggtgcgtgccaccatgcctggctaactttttttggtattattagtagagatgggatttcaccatgttggtcaggctggtctcaaactcctgaccttgtgatccgcccgcctcggcttcccaaagtgctgggattacaggcatgagccactgcgccgggcccgatgtgtgtttatttatttcacttttgtgcatgtaatagaaagggcctggctggtcttcacaagatagaggtgaaataggttttcttttttcatataaagaatagttgttccataaatttgctttctaaaatagttaaaggaaagttcagtgttgccaggactagcttactgtaatcacaagtcattttttaaagtcatggaaaactggaaacatacttaagtaatttgagacttaattacaggaaagctttgcctgtttacaaacatctcagttcatcttcattcattttttacaaattcaacaaatattcattgaatatcttaaatgcaccaggggctgttgttcacccagtgacaatgaaaatatttggtttcatttaatataggttccgaaatactttagttaaacttaaatataattaaataactaaagtagtttccctctgttggatgtaagcaaggcatttttaaaagtcatttttatgtattcattagcattttcaattactttttccttctttgttactctttttaagaaatatgattgaaaattagcaatatacttacttaagaaaagatgttgggaaagaagatccttattttatttttattaactacaggtttgttgaatgagctttcttgtgttatatgtcatactaagcccaaaatacataattctgtggtaatttaaaaataaataattatataggtttctctctctcacacacactctctctgtctttagaaagatcattgctcctcttgtaactcgtcatggaaagctgtggtccaatttctggggagcattgagtcctgatggatactatgcacgatctgaagattatgtggatattgttcaagggaatagagtgtaagttacttggtttaatattttaatgtgaaataccataatctaaagatgtagtcttgttagtattacttgaaattttttttgcattcatctcttttctttatagttaatgggaatttgagaacccaagaccacttggaatcctgaaatactagtataaaactaatattttaaaaaaatgtttttaaagtcccaaatcttcaaaggaacaagctcattgctgtggggaatactaagagataatatatgtttaccatactcacattatggttgatagaagagtaatactctttatttaaaagcttggaaaggggatttagtttactaactttttaatggttataattaagggttgttttgataggttttaaaatttataattaagccaacagtaacactaacagccagaacattccagtattcctgattgcatgagtttttttgtgtgaaatagctattattctgctttaaatacaagttttttttaccaatattagattttcacttctagagattgaaaagaatatatttgctgaaaagtgtgtgcatgatttatatttatttcagagacaatggttgattactaaaaataatcacaattgaaatagttttgctaaggtaatattggagaagaatgtcattctttttttcatacatatgatggaccagagtgactaagacattacatgctttgccttagttctcaaacatgtcagcctgattaaaaaggggcagtatactctcaggactaaaaggatgtgcccttacatttagaaaaaaaaaggcacacgtttctgttcaaacagttgagtggtaaaaagatgtgttgcttgtggaaatagtaattggtgtggaaagcttcaatctgaatgatgtaaatacaataaaggtttttgttagctgcaattaaaatgcacagtggaggagaaaagactattaagatcgtattctgttgtttctgtgcagttgtattgactctgggtgagttgtatagacaatatacctgattgtatctttgggcacatcacaaatgagggtttgtgaaagtagaatgcaaaatttgtttcaagttgctttaggcattggtgattttctgtccaacctcctgtcattcttgtctaaagtataaggaaaaaaatatggcagaagcttttgatctggaatacacttcatgtccaaaagctacacgaaggagcaactgtgtgtgtgtgtgtgtgtgtgtgtgtataagttgaaacactgaataattccccagagattaatttctgaatttagctgacacgttgtatacagtaattcccctttatctatggttttgctttccatggtttcaagtctactgtggattgaaaatacgaagatatgttgagatagagaaagtgtaaacattcatgtaacttttattacagcatattgttatagttgttctattattgttgttagtcttactgtactttatgtataaattaaactttattataagtatatatgtgtaggaaaaaacgtagtgtatgtgtagcgtttgttactatctgctttcaagcatccactggggtcatggaatgtatcaccctcacataaggcggggactgctgtactccttaaggcatttttctttgaggctagtctagtaagacataatatcatatttccgttaatatctaactgcatttcttggtcaagatcttgccttgatgttctctaaaagaaaggcgcacagtcttaggggcaaaacttgttttgcagtttttatgaaatcagtcatgttcagagtgagaatatagatgtgggaaaggatgcaacgttcatgtgctcccagctgtatttcttcatgttttcctttttctataaaatatttaagatggcttaatgaatggtaagagaatataattttggagaattttaggctatattcagtggtattttggtaaatgtgtaacaactggcttttggaggtggaggattccctgatttaaagtgcttgcccatttgtttggtgtaaatacttctaccatggctgatttcaagtttccaatgtgaaattactgaacatggacttggcagaaaaagttaactttggggagccagtatgagctgggtctagtgcaccactggttgtatgttatgattcatgctatcaaattctttaattttaaatagaaacaccgtctatacaatagattataatagtctaattgtaacaactgattgagatatgatagctataatacaaatgccaaacagataccaacccaaaattgaaatgtatccaaaggggcagtggtttatctcctaaatctcattaaatatagtgtatacaatgtaatcttatatatatatcattgaatatatttgtatgttgattcaataatttatgtatacaaaatctaaacacaaagcatttattttaaaaaggtaaaaatgaaacttaaaattgtttgtatttgtggtatataagaatgtcttctctttactttcagaggagtatggaatgtcccatatatggctaatgtgtacttaattaaaggaaagacactccgatcagagatgaatgaaaggaactattttgttcgtgataaactggatcctgatatggctctttgccgaaatgctagagaaatggtaagatatgcagtgatggcttgcttgaatgttcttataagatggcttgctttaccagttggtgtgtcactgtgttttgatgccctttgtcttgctaatttgtaagtactagccaatttttttggttctgtgttaaaaaatttgggagtaattttggagataatttaacatttacttatagaaatggtatgaaaaatgttagtttttgtgctcgggctaattcataggcaaccgagttggatttcagtaataaagatgtatttgttacaaatcagctttgctcttttaagaatacatctttaatttgaaattctatagtgaaaacttgacctaattaaaattaattagataagcttcgatgaaacaatatttccagatttaagaatatttttgttctaaaattaatgtccacattttctctaactaggtaaaattttaaaattattattaacttcacattcttagaaagcaggattattaccaccaaactagtagaagtgttgagatacatagtgtatttactctaaataaaatactaatgataccttgctgcactacaaatgtacttttattataaaacttaaaatgactagaaaataatttttcaaaatgcataaacatggcttagaatatattgatatgatttttggttttagaaatgatggggctattttatttccgatttccaaatttatataagcaattgtgatttgatgaaaagtcagaaaagttggcaagtatttttttcttagtttaacaaagcatgtattgtttgaatatgtttgttttctctacaaacctgtgtgcattattattgaatatcctcagtacttgtgatagtattttgtgctcatgtttggctaatttgactcaacagcgcatcatggaatggcctctcttactcattttttccgttgtcttatgtgtctaatgaaagttctgctaaggaatgagcttagacttatgtttgaccccaccacacctcccaaaaagaaaagaaaagaagggctgaaagagctggagatgtttctttgtgtgtgctataagctttgcttgttctgcatgttgtctatgaaggacatttcagaatgttagcttttgatcaacagctgctattatttttatttaccaaagaatacctgagagagcgggtgtacaggtcaacttacccaatgcttctcttcattttagactttacaaagggaaaaagactcccctactccggaaacattccaaatgctcagccccccaaaggtgttatttttacttattttatttatttttgtttatttaatatttgatatagtatattgcctagtagtaaagtttctttaagggccttacttgcatttagcttggtaaaatgttgattttcatcagtcatctgtgtgtttgcgtgttttgtgtgacttgggcatgggtcttgtgtgatagtcaactcttggttctttgagctgatttatattttatggctgacaggtgagaaagttaaacctaagtccctttcattctttttttaggtttttatttctttttaaagggagagaagagggtagaagtaggtataaaatagaatttgattacagtaaggtttaggtgcaccttattgagttattaatcactaactcttttactattaaaacaggtccaaaaagaaacacattacctagtggtgtttgccacatttgtctggtttggggcaagaatatgagactggttttctttatctgcctttataatgtatgactcatttgcgtgttagcctttaaacattagaaaaagaaaggaatgaaacagactggtgaaatataactggcagtgaattcttgattaaaaatgtgatgctttctttgaaagagaaagaagccaaaagaggtataattcattgcactgtgtctcaaaaatatttctgctttcaaacaggaattttttccccgatgtctacatctaggatcaatgagaaagggacaaaaacagtccattcttctttttttcagttgagtgtcagtgctatctactagttttgtgtggtgtctgaattcataatcaaaatttgagttttttattttaaactatgcacattttatatgaatactaaaaatgcatgttcataaatgaaatagatagaaattaatatcttctatatatttttcctatgattaaatttacttttgtacctacctctaagattaatactgttattttctggcatatagggtgtatttatgtacatttctaatagacatgaatttggaaggctattatccactgctaattacaatacttcccattataacaatgacctctggcagatttttgaaaatcctgtggtatgtatttcatactcaactttattatttttctataactgtaagtggttataaatcagttggttaataatatgaaatgtggttagaggctttttaaaatgacataaggtgaaatgcacatcaaaaccacaatgagatactgtctcacaccagtcagaatggctattattaaaaagtcaaaaacaacagatatgggtgaggctacggagaaaagggaatgcttgtacgttgttggtcggaatgtaaattagtttagcaatttggaaagcagtttgaagatttctcaaagatcttaaaacagagctaccatttgacccagcaattccattactgggtatatagccaaaagaaagtaagtcatttgaccaaaaacacacatgaacctgtatctgttcgttgcagcactattcacagtagcaaagacatggacttaaactaggtgttcattaatggtggattggataaagaaaatgtgttacatacacaccatagaatactatacagccataaaaaagaacaatattatgtcattttcagcaacatggagagaactggaggccattaccctaagtgaattaatggcacagaaaaccaaatactgcatgttctcacttatgagtgggagctaaacattgggtacttgtgaacataaatataggaacagtagaccctggggatcactagaggagtgagggagtagggagggggacaagggttgaaaaaccaactaatgggtactgtgctcactaccttggtgatgggatcagtcataccctaaaccttagcatcatgcattatacacttgtaacaaacctgcacatatactccctgaatccaaaagctgaaattgtttttaaaaagtaaataaaaagaaaaaaattaaaacgacataattaattgtatttcatgatctatagagtagatctaaacttgaccaataacttgtttttattaagacacttattagctttggggaagggaattatcaatttgttctcttccaatattctattatttttgttttgtgtattcaaaagcaccatccagttttaatcacaattttagaaacatgtttacaaatagttcacatattataatagtttgattttttagaagaaaattcaaaaagttttgtttaggaaaatacattttttaaaattattttttgacagttttgtgaatgtacatcaaagatagccagagagaattgcagagaaagctgattgattcagcatatggagtcttaacttgaagaaacaatttccttttaaaatctgttttcttcttctttttttttttttttttttttttacagatttgagtggtacagtaattagctccttttgtgttttacagggacatctttttgttaggcaagtggcacacttattcaagggaaaatgctgtcttcaacaatcaaacctgtaacactgctgtaatgattttccccttgccaatagtaaaagttttaaattgcagactcaatccacctgatgagaattgtcctttattttgtaggaatagttgagatatggggatactaaatgtagtagtctttgaatattctgaataggaaaatattatcttttgacattttgttattttaaaagtacttttgttccattttaaccacataccttcctctttcacagaaataaagctgaaaagaggtgttttctagtcgtgagggtagaattccatatttcacttcaccattgaatctcttggtgtcttgagggatagaattatttgatttcttgggtgacattaggttcctggtcagatatcctgaattatatcctgaattgtagatatttgtgtaagaattcaagtctttggaaagtaagcaatgaaaatatcagaactgagtaggaacaagttttctttccatggctttctttgttaaagcagcctgattaatatgccttgtgagggataccccatagcaaaatgcttattgattatcccattatcagaatttctaagaaattaataaagtcacagtttgctcaatgatttgaaaggtgatctaaaatgaaatgtgaatactaatgccctaaaataaaatcttaggggattttttttttactttaacttgaagaaaaatcagtattgatgcacaggaaaaatgctataggtaaaagttcttaaatcttatggatgattattcaatttcttgccacattttagaatcagaaagctaattaatattagagggaataatgagataatatagaaatctgatccatatatactatataaacatgaaatttattaaaattttgaagatacctttgtttcctccacataaaaaatgtttgagttacatataaacagatatgcaaaaccagtgacataaattatggtataaatattcagcccctaaaatctagcctcaaaagatgtatttaaggcaaatatcttttaaaacatcttttgattggaattattttgagtctgtgtctcacttcctccctgctggctctctgtatttgcactttgtaaagagaaaattaataatttctagaaatattctaaatttcagaagatatctttttggatatttatattactccatgtattaataatattttagtaaatatccatatttgaataaagaacttgtcccaataaaataattctttagcttttgttgaaaaaagttgagatatctttgtgtgtggattttatgccagagattggtcaaaaagaatcaaattcatggattagaataaagagaaaccattttttaatatagagccctaacccttaattttagtaactgaaagaagtgcaagtgctagtaaactcatgattattccttgataaatattaataactgaagtgaaggcagaaattttaaaaactcatttaaaaaatcaaatttagagtaatttactatagacatataagacagaccctagttaattagttcactaattcatttttacaaatacttgttggtagaattttgctccttgtcttttacctttaagcacacctttatttacctactctgtgtatatattaaaatactgatggtccccaacttacggtggctttacttaggaattttcagctttatgttggatttatcggggtactgtgtgtttttaacctcccacgggtttattgggacataaccccatcgtgagtcaaggagcatctgtaaaatgtgtaaatctattcactgtaagattacttaagttttaaaatcctgaggtacaatatttcataaataaaaattttgtatttcatagaatgacataagcatattcagaaccaggcaaagattaagctatatactgtgatttctgaaaattactattttgtccactatacataatcatttataagttgaataatttctaaaatgcatatgctttatacttttcagtgaagtatttataaagatatttgttttaatatgtacttctttttataggactggaaggaaaagtatataaaccgtgattattcaaagattttcactgaaaatatagttgaacaggtttgtattaatgattacaaagtatagaaaattttgctgttattttccagaagaaatattattaatactactttcacagaagatgtgaaagtggagaaactaccttttaggtaaaatttatttgattcaattactgattaaatagcattaaggaacatacagttgtaaaatgtagaacatagaaattaacattttaaaagcatgcctttttaaaaagcatgctcctatgtgtcatagctttctgaaaccactaaaaatagaaactgttgacagatctctgatgtagaactcttgcagtgaaagcttatctttggaagaaactgggctgtctttctggaagagtcttttctcagagacatctttgaaacatgaattctcttttagcttagtgttcaaaactattgttaatacctaatttttgagaatgtaagatgtcatcaattctgaggtgcaccattatttatgtaccatgagaaaaaaaatactgtcaataaaccatgacagaaaactatgtttcctagtcatacaggattttttattttacacatattaaaataactattttagactattaagacacagaagttattatgtcttctaacgatgatgcatattttatagccctgtccagatgtcttttggttccccatattttctgaaaaagcctgtgatgaattggtagaagaaatggaacattacggcaaatggtctgggggaaaacatcatgtaagttgtaatttcacactaagaactaaaatgtatgtgggggttaagtagatactcagagaattcggaggggttatatactttttctcatatgtctctgagttctagacttagataaattggctagccaaggctctgatttcagtctacttctcccaccaaccaatttttttaacacttaagtaatttcattagtttgggcgggtttctcatttatgcatgtaattacactggatgttccctaagggtcgatgtcctcaggccagagtttgttaggtaacacgtctttacagagtgatatcactcttttccaaggccactttttattccttgcgttttcacagtgagctgtggtgaaaattctaaggcaaatgttatctggctctgaaaactgtttttgtgtgtaaagataggaaggagggatctgagtgccttaggtgtaattcagttttgcatttgcattcagtgtcaaagacttggcaggaaatactactgccagtggttagatgtgtttcttttcctctgagaacagacatgccattttagcagaatactctggaatattactgcctctgcacggttatgtcccccaggtaatgagctgataagggagagggaagcttaaagtataaggaagaacttaagtcagcgggtgatgaaataatgaaaagcaatcattcaaaaacttttgagtgttacaaatagaagtgaggaagggcggggaaagcttgtttttggtgtttggtaatacagacagcagatatgccaagtgtatgctcatcaagcagctgagactgcctaaagggtcactgtaaaaaaagactcatttttaagaaaggatgtgagggcttaggaagtcaattttatttactttatagctaaacttcacatatacatttaagaagtaggaaaggagtctactgaccttacattactttgtttcgtcattgtatcattgacaaagctgttacctaagttattttgataattttacagttaaagcagatgatataccacattggaacaactgttatttttattgtctattatgatctgtggttgaaaaaaaatactataatataaatgggaattgcacgtggagtacagcttattatgtcattaatgttgtttctaggatagccgtatatctggtggttatgaaaatgtcccaactgatgatatccacatgaagcaagttgatctggagaatgtatggcttcattttatccgggagttcattgcaccagttacactgaaggtctttgcaggctattatacgaaggtagttatcctctcacccctccagcctatttcttacccatttttacacaggtgttctttttaatgtttttattaataagcaaatccactggcttactttgctttttcagggatttgcactactgaattttgtagtaaaatactcccctgaacgacagcgttctcttcgtcctcatcatgatgcttctacatttaccataaacattgcacttaataacgtgggagaagactttcaggtaattatgactcttgtgtttttagatttttcaaaagaaatatatcattatgaaaaggactttgccttaggccttagtttcttttttaaattttgctcaaatgacataatttgaattttgccactggttaaatataatctgatgtatttcttcattttaacttttttagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaagttttgttgttctattattggtgtttatcttccaaagtgaatacatgatggaattgtctgaaagaatgaagcctttgatttttcattttgcttagtagatttaatgatatacgaaactattgaattataaatgaaattataaaatcttcaattttaggatgactagggatttgatctaactcgttttccaagtgagaaaatagaagccaaatgttattcaatataggtttatttgtttattaatattttctgggtctctattatgggtcaggcactgttccaggcaccaaggatatgttgatgaagaagacattatagtcactgtgagatggacttaaaaagataaggaagttggttctactcctgttctcttctttggcgacacttaatacccaaagaaaatttctactatccatcaactaggataaggagacattttagtaatgatttgtgaattatgttactgtacatcaggaatggttttcaaaatatgtaacacctggtatgatgtagatgccaactcatcggaacagactctggttataaaagcagatcggttcgttcctaccagtgcaagccagcttaatatctcttgtggtacagttcaaagacatctcccaggtactagttattttccattttggtatccatgggtggttacttagcataactatttcagtctcatgccatgttttcagaaatgggatccaggtagtctattgagcacagtttttttgtctttcctcttatcctacattccatgaaataatataaaatgtagctttaaaaagatgattcataattactgagagaaaattagaaaaattcccataagtagattaaaaaatttgaaaaacggaaaacgagtagaattggaaggatggagaaaaatacagcttgaaacacacagagcagaagatacagaaagtacatctattgtttgattcattcattttatgcaatataataaaggctttttaaaaaaaatacacacacacacccatatatataaacaattatcccctgaataatatgggcgttagaggcactgatccccatgcagtcgaaaatccacatgtaccttttgactccctcaacacttatcaactaataacctactgttgactggaagcctcactgataacataaacagctgatgaacatttattttatatgttatatgcattatacactgtattgttacaataagctagagaaaacgttatttaaaaaattataaagaaagataaaatatatttactattcattaagtggaagtggatcatcataaaggttttcatccttgttgtcttcgcgctgagtaggctgagaaggaaggggaagaggaagggtgtctcaggggtggcagagacagaaaaaaccggcatacacatgagcccgcgtagtttaagcacatgtagtccaagggcttattgtgtatctgcaacaatcagatatctctgacagatgaacctgataaagtcacactatttagagtatgataccatttatgttaaaaacaaaatactatatatgtgtgcataaacctacagaaaatttcctagagaggaacaactctggagagtggtatgagatcacggaggagtaaataggatttatgccttttaccttttacacttgtgtttttgaaatattatagaaatatatttgtatattgattgtttaaagaaaaaaagactagaaggaaaaggagacattcacgtaactaatttgaataaatggaagcatatggatgtcaatagtaaccgtgtgtgtgtgcgcatgtgtgtgcacaagtgtgcatgtgtgtgtatgtgtatacatacattaccaaggtgctttaaatgctcaccgtggtagaattttttctaattcttaatgcgcataggaatcaatatgaatattttccttaatatagatacttcagtagtcatccagtgcattaatcttcattctgcttcatctttgaaaacactagtaatttatctgtattggtaact

SEQ ID NO: 17198 - DNA, 20495 bp, Human
cagggaagcctattcacaggaggctgagatggagtcaccaggctagagtcggggcatggctctactagccagaggcagccttttcagagcaaaattaggccctactccttggaggggcctgaaggatgctgcaggttaccagggcaggggcagaaagctgggaagtaggcagcagtctagggagagacatgggcctcagcaatggggtagaaacccagttaccatgtgaagaacaaatgccacaagagagactgtggaaggactaaggcagacataggctctatctcagccataccctgactggctgtctggctttggacaactaatatctctgcaaataagagtaatgattctcagctatagtattatgagtattacatgaaagaacctaagcaaagtacctggcatatagtaggtactcgataaagaaagctaatggcggccaggcggtggctcactgtaatcccaggactttgggaggccgaggcgtgcagatcacctgaggtcaggtactcgagaccagcctggtcaacatggcgaaaccccgtctctacttaaaaaatacaaatattcgccaggtgtggtggcacacacctagaatcccagctactcaggaagctgagacaggagaatcgcttgaacccaggaggcggaggttgcagtgagccgagaccacaccactgcactccagcctgggtgacagagcaagactccatctccccagaaaagaaagctaatggcaataatacttgccccaaaatgttagactagagggactcaattatctcccacaccaaatcaggattgatttggggaaacagggatgtggataatgctacatgtggaactcaagagtgcccatctgttggggagagaaggaaacatgatccagaaaccaagtcaaacccattggaatgtataaaaattcagagttatgtgttccccagcttcgagatgggctgctccccaactgaagatgtgctgcagatgttagctgatagctgaagtctagattttctcaaatgttattatatacatcagttactatcttctactatttctcttcacttcccttacctttcccaccacttcaccccctattctactcaacttctaatccacagctaaaagacagaggtgtaggggaggcggcaaggggttctctgctttggacattcactctgcccttcgttcagtaacaatgtggctcaagttcctgctatcatcatattaatagtaataattgcatttctgggtgcctgctataatctggttctttgctagtggtttggggagttttaaaaagtcagtcacacacacttcatgtgcccacatagcttaccactcaggtatcaccatctagcatcccatatagcacccactggccagggagctttgggaaatggaagaattctgatatgaaaagacttttgcacttgacccaatctttgacgcacaaatttgaatcagaattttgtgtgtgtggcacctactctcctttcagccacactccttttacccgcgactcccatacctttcccttccttcccagaatacccaggggcccctgaggttcagtgggctcaaagaatagtgagtactagtgctccgacctttttaaaaacaatgccccaccttcctttccttaaactcttcccagacctcagtaagcactgaaggcgctgaggggtgaaagtgcttcatcttttggggcagaggagaccccagcctgccaggctagtcagttccccagcagtgtgcatgttgcatgcctaggcagagggaagacttgaagcaggagaaactcccagggcctcctacaacatggcaggctgggggtgacttctgctgccgcaggggaagtagatgacagcattgtagactgggttggccttggtggagtcccaagcttctgttgggagggccctgggtaacctcatgattcttctctctgtgggtcaatacaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacaggtgggcatgcttattcttgtcttccttcacggctggtccacagaagggattgttctgcttctcttgtactgattataatcatgcactgtccagaggcctcccttgtaaagaccattaatattgaacttttaaatattaaagtttatttatattttggaatataaataaactgttaatattttgaaccatttgtgtggcttaaaattcaaaggtataagatggtgtacagtaaacaatctccccaccagactcctgttccccagacaacccagtcccttcccagaacatcaaatagaatcattttcttggagtctgtccagatctgatatgcacatgtaatcaatgcatataatatactgtttttcttactgaaatggtgacatacactataccctgttctgtgccttgctgtaaaacaaaacaacttaaccttgaagtttatgctggacagcttccatgcccctccagatgtactctccaccacacttcatgctgccttctgctggggccagaggtggggcatatgctgatagcatgggccaccacacagggcgcttctcagggagggatggagggaggagagtgaagtcaggagatggattatctggcccccttcctgtgagattgtgttgagctggctgggttccttcactgggctgtgttcccttccaagcaactttccaggctgtccttgggcacagagtgggcgagaacctgtgctccgagccttaggttgcagcagtctccctcatagttcctctactccgtccacacctttgtgacatgtcccttgtaaataaacccacccatttagagtggcactccttcctgttgggactgttacaaagcacattgcacatccatgtataaggtataaggagcttttttcttttttacaactgtatagggttccaccatcttgcatttagtcaattctcttgatatgtccagttttgtcctactccaaacaacactgtgatgaatgacatttcatttaccttttttttttttttaacatggtgaagtgcattagtttcctgtaactactgtaacaaattaccacaaactggcggggtgacttaaaacaacagaaaagttattctcccacacttctggaggccagaagtcccaaatcaagcattggcagggttggttccttactgaggctctaagggagagtatgtgccatgcctgtcttctggctcccggtgttgccagcaatccttggtgtttcttggcttgcagacgcatcactctaatctctgcctccaccttcacagtgcttcctgctctgtgtgtgtgtgattttcaatctgtataccttttccccacccctgtcttattgcactggctaaaatctttaggatgatgtcctagcctaggcaagggtggacatctttgcatttaccctgaccttaaggggaaagcattcagtatttactataaaatacaatgctagctataggtttttaatatctggttgaatgtgtgtgtgttcgtgtgtgtttataattattataattattattattattttttttttgagacggagttttgctcttgttgcccaggctggagtgcaatggcgcagtcttggctcactacaacctctgcctcccgggttcaagtgattctcctgcctcagcctcccaagtagctgagattacaggtgtgcaccaccatgcctggctaattttttgtatttttagtagagacggggtttcaccatgttggccaggctggtcttgaactcctgacctcaggcgatccaaccgcctcagcctccctttgtgctgggattacagacgtgagccccctacacctggccaattaatttttttttaagatgaggtcttgttctgttgcctgggctggagtgcagtggtgcaatcattgatcactgctcactgcagcctcaaactcctgggttcaagtgatcctcctgccccagcctgcggagtagctagaactataggcatgccccacaggacctggctaatttaaaaaaaaaatttgtagagatagggtctcactatacagcctagtctggtggtcataaatttttaaaaaatatgttgctagatctgaattgttaatattttgttcagagggttttatagttcatcaaagttatttgatcaataacgaaagttactcatctttagttttcttgtctcataatgtctttctcttatttagatatcagaggaaacctggcctcataaatgcattgaaaagtgttccctctcttctttttttttttaattcataatattttcttattatccttttaatatctgtaggctctgtagtgatgtgtcctttctcattcccgatgtaggtaatttgtgttttctttcctttttcttggtcagtgtgactagaaatttttcagtgttattgatctcaaaaaatagcttttggtttctctggtttcttgctttctgttttcaattttattgacttttgctttttatctttattcctccctttttgtgcttgctttgggtttattttgctcttctttttttagtttctttaagtgaaagcttaggtcattgattataaatctttctactttcctaataaaagcatttaatgctataaattttattctaatctctacttagctgcacccacagattttgatatgttggattttcattttaattccattcaaaatattttctactttctcttgtgaattcctctttgatctatggggtatttagaagtaaactgtttaatttctaaatatttggggattttcaagatatctttctattaataatttctagtttaattcccttctggtcatattatatacatagtaatatatcaattcttttaagttgatacttgtttcatgctccagaatgtggcctattggtgaatgttctatgtgtacctgaaaaagctatatattctggtatcattaggttaattattctataaatgtcaactaggtcaagttaattgatagtattgtttaaattttctttgtctttactgattttctgtccatttgttctattgattagcaatagagaagtatagacacctccagctctaattgtgaatttgtctatttctatacatttttgcttcatgtattttgaagctctgatgttaaatgcatacaaattagaactgttatgtcttattggtgaattgacttcttttcataatgtctttttttatctttcataatatttcttgttcagaagtttactttgtctgtttgtaatatagctactccaggttttttttaaattagtgtttgcattacatttttttccaccctgttaatttgtctttatatttgaagtagatttcttgtaaccaacatagaaacatagagggaggtctttcttttttattgtctggcaattttcctttttagttggtatggtatgtgtagatctttatatttcatgtaattaaatatatggttcaattaagatcttccctcttcctagttgttttctattagtttcatcagtttttgctcctttattcctcttgttgtgcctaattttgtttaattatttttatcatcccatttatctccatggttggctttctttttccccctctgagacagggtcttactctgtcacccaggctccagctggagtacagtggcacaaacacagctcactgcagactcaacatcctgggctcaagcagtcctcccacctcggtctcctgagtagctgaaattacaggcatgtgccactaagcctggctaatttttttacttttatgtagagatggggtcttgccatgtttcctaggctggcttgaactcctgggctcaaggaatcctcctgcctcagtctcccaacgcgttgggattacaggtgtgagccaccatgcctggccatgattgtctttttaaaaatacctcttaaaaaaaatttactagttgttttaagtttgtatatcttctttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgccagctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaagtttgtatatcttcaattataatataccttcaaataatgttatactgcttcacatgtagtgtaagaatcttaacaacagtatactccctatttgtcctcccatttttatgctattgttgtcatacattttgtttttgtatatgctataaactcctaaaacattataactatttttgctttagataactatctttgagaatgattaaagatatgaaaaaatattttatatctgctttcattcacatgattcctaatcttcatttctttgtgtatatccaactcatcggtgtaatatatgagttggatatgtaatcatagtcctctgcctgcaaaattttctttaatgtttctcatattgcaggtctagtggtaacaaattatttgtttctgaagaggtctttatttctctttgattttgagaaatactttcactgggtatggtattctgaattaacacgtttttcacttttggcattttaaacatttcactccattgtttttggcttgcatgtttgtcttttgtacatctttgctcctctgtaggcagtgtgccttttttccttggatgcctccacagttttctctgtctttggtttttcagtctctatctttggttttcagctgttcgaccatgatgtgtctcaatgctttgtgttgttttcaatcctacttggggttttctgagcttctcggatctgtgctttgatgtatttcattatttttggaaaatacccattcattatcttcttctctgctttctctcttttttctcctcctgatatttcaattacaagtatgttaggccatttgatactgtcccacaactcccggatgcttgattttgctttttctctactcatttttctccttgtgttttagatggagtaatttttactgacctatcttcaggttcactgagtctttcctttgctatgccaatgctactaatgagactattgaaagcattttttatctccatcactgtactttgtttttatgtcaatttctaatattacattcttttaaaagtaatttctgcattctggctgggtgccgtatggctcacacctgtaatcccagtgctttgggagatgaaggcagaaggatcacttgaggacagcccagacaacatagcaagatcctgtctctacaaaaaaaaattagctgggtatagtggcttgtgcctatagtctagccactcaagatgctgaggcgggaaaattaattgagcccagaaatttgaggttacaatgaatcatgatccaggccggatgacagagcaagaccctgtctctaataataattattatcacatttattattaatatattaattttatagtagtaattatttatgtgttcttctgaaattccacctctgttcatgcttgtttactttttccattagagcttttaacatagtaatcatagttactttaaattttaaatttcctgtctgatagtctggttatgttgattgttttgtttcttgacagtaggttctttttcttaattttctgtttatctcataatttttattggctgccaaacagtgtgtagaagagtagagactggggtaaataatacttatgcctggaaatgggcatgcttcttcccctgggctctgaatatgagttgaggcagtctattcgggagttcattgcatttgggttttgttgttcctatgattacctttagtgtagcaccagatttaaattcttctggggtactttgtgcttaagttggagatttgttgggttgtttcccttaatgtgcctactcctttacctgtaggccatccctatgcacacagttgcttaagacttggtgcttgttagcctgattggagctggaagtggggatgtgggttctcctttgtacagtcctgtttcagtcttaagcaagccctgtgctttggatctcagagttgggcactctcagtgatcttgactcattgcagagacaaaactctagtgatttgatcccttggtggtttctagcagggttacagagctttctcttttcatctttcccccacctacaacgggtcttccctattccctggggtcaacagtgttttctgcttttcccctagtcaactgaggcttttgttccataagggagaaaggtcttggtggaacttcatgctttttccacagcaacagctgttcccttcctccaaacatgtacctctcagaaaggcttcttctgtcctcctgtcctgtccccagtcttcctcatgaacacctggtgaggcctgtggaggagggcttgcaaatagatgtgaacttcttttgcatctgtcattccaagagttctatactctcatggtagttcatattggcccattagcaatttgttaaaagtgttagcaaaatttatttcacccacttgtatgtaacgccctgttttcttccctctattgcaagtgagccagtccccaagtccttctctcattggaggtgcctttctttccataaattccaggctacatgattgtgacctcagctctctaatggtttaaagaaaagttataattttgtagattatctggctttttcttgttatggtggaagtgatgctctttccggctttccacattgtagatggaacggaaacacacccaaataggttaacaaaggttacctccagaggggattatggccacattttagtctcatccttttctgcattattcaaatgttctacattaagaccgaatttcaatttttataataatatgtatatgtctatattatatacgtaggagccatttagggctttgtgttattaaaatctttctcagtcactgatcaagtgaacggaggctaaatctccacttttattttgtaccacaaaggtatcttctgaggatttagtaaaacacatctttataagaaagattcacatacttttaataatgctttataggtgttaaacacacacatacacatggcatttgctgtttattacaaagcagtttgtggggtacaaatgaaatgttaacccctcccttcctatctataattgacttatttttacagatgtggaggttaaagattaaaagctgaaatgagggccaggcatggtggctcatgcctgtaatcccagcactttgggagtccgaggcaggtaaatcactcaaggccaggagtctgagaacagcctggccaatgtgtcgaaaccctgtctctacgaaaaatacaaaaattagctgggcgtggtggcaggcacctgtaatcccagctacttgggtggctgaggcacaagaatcacttgaatccaggaggcggaggttgcagtgagctgagattccaccactgcactccagcctgggtgacatagcaagaccctgtctcaaaaaaaaaaaaaaaaaaaaaaaaaaggctgaaatgacttgtctaccttcacctgcaaataaatgaaatagtcaggactcgaatattcattcaagaaaaccacaatattcattcattcattaaacaaatgttgattgattactacaatgtgctagggactatgctagttcctggaatacagcattacataagataagcatgctccctgctctcattgagttacagtctgccaaaggagactgttaaaaaaatcacgtggttacataattactactgcaatcttagcctgcaaggcttacaaatcaagtgccgttttcattaaatcaggaagacaaagttattcaaaacatcaggctccatctgagagctgacttttcagttttatatattcatccatccctcaaacttttttgagtgccttttctgtaccaagccttgtgcttggcatcatggaaatgagaattggtactagaagttctcactcatgaccctgggcaggcccaggctgaggcacatctccccaccccctagctcagacccatcccttcctttccaactcagaagagcatgttgaaattcaggggaataaaaagacactatgatagagataaccatggatcatacactcccatttataagaaagggaaatcattctcaaactggggtttttcacttcttccaagtaatctcagcacagtggttgttaataacaattgggttagctatagtaagaaagtgtgtgtgtatgcatgtgtgtgtgtgcatgtgtgtgtgtgcgcgtgtgtgtgtcgtatgggcagggaggagaagtcaaagaggcaaagaaaagactgaggaccaagcctgaaatgccaaaggaatagcaacatcagacagaaaggcagagggcactggagatggggagcagcaaggcatgtcaaagtgcacaatgtggtactttcatcaaagtggagtaggacagcggttgtaagtcagatagacctgggctttactcctggctctgccacttgctgcatctctttggacaagtaaaataacttttgtgagcctcgatttctcacctctctgttgggactaacaacagtatgtacttctagggctgaggtgaggattaattaagaaagtacatgtgaagtgttcagtagcttggcacattgcactcattaaaaggtaactgctgttatcaccgttgttgcagttgtaacagcatcactgctgatgggcattcagggagctacgagtgtggagttaagatgtaggagaagggctgaagctggagctgtagacttggcagccagccgcacaagagggaggaaaagtgtgtccctagaagtggaggacagaccctggcatcccagcctagggaaggaaagaggtggagggaaagcggaggaaggaggtcgagctgcaggtatacacccacagaggacagtatgtcaagaaggcatagatgctgcaggagatggagtcagttggggcttagggaggcatctcttagagcaggtgatcaggaggtgagctgctatctggggcaagagcttccaggcagaagggatggcaagtgcaaaggtcctggtgaggtaagcaagggcctgaagtgttggagaaactgaatggaggctagtgctgcagggatggagtaagctgaggggacagtgggaggagctgcagccagagataaggagggtagggagggggacagtttggacaagacccgttgtccatctggggatggagagccattcattcttacacttcacttaacaagcatttcttatgtgcctactatgtgtctggcactatgctaggtactgaggatacagtgataagcaaaacagacatagtccctgccctctgcatgaagggtacagtgagaaagatgcacaatgatcagataatcacacaagttgacgtaacaacaaactgtcacaactacatggtctttcaagaggaatcatcaggggtgctgacctggtctgggggcttcggggaaggtttgcctatagaaataatatctagtctgagattagctaaataacatggagctaagcaggtgaagagggaagagatgttcttgactgaaaggatgccaggggcgaaggccctgaggggagaggaccagttggagttggaggccagaggtccggaatgcagagaaagggagaaggtgcaaggtggggccttgggggctgcagcaagaattggggtttttatcctaagaataatgtgaaaacattgaggagttttaatcggaattacaggtgttttggaaatgtccctctgacaatgtggaagatggagtggaggtgggagggtgagcagggcaggatggactcaggaagctactgtaagtccggatgagagatgacggcagcctgaactagggagaaaagggagagaagtggctgtgcttgggaagtaatttggaagcaaaatctgtaatatgtggtaaagggaaagagagactgtgtccaaaatagcgtatgcaaaactggatacttgcctaaagaaattgtaactgaattaatcaagtctttagaagcagacaggatagatgaatagattacatgacactacaagacagaactcaaccaaatcagagtgtaggacattccagggaacaaataccatgatgttgccaataaataaatggcacaaaataggggaaaaaaatatttaagaaatagaacaggacaatgttatatctttcatgcaatgtgtggaccttgtttggatcctgattcaaacaaactaaacatctttgggagaaatagaaaagtctgaatgcagactgggctgtagatgatattaaggaattactattcattcagttagataaactaatggcatggaggatttaaatgttgcatgcacattgtgtgcgtgtgtgtatacatgtacacatatgtatttaaaccttgccagtgagaaatgcacactaagtttttaggggttaaatgacatcttggatttgtttgaaacacttcagaaaagataaagtggaatataatatattaaactggcaaaaatgatgccaatttttgaagctgggtcatgggtgcttggaggtttattatactacctgtcttggggtatgtttgaaattcttgaaaataaaaaagtgatcaataaaaataaaatgatgaaaaatagagttcatactgaaatagaggacacaagaaaagaagcaggtccaagggggaaatcacaagttcaacttggagacctctgggccggaggtgcaaaagttaagtgcagacagtgaatctgcacagatgggaatttcgcagattcagtgaatctgtgggcctggataaactacccggggaaggaagaaagctttgtgagaagagagcccaggactagacatgaagaactgagaggcgtgatgaccaggcagagggcaggagttttgtgactggggaggagcagcagaaggagggatcacagaagccaagagaagtgagtgtttccaaaaggagggcgcaggtgacagaatcgaatgctgccaagatgtcaagcagatgagaaacatgacaagtccactgggtttagaatcatgcatgggggctgcttaggctgaggtcaggagcggggtgaggagggaatgggaggtgaaggaaatgagacaaagaattgggcagcactttgaagaagtctgtctgtgatgtgggagaaagggcagtggctcaaggagatagagtggaggaaataagaggtttgttgttgttgttgttgttgtttttaaggtgagacattcttaaatgcattaaaataatgagcaggactgggcatagtggctcacgcctgtaatcccagcgctttgggaggccaaggcgggcggatcacttgaggtcaggagttcgagaccagcctggccaacatggcgaaagcccatctctactaaaaagacaaaaaattagctaagcgtggtggtgtgtgtctgtaatcccagctactcaggaggctgaggcacgagagtcatttgaacctgggagccggaggttgcagtgagctgagattgtgccactgcactctagcctgggcaacagagcaagactgtctcctaaaaaaactgatgagcagaatgatgtagtagagaagaaaaagctgaatatacaggagaagggaccgtcggtaatgtagatttcctgagaaagcagcaggggatggcaagaggaaggatcgctcatggattctatcaggaaggaggaagagatgaaccagacaggtagctgagtgctgatgacgtccttcctttgtgtgtgtgtgtgtatgttttttttttttccctgagaagtaggaggtgattccacccgctggcagggaggagagagttggggaattggaggcgtaagggtcttgaagaaggttggagatagccatgagaaaggaaagagtcagtgaccagagagaaatggggttgcccagtggggtggaggttggtgattttgtgtctgacaggagacagtgggtgaaaggctgaaccagggcaggctaggtggtgttggtggaaggcaaggatggatggtcaatggggagatgtccctgtgtctggcacaaccaaggaggacttcgtggaggagaacgaacctaggcctgtgagcagatggctttgatagcaagggccagaaaatggtgcccggtgtcttctcaacttcaaattcccatcttattgcaacctactgccctgctcagtgcttcgcctctccagttccttcctgcctcctgttctaatatggtctttgactcttggaatctaatatggtttcaaggcccatatcagggttgtttgctaatttaaaaatatgctgttgcttcccagttcccaccaaatggcgagcagtttggtaagctgggtgggcaggcatggcagttatgttgcaaacagggttcctgcctgcctgggaggatcagacaggactgggctttctaaggcccacggcccactgtcttcacccctcacacaagctcttcaaaagcatgaaggagcatgttttccttgcatctaaatagttctggatgccaccaagccttgcagtggccatcagtgaccagcagagtacattctattcgtgcccttcccagacccaccggctctccacagggcttggactgttggcactgtctctgaggttgctattacaaatggcacctattggtagcagccaaaacatgattaggggaaataaaaccctctaggggcctgtgggaggagctaagcaacatgtgcagcacttaaaactcatcgtttctttttctagcttaactcaggtgattcgaaagtttgccaagcaactggatgagtggctaaaagtggctctccacgacctcccagaaaacttgcgaaacatcaagttcgaatgtaagtactgagttgagagcgggatggaagagagaattacattttagtgccaaatattttacataagttgttaatagtagcagcagctactgtttactggttgactataaagcaccaggtattatactaattactttacatatgtaaatatatttaatcctcataaaatgtttattataggtggcacatttcttcctttacagaagaggaatcaacttagagaggtagtaagtagcagagacaggattttctcccaggtctgtctgacaccaaagtttctgctcaccaccaccaccatcctccttatctcatttaatcctcatgctgcctctgcgatgtagaaagtagtatccctgttctacagatgaggctctaagaggcaaagagagttcccccaaagccacgcagccacacagctgtaagtaggggccaggaatcaaactcaggtctcagatttccttgaagttcctgcccataaaatggtggtagcaggagagagagaatagcttaagggcttcatgcattctctgcctaattagaaagccaaattaatatttctcataaagggattgagactgtgaaccttttctttgctgagtgttggcacccattccccagcattagttttctaattttctgtttcaatctgcctgtacttgcagggagactcatgtaccgttcgtttgctgctattaaacaaagatgaaatgattttcagcaaaacaaagttttaaaatatacattttttaaagccccatttgaatacaacggcttgctattcctgcccaaaataagtgccagtgaacaaaatgaaggcgatcaaattaccctctctccacaggcaaagggagccctttcagacgcgctttgaggctgcctgcagtggccatcacctattgataaagcctgctttatttcatggctctcagctcttttcttttcatgagcactaaattccacatcacaaagttaaagaaaaagtaattaaggagaaggattaacgattgatcagcctggaaaattagaagtccatctgccccctcccacccccattcctccactccacaccttatttttcaaatcaagccagctctgagtacaaattagaataatcctagggaaatttctgactattacttgaccagttcagaaattaccaagaagaatgcccccgcacccattttaattatgccgacaaaacaaacctgttcaaagtcggcggcaaggaggtttgttggaccttccacctgtgtgtgtctggaggaagctgttcttcccagggagcccagcctgggagtgtattttgagaatgtgcaaggggtggaaacaagtcccactgcaaccactctgtaagaatgaagagctagggcaggcacatgtcttgtctgcgttgaaatccacagatataagatcaccctacttcaaattatcagcctattatgtcagtgtaggaaacaagaccttttcctagctgcagtcatcatcaaaacatgcaaacaggtcatggagatcacttgataaaaaggacagattatgaatgcaaagccagggttccatcccagaagcacctcctagccccacacaccgctgaggctcaatcaaggtttactattagacatactactttttaaagggacttcttcaaagcttccacttgattcctgcaattatttacggggagaagtgattgagcttgcaattagcgaaatgaaagacaagtaaataattgcttttactcacggttgattgacgccaccatttctcacacctgcgagtgtatcgtgtgcatgactttgaaatatgtaccccaaatgtcaccattaggaagtagttgttgaagcccacatgggagaacaaagaatcaagtgcagggttttgccagtgggtacataaaatgggattgggcagtgagataaacgtaggcaaaataagcaggctactttttgaaatgtgcccctggaaaatccaagttagaatcataaagcatgcaaatatttcaaactaattcttttctccttgcagtgtcgagaaggttctcccaaattctgagacggcaaacatcactaaatcatctctgccaggtagctgtcctccattatgtgttttaatcactgctgagtcattgcaaatgagggggcaaatccacaaaaacaacctcctgcaggatctttcaggttaacagggcactctctctattattttttaatttctacagataaggaatgaaaacattagccaataactagtttcaactaatatacaaaataatttctggtatcagttgccccttaacctttcagatatgttctaagtccacagttctgtgtttctcttaattatccagcccaaaatgtatgtagtggttgaatcaaatgattcaaacagattaagaggatgatttgtttgttgtatcatctgagttcaaagccacataatatattcaatatttgcctaattttgtttagtttttttccagatctgcattatttttagcacaaaagtgacatatgcttgctttcaaaaacatttaaaaatataagtgtagtaagtaaaagtggaagatcccactccatgcccctatcaactctgtagttatagcttgatggcatataactacatttctattaattttgcactttaatgaagggactctaagtctgttaaggcaaccgattaacattacattaaaatattaatgaccttaaagcagaggtggcaaaccggtggccacaggccaaatctggccctcagatatgtggggttattgttgtttggtttgaatatgttcaaaacaatttttttcacatggtcactaacagttggaactgggagatgacagctaaacacccacatttttctgtagaaaaccttcaagggctgacaacttgctcccagagtcccatttccccagggcagctgtcagctgctgggccaagcttctccacagcagccaccgtcctcattccaccaactctctcacacttggcccacctcactcctgaatgtcacctgcctgcccccttcctgtgtttctgtttgcagcctctcctttaaggtgctgttggttctgggtgggttcaaggtcaaggtggtagggaggggtttctagttagagtggcctgaaggagggtcccagaccaggaaccagaaagtataacacaacacccacatatacctcactgctcctgtcctgcccctggcatggacagcacaggggatgatttggagaccagagggaaactcatccagattcatgcaggctgctacagaggctacacctgggcattgttctggtgatggtgcagagcctgacagattaatgggattcaggaaagaaggtgaatattggcctaacaaagaaacactgccttatttctgaggatgcatgccagcatctggttcttttttccagcttggaagagtggctcttgggtcatatcagggaactagacatggttttggtgcctccctctggggatcagacaatttagagaggactttgttcctttaatgcacatgtagataaaagcgtccacacccatgcctatagccacgtgttgcacaagcgtaggggcgcacacacacgttccctctccaccttccgcacaaaaacagtatgtaatttaatcagcaaatgccccatttccatctctaccggaaagctttcagacgcattcccagatcagacagaggactagggttaaggctgggaatgaaacaccagctagtatcccagtgagctttcccaaacacacatacacagcaagtcagactaaacaacgtccaactgaagactcacctcaaatacttagacctaagattcacgtccaggctctttcagatacaccaggtaagtaagcacttggcattcctatctcagccattcacttcacagaatcttttgggtgcctactgtgtgcccaatactgtgcttagtggtacttgccctcagcaggaaaaaaaattaaaagtgttaaatgttatgaaagaaacagaatggaaatagaaaatcacaaggcattcaggtcctatgtagataaagtggtcagagatggcctttccatgggtgtgacatttaagctggagcgtacattgtagtggggctgctggggcaaggagggagaataatgttccggccagcaagaacaccatgtgcaaaggccttgaggtatcaacacaatcactgaaagagaagcgatcggataacagtagccacttttattgagttccctgcactatgcactctgtttttcaaacactatctcaaggaatcctcaacagcagcccttctttaagaggtaagcactaaggccctaaacatgatggttagagacactattaaaaagcatgttctaggcagggtgcggtggctcaggccagcaatcccagcactttgggagacctaggtgggcagatcacttgagatcaggagttcaagaccagcctggccaatatgtcgaaaccctgtctctactaaaaatacaaaaaaattagctgggtgtggcagcatgcacctatagtcccagctactagggaggctgaggcaggagaatcacttgaacccgggaggcagaggttacagtgagccaagatcgccactgcattctagcctgggcaacaagagtgaaactccatctcaaaaaaaaaaaaaaaaaaaaaaagcatgttctaaacacttgcttacagaattcactctttggtaaacagttcatttcattgtaataaagtagctcacaacgcatctctgaaggaacatgctcaggaaagaaaaaaaaaaggtaggtactatcatatctccattttatagattaggaggctgaggttaatctacttgcctgccccaagtcagctgctcagcaacgaggccaggatttgaactaggttatgtttgaatccaggacacctgacctttccattcagttgttttcattatcattagagattcacctaactcatatattctacacctttgtgacctttaaagagttctacaattatttaactaagattttacttgtaattggatggtctgggtacaacaagggtttgtcagtatttacctttgcctagaaatttacatgcattaggagacttgacaatgtcttcgtgtattttaattttttttattttattaaaagacattttgaaaacatgcaaataaaggaaatgatcctagatacatatttttcttagcttttctcagtattgtttcaacttgatgatattgttccaagtattgttccaacttgcaaatttaagttcactaataagggttccatgaaaaagccacagctttaaagaaaaaaaaatacatatatataattattcacacactatacacatccctccatccactaacaaactactgagatgtatggta

SEQ ID NO: 17199 - DNA, 45540 bp, Human
  misc_feature (1)...(45540): n = A,T,C or G
atcttttttgttctttagatctctcagtatattcctgtgcccaagccaggctgtttttattactgtggctttacaatatgttttgatagctggtgggcaaatctgtattattttataatcaggaaaactcacaaaggagtgtgtgtgtgtgtctgtgtgtgtgtgtgttcttgcatgtggaaggtggatgaggaaatgcctttgaatgactaggtctactttggaagctgcaaaggagtttgacacagtgcctggagcagagtttccagaaaagcttggaaaaataaaaggagaattggagactacagggctctcaaaggaggctgatgctcacacttacaaggtctgtaggttgatgcaagcagagaggaaagctggcatggactgatctctgttatttttatacactagcactaactgcctttcaaggcccattaggcctggaaaccttttcccagcccctgggaagtcactggggatgctaaggttagtcattcacccactggggctatctaactgagctcaggtccgggtgcactgccagcagctgtttgtgtacttacagccccctgggtgcagacggacccccagctgccagccatatgccttatgtttcattgtcccacagctttcaaagaaaacaagtcttttaattcagcaagtattcactgaatgtctgacacccccagtgcagaccctgtcccaatcccccaatgggtccacctctatccaactctgggtgaatgaccatggtgctcttgcgcgcgggcacacacacacacacacacacacacacacacacacacacacaggcacacacacataactcaggcttggggcccacctctctgggctcagaggtatcaaagcaggggcattcctatcttaaggacttcttgtcttaggggctttggccccacctgcacaggacagaaaattagtggatttctaggagaaagcaggctatggcagggtatagccagggactcagctcttccttccagacatgcaggaaccataaggagggatggtcaaacagggcctgcttaggcctcttgctgggatcactccaagggtctctggggtcactcagaggagccgggaggctgcctgctgctgtacactgagacagactcctggggtgtttggatcacggcagcccacatgctgcctttttgttatcttttctgttttgcctcttccgggctgtacttgtcttgagtttttggccttatgacatccatattaaatggggtagggcagagcattgctcagtaaacagcaagaatggccctgggcatggccaaggcagttctgctaagtgtgaaagggaatgtgcctgccatactttgtgctttaggcccaagtgacctaggggccagcctgcctactggcctcactcccaacattacaggtgtttgactctactccaccccgtggagagacggagcacaggagccacccaccggggaccacataaggtcatgcacacccacagagtgcccagtccctgcctggccttgtccccattttccctccacctagggttggggtgacaatggaggtaactagaagacagatcaaaaggttcttggtcttgacacagatgcaagaaggaggcagataatagacacctcccttccccctcgcccacataggctccggtgggttctcagggcaaggcctggctccctcctctccgacttcaggtacaggtgagtgtggagggaactgaaagaggaaaggtgaagtgctgtttggcttcgacctggagggggacagaaggctctctgggcaggcagggccggtcttttggcaagaggcgcgctctctctcccttccccttccatcgagggctgggtgtgaaggtgagagcaatcagaaaagaaggtgaagaggtacttggccttgacacggacggggggggcggtccaggccgaggccgccccgcccccgccccgctatacccggcgccgcctcccggcgtctgagctgacacctccttagcgctggccgcgggccgcctctgcggcagcgctagtcgccttctccgaatcggctccgcacaggtaagatcaggggacccggcgcctgagctgccgaggaaggagtcgggggtgctgcgtgagactgagagttgggaggcaaagaaacaaaatcggatttcctcagagggccagaggaagagactgaaacacggtagccccaaatccttgggcggctgggaggtggtccctgtcatgcccacgacgggtgggcgcgtctttaccgacagcctgcatggatccgcagatgtgctgggcgcttagatgcctgcggctatgcagagacgcagtccagagaggtgaccccagatcctggtgggggctggatcccagggccccgacatccctttgcaatttccagccagcagctaaagactcccttcccggggctttagagaggctccaggctcgcgatccatgaacacacaaaaaccttccttgctcatgttctgaaaaaaagccccgcctcagctttgtgaatgttaataatagggggaagatttgttctctcttgggtgtgtgtacaggtggaacaatctgcagaaaaagaccttttttcggaaaaccttttcagtttgaagtttcagcaaatccatttttcatttccttgcatttggggagatgacatgaaatttaagctccagctttggggctgtctctgaagttctggggttcggcttacctttcccgggatgaggttttgatttggaggaagtaaaatgggttttgtcttaacctgggctcgttctttaaacttgtgaggccggggcggtggacttactgacatcctgtattctctcacctgcagctaggagaaaagatgttcactgtgctgacccgccaaccatgtgagcaagcaggttagtatctctcagcaggtagcaagcgtggttttgccaaatcgcaagagaaccccagcttcggcctacagtttttcatccatatcccctgcaaatgattgtttaactttattggtttgagactcagtactcagctgggtttcaacaccggcattcctcaaataaaagtaatgcttttcatcaaagccacacaaaacaaggactaacatgcatgtttcacttaaatggtttttccggtttgtataatccattaatttggcccttgtggtttcccttagctagctgtgtgtaacgtttgctttagaatactgtattgttgattttgtgatcaattgtacagtacttggatctttcctgtattcccatccaaatgttgctggcacagtgcctacaacacccccacccctcactgtgagtcagtgttgttatggttgatactgcaggcacaagtgcaggattttctcacactggaaggcacacacacacagacacacacacacacacacacacacacacacacacacacacttctaagcttgccccgcctgcctctagagcactttttggagttgctcatgtggaagcccagaaggctctggcttctccaagctcaggtaggtaccttgcaattaccatgtttgtccagccctaatgacagcacagctctaggctgcatttcctaaatgagtaagacctggtctcatccattttgctttgtaataagcttttctgcaaggacaagagtttgcttaaggtaatcatagctttttacttgaaaactgctgaaacacagaagacttaggaggccagccacgtagctgtggtcaggaaactgcatacatatcacacactcctcccccatggatagacattctttagtcatgcccctaaattgggtattcttgtcttccaaaaggatatgattttaggatagtaagggcaatctatatgaacttttatttttgtaaagggacattgcacttgaggagctgttttcctttgatctttaggttttcccccaaaacactttgaaatgttaacacagattgtaacgtcactcatacagactaacctgttacattccttccaaaggacaagtttaacttggcagattaaatttctaccccattttgttagagggaaaaaatcccttaaacttctataactaacactgacaaatgcattctttgaaagctaatgcaaaagtttgcctctgtggattaactggttcctgtacttttatttggaatcacagaaaagtgatacaggacctctttacatgctctgcaggtcaactccatggcagttggctctcctttccattgctattacccacaattctgtaatgagtaaccttgtgtctaagtcattttacacatgtggagctagttctgtgggataacttcccaaaagagtgattgtgagtcagatggcatgcttatttgcagttttcataaatattgacaagttgccctccattgatgctgtaccagtttacactttcaatgacaaggtaggaggattaaggtgttaagtgaccaactttgacaccaagaagtgtctgtgactgcagctacactgcaggggaatcagttgagatggaaagagttagctgttctgagccatgaagacctactgcgtgactgccctcctgtagcaaatgttgtgatgtgactgaatttgggggctgaatctaattatatcgtgggcgcatagacatgccctgttattcttctgggaaaatggcttacagaaataatggaggggtaaagcataggttataatgatctaggaataatgttctggaataagacaggatctatccaattgctgttcaattgatcttcctataatgatgaaaatgttatatggctgcactgtccaatatagtagccactagcccacatgtggttattgaacactggaaatgtggctagtaagattgagagactgcatttttttattttaattaatttacatttagatagccaattgattagatatatattggaattcgatgaatctagtgatctttctattagtgttcatcatatttcaaccatttggttgtcatttatgttgatgtcccaatagttttaccaagactattattattatttttttagagacaaggtctcactctgtcaccaggctggagtatagcggcacagctcactgcagccttgagctcctgggatcaaaggatcctccaacttcaacctcctgagtagcttgggctacaggtgtgcaccacatgtacagttgatttttttcattttttgtagagacggggtctcactatgtggctcaggctggcatctaacgcctggcctcaagcatcttcccatctcagcctcccaaagctgggattacaggcataagccactatacccagcccaagattattatttagtcagtattttcattgaatgtctttttatctttttaaaaaattaggtataacttctattcagtgaaatggatagatcttaagtcgtgcccctaagttgggtgttcttgccttctaaaagtatgtttttagaatagtaagggcaatttataagtttataatgtttttttaaaaggaaattatacctaagacactgatttgctttcattttcaagttttctccaaaggactttgaaaggtttgatgagttttgacaaatgcacacatccatatactccacactctgtatagcgcattgccattaccccaagaaagtgcccacatattccttctcagtgaatccctgccccaacttctgccccctggcaatcactattctgattcctgttaccttcctacttttgaacttcaaataaatgaaatcatttcagtatagtatagtactaatttttttatttttattttattttattgagacaaggtcttattctgtcacccaggctggtgtgtagtagtttgatctcaactcattgcaacctccacctcctggcttcaagcaattctcccacctcagtctcccgagtagctgggactacaggcgcatatgatcacacctggctaatttttgtatttcttggtagagacatggtttcaccatattggccaggctggtcttgaactcctgacctcaagtgatccacccacttcggcctcccaaagtgctgggattacaggggtcagccatctgcccagcctaatttctttttctttaactgagattatttttaaatgaaatattctatgagattatttttaagtgaaatattctatcacctggtttaattttttaaaaatagattttttgaatctccattaaaactaatgttagctgggcgtggtggctcacacctgtaatcccagcactttgggagaccgagacaggcagatcacttgagcccaggagttcgagaccagcctggccaacatggtgaaaccctgtctctattaaaaatacaaaaattggctgccgtggtagcaggcacctgtaatctcagctattcaggaggcagaggcagaagaatcgcttgaacctgggagttggaagctgcagtgagccaagatcacggcacagcactctaacctgggcgatagagtgagactccatctcaaaaaaaaaaaaaaagaaaagaaaaagaaaaaagtaaaacaaatgttattgtaattcatctcagggataaccaaaatatcagaaaactagaccatgcataccctccctgcaacactgttttagtacacaatttgtgaggaagggcaaataggtattgtttgtgcttccccaaaactggggagaaggggagcttatttgctactccatcttagaagtgtgggtctcgctaacaccagagaaggtggtttatgcacctgattatggggccagtccatcaattctacaaagaataccagtgcctggtttttacctccccctcaagtgtcttctgggtcttctcattttaggcctcaaggccctctaccgaactccaaccatcattgccttggtggtcttgcttgtgagtattgtggtacttgtgagtatcactgtcatccagatccacaagcaagaggtcctccctccaggactgaaggtaagtgtgaagggactggcaacaaagggaagaaatgagcataaaggggaagaaatcaattattccaaaaccatgagttagaagagcagaaaatcctttccccccatctctggctgaagccaggagaagttagtgtaagacgcaagggagaaggtctggacatgctgggtttgtgatatttgaggctacaaattgagggtagtgactgacaccttctccaaggactgtgtagtcttgctttgacttctgacttcaaagctaaaatttgtaaccaagagttgcagatagctatcaaagatttaccagttcagccaggtgcggtggctcacgcctgtaaggcactttgggaggctgaggcaggtggattgcttgagtccacgagttcgagactagcttgggcaacatggtgaaacccatctctatcaaaaaaaaaaaaaaaaaatttaccggttagtgcactttccattttgaccagtttatctgttctcccaaccacacaaccctgataatgagtaaagaccgaggctgagcacagtggctcatgtctgtaattccagcacttcgagaggccgaggaagaaggattgcttgagcccaggagttcaagaccaacctgggcaatatagagagactccatctctaccaaaaagaaatttttccaaaaaaaggaaaaaagaagtcaagaccaggagacccaggcacctcttctagcctaggctgagtgaacaaaaaatcaagaacttgagaaggtctccttgagctctatttgtgctgctactcttgagtctagaacatgtgctgtgttccttccaacacttccctcaacaacacccccccggcaaaaaaaaaaaaaaaattactcaggaccttgtgcttagtcccagaggcccctcttagttctcaacaagtccatccccaaatgatctttaggctcagaatcataatatatccccaggcttggctctgagggtgcccttggagacaggaggtgattccatgagaggctgacaagggaaagatgaagcaagttgatgagtccttcaatcattttgggtaggggtcagcaaacatttctcataaagggtcaaatagtatatattttaggctttgaggtccatttatagtctctgttttataactcttctttgttttttgactcattaagaatgtacaaacccttcttagctgtgccatagggaccaggtaattcagccatgttctttgaatctcatttaacatttacacttgacctcacaagtcttttccatatcttcctgctgttagtgactattcaaaggtaatatttgaaatacatagacatttttaaaagaaaagaaactaatattgttttggactctaaggatgggtttgagctaacattctaaggcagcttttctaaaagattagagtaaaatctccattagataatataatagcatttggttccttgataggatattttatttaagaatctcagccctcatgaataatgtgaattaaaaattaaaaaaaaaccttatgcaatcacccaataatgagaagaaagcaaattacccagttgtccaaagatattagctgaggcctaaaagaaggtgttttcccaagctccaggcactgccttctacaaactactgtatataaaattgggactttgggaggccgaggcgggcggatcacgaggtcaggagattgagaccgtcctggctaacgtggtgaaaccccatctctactaaaaatacaaaaaattagctgggcgtggtggtgggcgcctgtagtcccagctagctactcaggaggctgaggcaggagaatggcgtgaacccgggaggtggaggttgcagtgagctgagatagtgccaactgcattccagcctgggcaacagagcgagactctgtctcaaaaaaaaaaaaaaaaaaaaaaaaaaggaactgcaactaagagtaatatattttttattttttattttattgttattattttgtgagacggagtcgtgctccgtcacctaggctggaatgcagtggcatgatcttggctcgccccaacctctgcctccacagttcaagtgattctactgcctcagcctcccaagtagctaggatcacaggtgcccaccaccatgcccagctaattttttcttgctgtatttttagtacagatagggtttcaccgtgttgaccaggctagtcttgaactcctgacctcaggtgatccacccacctcagcctcccagagtggtgggattataagcatgagccaccgtgcccagccgcaactaagagtaatatctctttacactttgtatagtgctattcagttaagtcagcgcttttccctcattacatcacttagttcttatgccaaccatagaaggtggacaaagcgagcaccatgactgccattttgaaagtgagaaaatacaggtttggtcagtgaatgacaggtccagaactgaaacctggtcccttctgttcccaaggccagggctctcttcactgcctcccacttctccctgaccctgagttctgaatggagatcccaaatggagggaagggattggcctcagataagagaacacttcctgctttgcacaggatggaaaggtagggaggatgcatgcagatgtgggaaggtttgttgaattgaaggagaggagttaagcctagtaccacccttagaccctgatagctgggctgcctgccctgggccccacatttcagaaggaccagctctagttgcacttcaggcttatctctctctatgacccaaacgaatgtgtttacccagagcccatgtttccccttctagaacacactgtggtgcccaagacttcagaatctagggtcttcgtggacctccagaaggtggacatcaccaatggtctgaggggtggccaagaggcagctgcttacagggagtgtaaacagagcatagctgtgtggtctgaactgtccacacacaggtgcatgggctctttattctgtgagaacaggtttgggaaagggacagggcagaagcctctattcataaaattttgtctctaatcctacaaatgttagaaatgggctggttaaggcagttgccagctgatggcttctacttgttctggacagtaacaggcaagtcctctgttcaaaatggagagacatggaggaatcagatggaagactagtaaaatgagtagataaaaatagatccctgggcagtctagagggcactgttgaaggagaaaaccacacatgttgaatgctactgtcttaggttgggctctccaagtcaaagacatacgtgcaagtagatcatctggggatgatcccaggaaacactggtgagggactagggaactgagatgggtcaggcagccaagagagggcctgctatgcagcaggtcggcactgtgggcaactgggactcagtcctgcttgagaccctgtgagctggtacagagaactcaaagttgtcccatatcaaggggcatacaggcatgtgcctcccagatatcccagtcaagggcatatttattcaccagcttccatcagtcattagctgagaggctgctccctggatgttaactctctagtccttctggcatattttgtgatcaggtagactcgggccactagttaagccttcaggcaggtggaagatggatagttctacatcacagtagtaaggcctgaggggatgtgggcagagaattgtcagtgactactccatgtaaataatattgttattatccctgtattgcagatgagaaaacaggaaaagaaagggcaaatagcttcccatagttacacagattgaaaatagcagaactggtgtaaaggaaagaaaagagaacagacaacagtggccttaaacaagggtttggaggaaccaggagacacaccctccaccaatcagcaggcagttcaaagaggggattttaaatctcttctgaatcttggtaacagaccctagccaccattgcaagggacaggaaattgtaaaacacaggaagatgagctcggaaggtccattctgcttaattgggtggattaaatgtgagaaaagacagatgttctgggccagttgaaccagaaacggaatgacagctttggaagagagtgttccacatgcagtttttctcaggatatggagagatctctctttttttgttttgaagaggattgcaggtgatgaagttgagcaaatatgagggattttaaattatttgttatgtttatttttttataccatgagccctgttttgctttcgtgtgcagctgacagttggttctaaagggccagctctacaacagcctgtctggagggctctgaaatgttacagaggactctcatgcaaggtcgtatctggctattaaatctaaccttggcttgcctaaccctggtttatgtgaggttatggtcagaactattaaaatgcagtcaaggggcgaaaatgtctgagtctcttgtgttactggtctgacttgctccacaagcttgaagagtaaacatgatgccatcacttgtaattttcactcggcccccagtcccccgctttatcatcatgaagtccaataccttcctcttgaggcttcaccctccctacccctaatcataaccatccaagaactttagagcttctcagtccaatgatcaatactattgtactgcctcttgcagccatgtgatgtcactgttgaagatgggttctgcacagtctaaaggttttaaggatgggcttttccactgtgacctgctcagcccacattagttccccatactgggtccaagatcataagccattttagtctacactcccatgctcagccattactctccaaagcaaaaccactggcccagtctgtgttgaaatcattcccttttaaccctcattgagccttgctcatcagcctggatttctggtgccttgtagcccaccctggtctacttcttggagagtaagagttggataattagtttctttttttttttttttttttttttcagaaagcctcggtctccttatgcaaatgggtcctctcctccagccagatctgcacaccccttaactaagactttactttcaagggactttttgtttaaataagaaagtctgcaatgcacctgattactgaacagtcatgccattacacttggtttccttggagctcagtgaaaacatcatggctatgattactgaacagtcatgccattacacttggtttccttggagctcagtgaaaacatcatggctatgagtacaggttttagagtccgttagactcaggcttgatcccaggtctgtgatcttgggcatttacttactactgtaagcctcggtttgcccatgtgtcgaatggtatgatatgatatgatatgatatgataacatatgtcttatacaggcaataacacaaagcactttctgcagtgcctagaataagtgcaggacaaggcttattactactactatttattatcatagtaataatgataataataataaacaaatctaagaaagttgaccttatgcttctgctttcgctattgctttagacagatcacacaatccttaagtgttggaccaaggagactggccctttcagttaacattaattgcattcactgttagatacagagtaatttaaccagtttccttattctatacatttctaaactgaaagactgcttcctttcagttaatccactgtgtcttcagatccacatttgagccatggttttttctgacactgcattagacagaggattacttactactttttatccgaacatcaccttgccagctgaactgaaattcattcccatcccctctcccccaaaagaatcacactgagtttcactgtttaggcaaaagagctctgaaaactggttaaagaccatttttcccacttttgaaaatgtcagtgaatgatggtagggctagatccgtgtgagtcggtagaggtgggcctatatcagcaggtgccggagggacagccatttctccagtctcacagagcaaagtctggctgctgcagaccctggtgaaagctggatcccagttggagttacaaatgagaatggatactcttctctctgatcttggcccagcagccctgagcttcagaaacacaggaaaaacatgcaccctttttgaagggttggaataaagatttgaggaaaggaaggtgacagtttttctcctattctctctctcctcttgttttatggttcagcaccaggcgtggcagggcgggctggagtggtggtgatcaggtcaggagcaggggggaggaaagaaagcagaccaagaatatagaggcctggacctctttagtttagtgcctggtttccttcttgccttcagtttcaacctgtactttaatctccctgtgagtcgctgcctgtgacagattatgaacaatgccacccttgttccccatgagggatgtcaggtcaggatcctgatcaacattcatcatactgaagggctgagattaagaggctgtccaagttcacataccagtgaacacagatgttctatttcaaaataatggagaggctatgattcaggagctggagcaactttttaaaaatatggtcccatttcaaacaaaacaagcatttgtaatatagataataaaaagttggaaacctcctaaatgtataggatcaggaaattggttaaattactctgtacctaaaagtgaatacaatgaatgtatgaaaatggtgatatcaatctgtttctactgtcaggaagacatgttcatgatatacttttaagaaaagagcattgcatggccagatgcggtagctcatccctgtaataccagcagcattttgggaggcggaggtgggtgaatcacttgagcccaggagttcgagaccaggctgggaaacatggcgaaaccctgtctttacaaaaaatataaaaattagccaggtgtgatggtgcacacctgtaatcccagctactcgaaaagctggggctgagaatcgattgagcctgagaagttgaggctgcagtgagtcgttggtggcaccactgcatatatacaatgatatatgtatatatccagatacatatatacatatattgttagaaaagatacaacaagggctaacgcaatagttggatttgagggatgctttgttttcttttctgtttttcttgttttgtgattttatttgtttcttttgcttgactggcttttctatatatgctaatagcctgtatttacgagtagccattaagcattaggcatatagccttctatttacttctgcaagtaagtcctctaaagatgagggaacccagaaaggttaggcaacttacccagtccagcatcataaaatcgagaatccatctgagtcagcttgcctccagacccaacttcatcatcttctgtgggacaggctaggttaacccaaaggtggtgcggtgggagacttcaggccaccctgaaggcctctggatgccctaggatgactctgagcacaaacagatacggggcttaggtatgcattgctaattccaaattctataggctactaatacatgctctttcctggtcaggtttggtccagagcctgggctgggccaaacctgcaggtgaaactttctagtgcctgctcaagttggacaaattggtccaggactctcagcctactctcctgcacacagccagccccagcactgcccagcaacacctgcctcttcatttgttgacatacacattgccaaagtgtgatcaatatgtcaatattatttttttattttgctttttttctccttaattatgaatactttaattctgagcactgatacaggtattaacatgcctcagccgggcacggtggctcacgcctgtaatcccagcactttgggaggccgaggcgggtggatcacttgaggtcgggagtttgagaccagcctgcccaacatggtgaaaccttatctctactaaaaacacaaaaatccatcacatggcggccgtcgagcatgctaatcagaggtttccaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagttgtatgcaagatcatcatgaagtacaattctcaaccttggctgagtgttggactcacctggggcttttaaaacctgttgatgcctgaggtccactctcagagattctgatttaattggtatggggtgtagacttggcattgggggattttttaagctctccaggtgattctaatgcattgcaaagtgataattatttcctagaacctgccctacctttcctcattcccttccctcacaatccaaggagacaaaattggtttggagaaaataatttttcttattgattagcccttccctaagcgaagcagtgtggattaaggtactcagggttctcagtggcccactgagaaagcagtcctcagaggagtcccgcccattctgactctccctttccctttttattcagtatggtattgtgctggatgccgggtcttcaagaaccacagtctacgtgtatcaatggccagcagaaaaagagaataataccggagtggtcagtcaaaccttcaaatgtagtgtgaaaggtaaggactgaagtgtgtctgggagtcacaatgggcagcaaggtagagttctaagtgttttggaggcctggagaggtcctgagatgttgcttggaggcagggaatgagcattggactgggagtcaggaaataggagatcgtgtgctagtgctgctactcatcagtggaataaacttgctctagtcacttcccttctctgggcctcagtgttttatctgtatacatggaaaggggtggcgtcaagaactgtgaatggtctgagattttaccctgccatattttcatgggtgctggaagacacaagactcctgggtcagaaataaaggacaatttgttactcacaggagtagcccagagtatcagcattttcttatactggttctgattcccaatttgcccaggatgatggaaagacggacagatagtatgcactcatgcaataggttctgtcataggaaaggaaatctgggattttagggaagcatttataatgggcagtgagcatgcctgccttttgctgtggagggaaacacaagggacacatggatagctgtcttccagcagtgataaggagtagtcctgtgtattgatggcgaggcagacagagaatgacaatatgtaaacaaatggacatggctctgttccagtaaagctttatttatggacactgaaattttgaatttcatataattctcatatcatgaaatgtaattcttcctgtaaattttttcccaccattaaaaaatgtaaaaactctcttagctcacaggctgtacaaaaaaaaggtggtatactggatttggcccatggggtgccaacccctgaaatggagtattatcagcaatgataattaatgatccgccatgcagctccctgtcttttccacaacatattctgagttttatattaactgtttccttgttctttatagttttgtcttatgtatgtagtgtttctgttttttaaaacaaaattaaacatgtatttatataaatggaatcaacatattttatgccgtatttgctttgttcactaacaacattgggtttttaagattcatctgcactgatatgagtaactatcttgttcatttcctttcctttttttttttcttttttttttttttttttttgagacagagtctcactctgttgcccaggctggagtgcagtggcataatcttggctcactgcaatctctgcctcctgggttcaagcgattctcctgcctccacctcccaagtagccgggattacaggtgcctgccaccacgcctggctaatttttgtatttttagtatagatggggtttcaccatgttggccaggctggcttcgaactcctgacctcaagtgatccacctgcctcggcctcccaaagtgctgggattacaggtgtgagccaccgtgctcggcctcatttttccttgttgatgggcatttgtattttcttggttattaataaaacttaatatctttccatatatttataggcatttctgttttctgtgaaatgcatgttcatgtcttttgttcatttttctattgaattgttgaatttttcttactaattcattgaaattctttataaatattctaaatatgaattctttgccattattattatcatattattgctaataccgtctcacagtttgtagtttgtctttttagtttctttgcgatgtgtcttgatgaaaagaagttcttgattcttatgtaaatacaaccatcaatattcctttttgtggcttgctcttttgtatgttttatttaagaaatccttttctatcttgaggtcatacagacctttttctatgaaaagtgttataattttgccttttacaattaagtaattagtccaagtaattgagcctagttagggagtgtgtatatgtgtaagcctttttcaaagccacttatcttcctcgttcgagcattaggatcttcagttggcctgtagcctcccaaccagggtgttctgaatgtgcccagtgtatccttgagcccacaggacaacaggttagagactccagacctgtcctcccagcccgagcagcctcctttgtttccctccgtgagctgccaaaacattgtaagttcatggggatcatggcattgaaaaacttggaaagcagagttagtctttctcaccgggagaccaagagtcttctttggctaatcagagtgaattctgatcatctgccctccgaggagggcagccaggagcttgcctaccctgatgcacaggtgttccaggttaggctctccagaagcagatgtagagacagattatggagtgcaaggtggttattagagatgcactattatagcagaaagtgggcagagagaagtactggacaaaaaaagagaagtcaaacttcaactcaggcctgatgaagcttcagctgatccgttatgctgcactgggttgaaatggtgtaaagtggcttggctgtaataccccctgttgctgccactctgggatgtttgccaccctggaaagagcaagatcttgagcaaggcagctctctgcagctcaggcagaccctgaagaagctgacagctgggacaataagtctatttgaaggggtatattgcacggcacggttttggattcaccacataagggacttggatattttcctttaatttttttttttttttttgagatagggtctcattctgtctcccaggctggagtgcagtggcacaatcatggctcgctgcagcctagacttcctgggttcaagcagtcttcctatctcagcctcctgagtagctgggactacagacattgccaccacatctggctaattttattttttgtagagatggggtctcactatgttgcccaggctggtcttgaacttctgggctcaagccatcctcctgcctcagcctcccaaagtgctgagattacaggtgtgagccactgcacccagcggatattttctgagtattgcttgcttgttatccacaagatgcaggcagctgtagccttgctctgacctcaaccagcgatcctctatctgctcaggtaatgcctgagccatttcctcaccttcaaccatgaaatagggcagcaggctgctcctttcaaagacagagactatgtgctccaaggaaagagaagatagtgtaggatcgagattgagacttcacctcatccctactgtgtgaaccctggaaagttatctaacctgagtcttgacttcctcatctctaaagtaaaaaacataataatagttatacctaccctacaggagtgatttgaagactaaatgacataatgttgtaaaagaaatgcctggcatacagtaagtgctcaataagcattaactgttattcatggggcaccacaatcagagctcctggtggatcctcttgccacttgttactctgtcccacagttacaagatctctgtctttagacccaggagggcaattcaaccaagttagtcctgatggccttacaactgtggggaaaaataagacttacatggggaggtgttatggcagtccctcaggggaagggttccttggcccaccctggatggcatatgtgatttgaggaggcacagagtcatggaggccacagcatatccataaatggatcttcccttctttgatcacagtagcctcagggatctatatatactctgaatgaacagaagaccacaaactaaagctcaaattacagagttgaaggtcagcaagtgtcatcccctcaaaggcttgtggcttctccaaggataatttgggtttctgcttcctccattgcaaacttcccaggactcccctgtcttggccaaacagaagggggtgatgaatgcttgctcacccagcagggattcccagatgcctaggccctcagaaatttctttctggttggtatcaacccccagttgctactgttttccatgagttcattgcctttgctggcggtttctgtgctggtgtctgtacctctggctgcttgtggtgaagccacctcctggaggtgctgggttctctgcatgcgtctcatctcatctgcagtactcatgcctgctgctgcctttccccacaagggacattcataatgtctttcctttaaaccagtgactaaaaattacttaagctccactagagcctaaacttaactatctcctccattaaaatccctcaaagagttgcatcagaaaccaggccaccatagtattaaaaaaacatcctttgcctctgggtgcagtggctcatgcctgtaatcccagcactttgggaggtgaggcgggtggatcacctgaggcaaagagtttgagaccagcctggccaacatgatgaaactccatctctactaagaatacaaaaattagccgggcttggtggtgggcgcctataatcccagcttctcgggaggctgaggcaggagaattgcttgaacccagaaggcagaagttgcagtgagtggaaatcatgccactgcactccagcctgggtgacagagcgagacttcatttcaaaaaaaaaaaatcatttgccaatagttggccggagctcaagctgaggtgcgtgtctttggcttctgtttcccctcaagtaagttttgtgccgtctgtttaaccctctctccccatattgaaatagcaatttcagtgctcctctcatgggaccaagtatccaagtccaagcagcttagaagcctgtgaatcctatctccttttccctctagaaggcttaatggaccttatgcaaacaggctgtctggtgacatactcccaaggtttcaccattctatctcgcctctcaccagccgctaaccagagaccagctccttgcagattatattttgtttatcccagattggactagccaatctccttactacagagatgtatagtggtttgaaagtctcattgattgattgatttaataaatatgtattaggtgcctgctgtttgatacgaactgttcttggcaccaggaattcagaaataaacaatatatacaaaatctgtggttatgtgttatgagacttgcattccaatgaggaagatagacaaaaaaataaacgggcatataacgagtgtcaggcagacatgatgtgaagagaaatcaggcagggcaggaaaaagagagtgatcatgctgttttgaacaggattgtcagggaagtatgaagaatatgacagctaggcagagacaaaagtgatatgagacaatgggccatgtaaatgtgtgggggaagaacatgctgagcagaggcatggcaagggaaaaggccaagcatggaagctgctcagcattttccaggaaaagccaaggggccagtgtggctggaagaaagatgagaaatgagactgaagctagagccaaggcctgctccttggagggacttgaggtgtcctaagggtttgactgtgacacaaatgaagtttcttcaaagtatattgggaagccattagaagattctaactagggaactaatacgatatgacttctgtttttaacggatcactcagttgatatagaacacgtagtcaggggctaagattggaagcaaggacaccagttaagtgctgttaaatcagtacgggtgagagattaggtgatggtcaatttgcccttgactagtgcttctcaacacaaggtgaatttgtctcccgggaaacattttgcaatgtctggagatcttttcgattgtcatgactgggtccgtggtgctactagcatctagtgtatagaagacatttctcatctttcttccagccacactggccccttggcttttcctagaaaatgctgagcagcttccacacttggccttttcccttgccattctacaatgttctaagcattgtacaatgcacagaacagcctccacaacaaagaattatctaccccaaaatgtcagtagcaccaaggttaagaaaccttggtttacgatggttctggggaagggggtgagaagtgcttagatttgcgaggtattttgaaggtaggaccaacatgattttatgatggacttgatgtgaggcatctgagttcataatgcatgagcaagagtttggatatgagcaactgtgtgcatcacaacaccatttactgagattggggaacactgggagtggagcatattgggggcagggcaaagcttaaagagtttggttttgggcatattaagttggagatggctataaatcatctgagtcaggggaggcaaactttttctgtaaagagctacacgataaatattttagacttgtgggtcatatggtctctgtcgtaactgctcaactctgcccctttagcatgaaaacagccatagacaacaggtagatgaattagcatgtttgcatttcaaaaaaaaaaaactttacttgtggacactgacattttaatttcttataattttcatatgtcatgaaatgctgttcttcattttatttttttccaactacttgaaaatataaaaattattcttcacttgcaatccatacaaaaacaggtatggggtcaaatagcttgctcattcctgatctatacagtgatgtggagttgtcagataggcaagtcgggagttcgggggagggggaggatgaagaaataaagctgagtgtcatcagaatacagacgatatccagccccagctcatctaaggagtgaatagatactgaagaaaagagatctgaggacttagccttacacactccagtactgagaggttggggagaggaagaggatccagcaaaagaacttaggaggaatgacagccagtgaggggagaagaaggtcagaacccaaatccaaggtagttgaagaaagaggaagtgcgcaattaggtgaaaagtgatggggagcttataatctaagaagttagacagacatgatatgcccccagtgcggtgatgtacactaggaaaaacctagcacacctaggaagtgctcttgccaaaaaatcaaatctgaatctgatcacatttctagaaattaactcccagtttataaaaaacacagaagacaaaggaacatgttcaaggacacctcacggatccaatcagcgaaatccaaaataagagacctactccattaaaatgatttctttaataaataaatggcaagataaaaggggggcaggaaaactgttacagaatgagaatcttaaaaaacatccaaatgcacatacaaggtatggactttggtttctgcatcacactataaagaaaaagttattctgggaaatttgaacactgacaggtctttaataatattaagaacttttttaggagtgatttttttcttaggtatcatggttatatttttcagagttcttccctcttaaaaacatatactaaagtgtttgtagatgaattaacataatgcctgggattttctttacaataattcctagagatggaaaaaagaaagcatataaatgaaaataagatgggctgtgtattgattaactgttgaagctgaatgatcagtatatggggattcatttcactagtttcacagtaaagaattaagactaatgtgagcactgacctgtgatgttcagcatagttttgttgtttttgttggctttattggcattttggagagaaaaacctgttaactaacctatctcataggaatatgcctgagagcttaatctcacattttatttactgagagaattgtgtgtctttttaaaaataactttctaattacaaaataatatattttcattgtgtgaaaatcagaaaacacaggtaaataaaatggaaccaggcacaatggtgtgcacctatattcccagctactcaggaggctaaggcagaaggatcacttgagcctaggagtttgagaccagcctgggcaacatagcaagaccccatctttatttaaaagtagaaaaggaagtaagatcatccataatccttcccaccagaggggaacatttttctttttttaggattaatatatttttatattaaaaattattcatacaggctgggtgcagtggctcactcctgtaatcccagcactttgggaggccaagtggatcagctgaagtcaggagtttgagaccagcctggccaacatggtgaaaccccatctctactaaaaatacaaaattagccgggtctgttggtgcatacctgtagtcccagctactcgggaggctgaggcaggagaatcacttgaacctgggaggcggaggctgtagtgagccgagatcatgccattgcactccagcctggacaacaagagcaaaaactccgtctaaaaaaaaaattatatatacatacgtatataaacatatatatttatttaattgttgttattgttattagtgtttcttacagctacttcagttctgaactcctgagatcaagccactgagttcatcaagcccacggcttatggtgctgtcatttgtctgttgtaggaggtcattgccccaggagggaaaattacattagaggctctgtccttggccaaggttgagaaagcctgtccttgcttctctagcactgtcgatgaaatccacgtctgtgcatcttaatggacacatccaagcaaaacttgtaattacaatgctcaggtttttttattggtttgtggtagttggaagatgggtgggaaaggttaagaaagggcagctgaaggaggcagtggctctatcaattccaaagaaggaagtttccagagggaccatattctctccatcttccttgtctgtcctatactttgtcttccttaaagtagacttatttaaactcagagcctggactgggagaacaaattaagttatgttcatgcaatggcatgcaatgcaactgtaaaaagaaatgaagaatatttatatactgctatggagtggccactaggaagtattgttgaatgcaaagaaaaaaaaagtggagaaaagtatatatagtaaattaccatttatctaaaagttggggtgattaaaaatatatatttgcttattttaaacaaacattggttaaactttttttaaaaaagaaactacttacaggaagaggagacaaggagagaatctagatgtctctgaatatacctagttttgtagatctaattttagaactacttaattattttagtaactataaaacaaaatcgttttttaaaaagtaattcctaaaactcaaaagtaaaatgcaacaggccagtcatggtgtctcacacctgtaatcccagcactttgggaggctgaagcgggtggatcacttgaggccaggagttcgagaccagcctggccaacatggcaaaactctgtctctacaaaaaatacaaaaattagccaggcacggtggcacgtgcctgtaatcccagctacttcggaggctgaggcacaagaatcgcttgaatctggcagacagaggttgtagtgagccgagatcacaccaactgcactgcagtctgggtgacacagtgagactccatctcagaaaaaaaaaaaaaaagagaaaaagatatcactatttgcaacccctaatgaaataatggagctaaaccattatcattgatgataacagcacaaaaagagaaacaaccagatactgtgcctcctattgtaagtccacactaatccctatatattttttttaaatttcaaacctgatctgatcaagcctctacattcagttaaccatttatagaaatacaagggaccaagtaagatgttaattgaactatgagggtacaatcgacaaactctagactgtggaaattcttcaggacgaagaaattgcaagtaaaatttttaataattaggagaaaaatagaaagggaaggcagaactaatagacagaaagagacttaagattgcactgtaccgaatttattgggatcctgactcatacaaatgagaagagggtgatggatgaaggaagaaggagggatgaagaggaggagtaggaagagaaagagacacagaggatgagaatgagaacgaatatggaggcaatgggaaccatgactggatagttaatgatattaagaaattatttttttggcaaggcatggtggctcatgcctgtaatcccagcactgtgggaggtcgaggcaggtggatcacctgaggtcaggagttcgagaccagcctggacaacatggtgaaaccgtgtctctataaaaaaaccaaaaattagccaggcgtggtggtgcacgcctgtaattccagctactcatgaaactgaggcaggagaatcacttgaacctgggaggtggaggttgtagtgagccgagatcgtgccactgtactccaggctgggcgacagaacaagactctgtctcagaaaaaaaaaaaaagaaaaaaagaaaagaaaaagaaattatttttaatttgtacaggtataataattcaactgtagttagggctttttcaaagaatgtttactttttgtgacacatactgaaatatgggaattaaatgacacatctgcattttgctttgtgggaagcaagtggaagattgtatggatgaaataagagtcgatcattgttgaagctgggagatagatgcatgagtttcaatatactattctctctacttttatttatatttgaaatttttataatgaaaacatttttttaaagtaggccctggcttactttttatacaattgtaattcattcttttagaggttgcaagtatactgatcagtgtgaccatacgggacttaccacatccagctgttttcgaccccctaccaaaccccaataattttcaaagccaatttgttttttatttaaaagttgtatcactgcgattggttcctggaaatgctgacagatgctgactgcttgcttttcaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggtaaaggctaagtggcacaaaggagcccatttgaccaaaataaccaagaatatgttgaatcttgccaagaatgtaactctatttctgggaacaaccctcgccccccaaaaagaagcccacattctgccataaatttgggctttaaaggttgggaaacttttagtttttattttaatacccagaaagaaacagttctaaaattgtttccctctcccttggtgattttactgagaactttgaaaaagagagaggtcatatgaaatctgctcatgggatataactctagttctttgaaaagtagttgttttgacagttggcatttgacacctgtgaacaaccagctaagtttggtagtaagtacaacccatagctatgtagcttccgcttgtgtacaaaataccactgaaatctgctttaaaacaatggcatgtctgcacctcaaatcagtcaaagcttttggagttgttatgaaacaagcatctaatttcactcactcaaattagttccttctaaatttgtagtcatggcttttagcccagttgcattgtttttgaatgtcttttctcttttttctccattatagcatttccttgaccttgaaatttcaaaaaaaaattccaaaaagaaacaccaaacttaaatctactcagagtaaaggctactactccaagtgttggaataaggttttatcacaagaaaacaacactcattctgcttcagagccactttatctacgattccaagcacgcaaaattatctatgtctgagcattaataaaaaaagaacaaacagagctcctttaacatgataatgaaaagaaatcatgatgtgctctccattagactgggccttttccttatagtctcataattcttgtttctaatctgatttcctggttgaccacattgaatgtggaaggaagtcagatttctctgctcactcttggaatctgcagtgtatttccaaattatttcatttacgtgtaatagaaatgatctaaaaactccttccttttgctttttctttcttataaaaacagttcttccaaaaaggatggaactgaaaccatgtaatctcagagaacacagaaaggcagcccctttacaggctattaattccatggacctaaaatcctcatctgctatagtggatgcttccttaacacgacatgtgtggagctacttatagaaaagccagctgcaggatgtgctcatgaagttttcaatttggagactgaatgcttagagcttagtttgtgaaatccttctgctttcagtctattcaattcccattttcagactgaatttcctatttcagaatacattaggatgctgtttactctccctgggacttgacttcaggtaataagtttcagaacaggacctgagcaataccaacaatatgaatgtgataagtgactacaatcagggagaaatactggttcaattccattaaatgtctgtaaaagttactctaaaatatctttgctttaccagtagtgtttgtacatatgtaaacttcttggttgaactggctctgaacttatgacttaagtagacttctagtactctaaaaacaaaaacaaaacaaacaaacaaacaaaacagctcttaagaaactgactttttcttggttgcttcccctccctcccccagtctttcagtgagaaataattaaaaggctctgcaatttacagctcatgacaaaaaccatggaacagaaagctcacctcttaggaaaaaatgaatgtctcctttgaataaattaagtactaactctttcttgtaaaactgttttctaatgatgatctatttcttctgagaaactagctgatattttaattactagacaagtaaaatagaaaagaaaacaattaatgagaattagctgggatgagaattgatgaaactgggaaaactctgaattattttccaagcagtgataattggccacggaattggaatggatcctgcttatagccttgctctttcttcttcctgagccaagagtcagccagtgcccctggctttctacccatggatgaaagatgaaataatctcccaagtgagctttctttcatagggtaaaatggcagcagatggacgccataacattctgtcaccagggatagaatgctgtgttgccactcctctaagagtcagcacaccaatggtttttcaatccagtgacagccatgatgactgtcatatcccttcatgctgaagccctcccaaagagtgaagcaaaaacagctaaaaactcaatgttcttcctttcccccttcctactaagctccctttccgtctggtcagatgagggttccttcatatggtgcctccaagagattatttatgccactcttatgacttcatcaatcccctttcctctgctgatctaagacagagcaatggcagttaaataggaggctcttttgatacatgaacagatgagatgggtggggagaacaaattgtacttatgctgaaagcaattttcctgcttggcagtttgacaggtaacaagtgcatcctgccttcacagttgccccagaaggcttcaacttgcaaaagggattgtggtgtacagcacacatctggaaaatcattcatccccaccagcagggagacggtgaagtttgcattttcacctgagtgagactatgtattttaagactgtattgtctgggcactcagacttgtttgttctgtgccttgtacaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggaggtgtgtgcaaacaaatgcatggtttttaatcttactgtttatcctatcccctgtgagtgatagcctaagtagaggtacatgccatcagggatatctgccctgtatcactcctaccatgtaacgcattagggaaatacctatgagacaatagctaagaaagacatatatagctggggagaaaacatggtcataaacaggactaaatgctagggagggagggaatcttgtcactttactagcttgtaagaaattgaagggggtgggatctaaatttaacactaggctatgggtctttgggagggcagttgaagaataacccttcagagaggctccatgaccatctgaaatgtacaaagccctcaggaagtctgtatccctaagtccccagagacaggaggaggtcttcactctgtgttcccaggtctcctcacagtccaatccctgcactccctgctcccttggtgcagaggaaagttgactccaagagacaactgccatgttacagggggcacaaaacaggagttactcagagcatatccagcccaagacctattttgttcaccttcaaatgtattttaaatttttaaataattaccaacaattaacatttgggaaatttcacataaaaatccatacttctagcttcttctgacctcctcactcctcccaaaaatcggaggaactggtcacagtagactcacattcctgcacggtaacaggaacagagtgtaaatcatggactctccagtttgccacagacccaccagtccctattatacacctaatctacttcactcatttattacttacctatgttacctgcccagttcctgtaagcattttaattcaccacctctaaaagaaaaggaaagaattggcctcacatgctccctctgtcctacttcttagtaataggagacgaggcttgggtggagaactctgggcaaacagagatggtgcctttggctttctttctcacttccttttcccactgtgcagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcaggtacttgagtcgggggtagggggtggcaggtgttctcttgagggtttgagctgaggggagaatgccctgccttctggggtctgtcctctccacttcaattgaaaggtagatggaaataacagcattttccaatttactcctgggggtccaagtccctttcctctctgtctctttcttcccctccgtctccctctcatgttgcccacttccagtaaatttgagtaagaagtctagggaagttccagagcttcagttgttttgtaaatgactcaagacctggaatccctttatggacacaaactgttttaaaccaggagctaaataagcctgagaattttgagactcccctgggtgtagacaaaataatattagtggtcacaagagaaatgtgtgctgaagggggagagggcagagcccttcccaggctcagcctccttttagatgggtctatattaggcagacttgatacccttatatggcagaactttagagcaaccacattccatcatgttgatcagtaattcatttgataagtgttccagggcccagaaggctaattcaggcatcagctagaaagctattgctaatattaaactcaacattatgcagtgtgtgttcatgagggcactaactccacaggtgagaccccagacccaaacaccagtgctcaggggacatcaatcttagccatggctgggtggctgagaggatgggccttgactgcctagaggggtatgaggaaatcagaagccacagatcctggcttcttatgggactcaaaggcaggggaatcagcctatgaacaaaatggacacaacttcagtaggttaacccacgttcgtccaacctactctgataactgaagacaggaacagactctatcctgcagaggagttgaagggatcacaaaagtgcatcttcagcaggactcacaacttcagacccctgcatttacccagtgttcatgcagggtaggttgtgggaactcagcttccagttctggcccctcccccaaacatctccccaatcctcccagaaatggctgaggccccaggacacatgcatgggacatttattgtcaggagagtctgagcactgcctggaaaggacagatgtgagaaccctgcagacagccctcaactacccttctgtagtaatccatgctcacactactataaagaaatacctgaaactgggtaatttataaagaaaagaggtttgtttaattggttcatggttctgtgagctgtacaggtttctgcttctagggaggcttcaggaaacttaaaatcatagtagaaggcgaagcggaagcaagcccttcttacatgggggaataggaggaagagagagagtgaagcggaaggtgccatacaattttaaacaaccagatctcctgacaactcactcactatcatgagaacagcaagggggaaatccacccccatgccccaatcacctcccaccaggcccctcctccaacactgggattacaattttacatgagacaaagccaaaccatgtcaccttccatggctcccatcccaacttccacctccctgcccagtcagccaaaccaaaccctacaggtaactcaatcaaccctccctatcaggggatctcaatactcaccactcatccccacttgctcatcaaagtagttcaaccaacatgcttctttctttctgggagagaagctctggaaaatcctcttttctccagctccttttacctctagcaatgcctaatgtcctttgctccagctctgaccctagcaggggtagaatgtggaggctcaggtgaaatcctcctttttccagggtgagtgaggatcagagaggctaatcttttaaatttggctggccctatggaatgtgtgtgtttctgtctgtctgcgtgcctctgtgtgtttttgtactcatacaatgtttactaaagaatgattatctatgtatccagcagtccacagagaagaagtaaatacttcacctttctgaggtctgatttaggcttgagaatgccagtctccaaatgtgagcccagcactggccatggagaagtgagcacccagcctctcacagtcagctcacagggacagggacacatgtcttcaatttgcatggtaacctctagatgcctgatagggtggctctgccctcagaggcttctgactcatgcaagaggagagacccagatgagatgaggattactgacaaattcatgtcaagactcacctgaccaacagtttcataggtcaaatatgtattgccaagccctgacttggaaggttcacacaaattattgcattgtaaacactgactgagtaaattccatcagtctggatcttgtttcctcatctgtaatataaggaactacgtagtgtggtgagaatgatagctggatatgtactttgcaagttactttcttatcaataagtctccagtcaccttagagctgaagtctcactctgacaacatgttagatattaggaatgtgcattcactttctatctttccctttttaagtaagaaatttttcttctgtttttaatgtaatatatgttcagtgaaaaacatttaggagatgcacaccaaaaactataaaggatttatttaaaaacagaattaaccactattaacatactattgcattttcttccattttttaaatgtatgaatgtgtaaaaacttggcttcatatggtatatataattttatatttaccttttattttacctaaccatatattatgatcattttcctgtgttgttaatgtccttttaaaatacgattttttatgagagcataatattccaagtgccataacttaaaaagaaaaaaaattgaccattcgattatgaaagaaagtacattcttattgtaaaaatttaaaaccatagaaagagtgttaaagtcaaaatgaaagatcctccttccaatcccatttactgaatgccatcactggtcaaagcttaatatgttgttcttctacactttccaggtcagtatattaacttattttctttactatttactatcccataatttatcaatcataccctccctcatggacatcaggctatgtcctgttttgttgctacaacaataatataataagccttcttactcatataatcttagcgattttatttctgtaggacaggttcaaaggacaggtgtatttttttatttaaatgaacaaataggtaatcttccaacaaaattagaaccattcagattaccacccatgttgtgatgactttttgaaataagcttcaggaattccaaaacattctaataataagtacttagataatgaggatctgtttctggattttctgttctatacattcatttttctattttggggccaatatcatgttgttctacttgcaaaagtctatttttctactctcagaggtttattttgaacttcaaagtcatttgaagcagtaacaaaaaaggaagttttttgttgagattgtgattgcaatcacattgattcatatattaatttggttaaaatgtgcttattagtgacatcaacaatttctatccagaattatacaatgtatttccatttatttaattcttggcttgtatccttcaataaaatgtatagttttcatcattggttctgtacctctgttgttaaatgtattttctttgtgtatattttttaagctttctatcactatcaagaatagtttctatcattgttttttccagttttaaccagttttactctaagatcagattatgctgtagttttctagtggacttttctccctcgagcccattgactgactttttcatgacagtgccctgcaaacactaagctcggtgaagactgttgaatgttgaatgcctgaacttggcacattggcaaattatacttaaagaatgccataacaaaaattcaaacacacaaaaaaagaaaagaactaatacttactaagcttttcctatgtactaagtcagaaataatttatgttatcttgtttcttctctgggccaagccagaaataatttatagttttaatcattttaaaagtataaatctcccttcagactatactagaaaagaaaaaaagtacaaatcagatttggaagtagatactaaatagccaattgattagtttgatttttttttcttttttctttttttctttttttttttggagatggagtcttgctctgtcacccaggctggagtgcagtggtgtgatcttggctcactgcaagctctgcctctcgggttcacgccattctcctacctcagcctcccgagtagctgggactacaggtgcccgccaccatgcccagctaattttttctatttttttttagtagagatggggtttcactgtgttagccaggatggcctcgatctcctgacctcgtgatccgcccgccttggcctcccaaagtgctggaattacacgtgtgagccaccacgccccgcatattttttctttcaaccaatatttcagccatagggtgacccaagtatgatatgctatagattatatgtaacaatttttgaaaatcatagatttttttcataccatagaggcagaaaggggcctgtttgcctccttctcagtcatatgaagatttttctggaaaacactcatttgggttatatttgatgaatattaagcttttataggatttttgcagaatcttgtcactgacctttgttaaataattgcattacttgaatatgtacctcagtttcctcatcagtaaaatgaaagggttgggctaaatgtctgagtcaagattttactgtagggtggccaggtgcagtggctcacacctgtaatcctagcactttgggaggctaaggcaggagaatctcttgtgcccaggagtttgagaccaacctgggtaacacagggagaccccacctctacaaaacaaaaaataataataattaattattttaaattttttttttttttttgagacggagtcttgctttgtcacccaggctggagtgtaatggtgcaatctcggtttgctgcaacctccgcctcccgggttcaagtggttctcctgcctcagcctcctgagtagctgggactacaggtgcgtgccaccacgcctggctaatttttgtatttttaggaaagacggggtttcaccatgttgcccaggctggtctcaaactcctgacctcaaatgatctgcctgcctcagcctcctaaagtgctgggattacagatgtgagccatcacacccagccaaaagaaaagattttactgtaggggaagcagtatgccttagtggcttaagttgaacatagttcaaatccaattccttagaaaagagagttcataaattgaatcaacaacattcaggactttagcataaaatagagtattttgcaccagtagattaaagattgaatagtcatatggaaaaagtaaagccaagtctctgagtctttaaatcaaataaatttcaatggataaaagatttatatgtgacaaggatatttgtttgtaatggcaaaatgattgggaaccacctcaatgttcatctagatgatattccttaaataaagtatggtttatttgtacagtggaatactatgcagctactaaaaaaataggccactgtataagtacaatgaatggaaagatctcaaagatatataattttaagtgagaaaagcaacgggtagaatggggtatataaagtgctaccatttatggctttaaaaaaagaaaagcatgggagaaaatatatatatttgcatgtgcatgccagatctttggaaggatacacaaaaactggcaatagtgattgtttccagaaaaaggcctgatggctgcaagtggatgagaaggagacttcactttcatatgtttatttgtaccttttggattattttgctagatggatgggtgatattctacttaaaatgatacattatatatatccattttctcaccaagtgaagttcataaaacctggttcatagggctatcataagagctggatcagataatgtgagagagagcctagcgctatgcctggtacgaggtaattgtcacacacacacacacacacacacacacccttttcccacccctacttgaattatctagacaacctgtgatcaaagacatgctgacacagaatggtattttttgtttctctcttggcattggagggtagtgatagaatttgcaaaagggaaatacttggctctccacaaaaaaagtggtttctaataccttactctttttttttttttttacttagagattttattattattattattattatactttaagttttagggtacatgtgcacaatgtgcaggttagttacatatgtatacatgtaccatgctggtgtgctgcacccattaactcgtcatttagcattaggtatatctcctaatgctatccttcccccctccccccaccccacaacagtccccagagtgtgatgttccccttcctgtgtccatgtgttctcattgttcaattcccatctatgagtgagaacatgtggtgtttggttttttgtccttgcgatagtttactgagaatgatgattttcaatttcatccatgtccctacaaaggacatgaactcatcatgttttatggcttcatagtattccatggtgtatatgtgccatattttcttaatccagtctatcactattggacatttgggttgattccaagtctttgctattgtgaatagtgccgcaataaacatacgtgtctaacaccttactcttatacctacagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggtaagagcaaaaccttctgaaagattcctttccccattgaatattcatttctcacttttctgtttctcctctgctgacttgttagccaccttcttattcctcacccataaacctttctattataccccattctgagaactaattttcttctgtattacttatttccaggcttttgcaggattctactacacagccagtgctttaaatctttcaggtagcttttccctggacaccttcaactccagcacctggaatttctgctcacagaattggagtcaggtcagtatttaaagagaagggatcaatgtcagtacaaaaaaatatggtagaatctattctatgtgtgtgtattctgaatttagcctttatgctcttctatttccatcacatctgtaaaataaaaggaataagggaatctactcccacacctgtggtgtgaattaatgttataactacatgcacaatggttagaacaatatttggcatataataagcactcaatgagtttaaagattagtatattgtgatattatatagggatattttcataattatattgtgtgattatatgattgtattataaagtattttctattatgaaattatgggtgataagattctttaaaacatgacttttaacccaaggtgttcattttaaaacatacctgcctgccctgcctctcagatgttttaaacctttcagctcccactgctgctccccaaatttgatgaggtatatgcccgctcttactgcttctcagccaactacatctaccacttgtttgtgaacggttacaaattcacagaggagacttggccccaaatacactttgaaaaagaagtaagttaagcacaaatcattttctcttcttcttcccaacagagaggtttgtatgtgtgtgtggaacaaatgtagaaggtaaaagggtattaatgagttaaactcactgggtggaagctgatcagactgatcccttgtgagtttcccagaagaggtcatggagaatttagaagagttgctcatgggtatacattctcctggaaaagactggaagccaagggccaatggactaggcggtcctggagggcagagacctgtcttggtatcttcatattcccagcactctgcacaaggaatagagcctagaaggtacttagtaaatgttggttgaattcataaataaatatgttaaggatatgagacttttcatcctgaaaagaagctttaaatgtaacagttttttaaagaggatagtaactaattcttctccattttattcagatatcagagtaagatacaggccttagggcctgatggatttgcattagcattaaataaatattttctctttgaatgaacctgaagtcattatatttactgacaaagatttgggggatggggaagatattcttagctcagggtttaatatatttaaaaatatgtatatttatagatatctataaatacatacatatatatatatgatggtcaagtgaccagaatggtccaaagctggaatcacagctgtcacctggtgacaggtgaaaggacctccataccttgtttttaggcagggctaagccttgtgaatatgttcagccagcactatgttccccaggttccagagaattttctcatttcaggaatagctgatatgaagcctgaaggatgtctggagtcagcctgttcaataccagcttcagcaataattagattaaaccaatcaatatcctgcattaggcctctgactatctacttttacataaataaaattgagtcatctacaaaaaaataaggatgtctggagacataaggactgttggtagcatgtactctctaagctttgcttctaataaatctaattaccagtaaagtatattataagaatggagaatgactttccatttgaatgccagtttgagttgacataatattctaagttaaaagttccctttttttaattataaagaattttgtgtccagccaaattagtatttaaatgtgaagatgtaggctgggcacggtggctcacacctgtaatcccagcgctttgggaggccgaggcaggcggatcacctgaggtcaggagtttgagaccagcctgaccaacatggagaaaccctgtctctactaaaaatacgaaattagctgggcatgttggtgcatgcctgtaatcccagctactcagaggctgaggcaggagaatcacttgcacctgggaggtgaaggttgccgtgagccgagatcacgccattgcactccagcctgggcaacaacagcaaaactccatctcaaaaaataaaaataaaaataaataaataaaaatgtgaaggtgtaaaaagacttgagaagatttgctgcacagaagacttacaatgaaaatatttttggtggaagtaataaaataagaagagaaataaatccaggagatgttacaaaaacactggaagtaagaataaatgatgttgtggcttaaaatttacattaaaaaagccgggtgctgtggctcatgcctgtaattccagcactttgggaggccgaggcaggtgaatcatttgaggtcaggagttcgagaccagcctggccaacatggcaaaaccatgtctctactaaacatacaaaaaattagctgggtatggtggcatgtgcctgtactcccagccactcaggaggctgaggcaggagaattgcttgaaactgggaggtggaggttgcagtgagccgagatctcaccatttcactttagcctgggcgaaagagcaagactctgtctcaaaaaaaaaaaaaaaattatattaaaaaaaacagaaaacgaacactaaagaaaagtatttaaaaaaaactccattcatatgactcaagtatagaaaatatccacatgataagggtgtggtaaggagttataagatacagggacataagagtaacctaaaattctcttcttgtcaaaggaaacacagagatatctttttctttttcttttcttttttttttttttttttttgagacggagtctcgctctgtcgcctaggctggagtgcaatggtgtgatcttggctcactgcagcctccgcctcctgggctcaaacaattctcctgcctcagcctcctgagtagctgggattacaggcacccaccatcatgcctggctaatttttgtatttttgtagagacagggtttcaccatgttggccaggctggtcttgaactcctgacctcaggtgatcccgcctcggcctcccaaagtgctgggattataggcgtgagccaccatgactggccacagatatcatttttaaggcaggaaagaagaaaaaatatatatagaaaaatagcactaattgaaaatttaaaagtaagatattagaaagaagtgtaaatatattaataatcacaataattataaatggactaaacctaccagttaaaagagagatgtcaaattgaatttttagaaatcaagcaggtgccatttataagagaaacatggttcaagcataaagacatggaaagatagaaagataattttgttaaattatcaaacactacccaaaagaaagctggtataactatttagtatctggcaaagcagtctttaagaccaagagcctcattctagacacagagggttacaacataatgataaaatgttcaattcactatgaagattgcaaaggtgaaacatttatacacctaataaaacaccctaaaaacatgtaaagcaaaaatagatagaactaccagaataaattgacagtcagcttcccatttgggctgattttctattcttaggaactggtcctgggatcagtaaaccactcattagcctctttctctagccacaaacactcctgtgctcctggacaacaggaacactttcactgttattaactgtgccgtcttcactcttggctgtgacaagattgtgagaatttgttcttttgactatttcttctgcagcgctggaggtgagatttccccaagcctttgtggctacagtgtggtgtcttaacttgggcaagtcctttgacctctttgggccacaatttcccatgggagctttgtgaggttgatagcagtatgactccggtatgtgattgcagccttgagccttgccctgagcgctgagccatctcctctactccacaggtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacgaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttgacttgcaaggggtgtgtgtgtgttaacttccatatggtactctttctcctaaggaccctaggtgatatttatgagagaaatttttttccctagcaaattaagaaacccattcattaatatcacctttattccagagagttcaaagtgcttttactttgataaacctttgactgcttgagattattgagtcaagcatttctgtaccttatttgaaattctaagcctctgtgagtccacaacctgacactcaaatcttggttctcatccagaacggctactcctatcccaaactgtacctttgctcccgccatcctctctactatattatagatcctcctcccacccatccaaatcatgtatgtttctcaaggtccagttccttcatataagtcttccacaaagctttccttgcacacacatactatgctctatctcctggaccactttttcaaaaccagccacgtaagtcctcatattgttatttatcttggcatatgtgtacagcttatttctaaaagacagagtaggctacttaagggcaaagcctattgtacatcactcctcatttattcaacagacatctaaaaacacctattatggctgataccttttacgtgtgattttggatttggacatatgctatgaacatagtatttattcatatttgttgattgaggttgtttccatgagtgactaagaaatgggcaataaactatagagatagcagggaaaaaacagcatccaaatcaccaagagtttgcaagaaaaaaaatttgtatgtgcaagaaagagagccaaagctccatgaaggcaaatcctagtcaacatttctaactcatttgggaagttagaataaactgaggtacttcaggttttctgacacacaccgaagaatttttgactgggtgcagtagctcacacctgtaatctcagccttttgggagtagctgaggcaggagggattccttgagcccagaagttcgagagcagcctgggaaacgtggcaaaacctcttctctccaaaaaatacaaaaattagccagaagttgtgggcacacctggagtcccagctacttgggaggttgaggtaagaggattgcttgagcctgggaggtggaggttgcagtgagccgagatcatgccgctgcactccagcctgggtaacagagcaaaactatctctctctctctctctctctctctctctcacacacacacacacacacacacacacacaagaatttttatagatagaccattgtgaaatctgcagttcaagtggcatatctagcactgttactgtggtgaacagaatactccttccccctctggtgttactccaattatgtggttacattgtcacatggcaaaaggattttgcagatgtaattacaaatcagttgaccttaaaatggagagcttatccaggtaggtctaacctcaccacatgagctctttaaaggcagagcattttctccagaagacgaagtcagagattcaaagcatgagaagaattccacatgcagttgccggcttggggatggagggcgccgtgtgcaaaggccctaagtgcagcctctagaaactaacagcaatccctggctgcatcagcaaaaaaccaggaacctcagccctacagctgcaaggagctggattctgccaacaacctgaatgaacttggaagcatattttcccccagagctttcagataagagtccaggtcagatcatatcttgatttcagcctactgagaccctaagtggagaacccagttgagcccactctgacttctgacctacaaaactataaagtaacaaaaagatgacgtttaaagccactaaatttgtggcaatttgttacacagtcacagtaaactaatacaactatagaaccccaaaccccaaagctccaaccaaagcaagtcttttgatttgaaatatgtgaagataaaagtgatgagtagcacaaatagtgtctattcctaatcacagctatgtaaaaa

SEQ ID NO: 17200 - DNA, 31391 bp, Human
  misc_feature (1)...(31391): n = A,T,C or G
aagtctggaaggggtggctactgacatagtgaagcaactagttcaattctacaacttgacagctacccctgtgccaggctatctacgaggatacttagaatgcataagacattccttcaaggaactccaggaacagaggcctgacatgttgcaatgtttagtgtcaagcagtgtactagagacacattatcacactcaaacctcacaacaattctgtgaggtaggagttatcactccccttttatagatgaaacagaggcttagagtgattgatttattgaaagtcaaacagccagtaaatggtgtagccaggattccaaacttgctgtctcactgagactgtacttaattactggagggaccgggtgtggtggctcattgctataatcccaacaccttgggaggctgaggctggtggatcacctgaggtcaggggttcgagaccagcctggccaacatggtgaaaccccatctctactaaaaatacaaaaattagctgggcatggtggtgggctcctgtaatcccagctactcaggaggctgaggcagggcaattgcttgagccgagatcacactgcactccagcctgggcaacagggcaagactctgtctcaaaaccaaaaaaaaaaaaaattactggaggaacctagaagaagaaatgatcaattttgcttggagtgtatctagaaagacttcactgagatcatttaaagaacaaaaaggatggctggggtccagcgcagtggctcatgcctataatcccagcactttcggataccaaggcagcagatcacctgaggtccagagtttcagaccagcctggccaacatagcgaaaccccatctctactaaaaataaaaaaattagctgagcatgttggagggcacctgtaatcccagctacttgggaggctgaggcaggagaatcactcgaacccaggaggtggaggttgcagtgagccaagatcacgccactgcactccagcctgggcaacagagtgagactctgtctcaaaaaacaacaacaacaaaaaatacaaacaagagacaagtagttcccaggtgcctaccaagtggtcaggcactgcacttacctcactgactgcagtaaccaccctttgaggttgtggcattgcctccattttccaggcaaggaaatgggctgagagctgggattagtcaggtcatgactgtgtgtgccactcccgctaaatctcatttgatgtggttcatgaggccacaccatggacagcttcctccttgtgtccactgaggatatggctttgtacaacactttggtttttgaacgactttacaaacctccctgtcttgtgaggaaggaagaacagttattaccatctgcatctgatgatgaaacaagggacgctgcagaggagccgcactgaccactccctccctccagtcctgtcatcccactgccagtgtcccaccctcttgtgccctgcacttcactggctaataacccccctcactttttcctctgtgaagccatcctggataattccccacccacgaatggtccctcctcatctcagagagctctccatgcacacctgttaccgtttctgtctttatctgtaaatatctgtgtgtctgacttccatgcctcacacacctctatagggcaaagactgtcttaaacatcttggtagtgtcagtattttgcacagtgaagtttttttttttaaattatatcagctttatttgtacctttttgacatttctatcaaaaaagaagtgtgcctgctgtggttcccatcctctgggatttaggagcctctaccccattctccatgcaaatctgtgttctaggctcttcctaaagttgtcacccatacatgccctccagagttttatagggcatataatctgtaacagatgagaggaagccaattgccctttagaaatatggctgtgattgcctcacttcctgtgtcatgtgacgctcctagtcatcacatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggtaagagagagagctcccaatcagcattgtcacagtgcttctggaatcctggcactggaatttaatgaatgacagactctctttgaatccagggccatcatggctctttgagcaaggcacagatggagggaggggtcgaagttgaaatgggtgggaagagtggtggggagcatcctgatttggggtgggcagagagttgtcatcagaagggttgcagggagagctgcacccaggtttctgtgggccttgtcctaatgaatgtgggagaccgggccatgggcacccaaaggcagctaagccctgcccaggagagtagttgaggggtggagaggggcttgcttttcagtcattcctcattctgtcctcaggaatgtcccaagcctttgagtagggtaagcatcatggctggcagcctcacaggattgcttctacttcaggcagtgtcgtgggcatcaggtgagtgagtcaaggcagtggggaggtagcacagagcctcccttctgcctcatagtcctttggtagccttccagtaagctggtggtagacttttagtaggtgctcaataaatccttttgagtgactgagaccaactttggggtgaggattttgttttttttcttttgaaacagagtcttactctgttgcctgggctggagtgcagtggtgcaattttggctcattccaacctctgcctcccagattcaagcgattctcttgcttcagcttcccaggtagctgggattacaggcggccaccactacgcccagctaatttttgtatttttagtagagacggggtttcaccatgctggcaaggcaggtctcaaactcctcacctcaggtgatccgcccacctcggcctcctaaagtgctaggattacaggtgtgagcccctgcgcccggccaaggggtgaggaattttgaaaccgtgttcagtctctcctagcagatgtgtccattctccatgtcttcatcagacctcactctgcttgtactccctccctcccaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggtaaccattacacccctcaccccctgggccaggctgggtcctcctagaggtaaatggtgtcagtgatcaccatggagtttcccgctgggtactgatacccttattccctgtggatgtcctcaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggtgaggaggaaggggacaagatgacatagagccattgaaacttttcatttttcttttctttttttaaaatttttttgaggcagaatctcactctgcccattctgtcggcgagacaggagtgcagtggtgtgatctcccctcacagcaacctctgcctcccaggctatagtgattctcctgcctcagcctcctgagtagctggaattataggcgtgcgccactaccacctggctaatttttgtatttttagtagagacagggtttcatcatgttgaccaggctagtcttaaactcctgacctcaaatgatatacctgccttggcctcccgaagtgctggaattacaagtgtgagccaccgagcccagcagacacttttcttttttctttttttttttttgagacagagtctcgcactgtcacccaggctggagtgcagtggcacaatctcagctcactgcaacctccacctcccgggttcaggtgattctcctgtctcagcctctcgagtacctgggattacaggtgcctgccaccacgcccggctaattttttgtatttttagtagagacagggtttcactatgttggccaggatgattgcgaactcctgacctcgtgatctgcccacatcggcctcccaaagtgctgggattacatgcgtgagccactgacacttttctttgccctttctttggaccctgacttctgcccatccctgacatttggttcctgttttaatgccctgtgaaataagatttccccgcctatcatctgctaactgctacggactcaggctcagaaaggcctgcgcttcacccaggtgccagcctccacaggttccaacccaggagcccaagttccctttggccctgactcagacactattaggactggcaagtgataagcagagtcccatactctcctattgactcggactaccatatcttgatcatccttttctgtaggaatcggatataacatcatccgggtacccatggccagctgtgacttctccatccgcacctacacctatgcagacacccctgatgatttccagttgcacaacttcagcctcccagaggaagataccaagctcaaggtaggcattctagctttttcaggccctgagggccctgatgtctgggggttgagaaactgtagggtaggtctgcttgtacagacattttgtcccctgctgttttgtcctgggggtgggagggtggaggctaatggctgaaccggatgcactggttgggctagtatgtgttccaactctgggtgcttctctcttcactacctttgtctctagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagtaagggatcagcaaggatgtgggatcaggactggcctcccatttagccatgctgatctgtgtcccaaccctcaacctagttccacttccagatctgcctgtcctcagctcacctttctaccttctgggcctttcagccttgggcctgtcaatcttgcccactccatcaggcttcctgttctctcggtctggcccactttctttttatttttcttcttttttttttttttgagaaggagtctctctctctgtcacccaggctggagtgctgtggcgccatcttcactcactgtaacctttgcctcctgagttcaagcaattctcctgcctcagccttccaagtagctgggattataggcgcctgccaccaggcccggctgatttttctatttttagtagagacggggtttcgccaggctgttctcgaactcctgaactcaagtgatccacctgcctcggcttcccaaagtgctgggattacaggtgtgagccaccacacccagctggtctggtccactttcttggccggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtaaggcctggacctccatggtgctccagtgaccttcaaatccagcatccaaatgactggctcccaaacttagagcgatttctctacccaactatggattcctagagcaccattcccctggacctccagggtgccatggatcccacagttgtcgcttgaaacctttctaggggctgggcgaggtggctcactcatgcaaacccagcactttgggaagccgaggcgggtgatcacctgaggtcaggagtttaagaccaccctggccaacgtgttgaaaccctgtgtctactaaaatacaaaaaaaaaaattatctgggcatgatggtgggtgtctgtaatcccagctactcaggaggctgagaagggagaatcagttgaacccgggagatggtggttgcggtgagccgagatcgcgccactgcactccagcctgggaggctgagcgagactccatctcgaaacaaaacaaaacaaaactatctaggctgggggtggtggttcatgtatgtatgtgtatatacatatatatgtgtttatatgtatatatatatacacacacacacatacatacacacacatacacacacaaattagctgggtgtggcacccgtgtagtcccagctactcaggaggctaatgtgggaggatcagttgaccctaggaagtcaaggctgcagtgagtcgtgattgcgccactgtactccagcccgagtgacagagtgacatcctgtctcaaaaacaaaaaaaaatctccccaaacctctctagttgcattcttcccgtcacccacctccaggattcctacaacaggaactagaagttccagaagcctgtgtgcaaggtccaggatcagttgctcttcctttgcaggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacggtaagccaccccagtctcccttcctgcaaagcagacctcagacctcttactagtttcaccaaagactgacagaagcccttcctgtccagctttccccagctagcctgcccttttgagcaactctggggaaccatgattccctatcttccctttccttcacaggtctgcacacctcattgccccttttgcaactactgaggcacttgcagctgcctcagacttctcagctccccttgagatgcctggatcttcacacccccaactccttagctactaaggaatgtgcccctcacagggctgacctacccacagctgcctctcccacatgtgacccttacctacactctctggggacccccagtgttgagcctttgtctctttgcctttgtccttaccctagaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcaggtgagtggagggcgggcacccccattccataccaggcctatcatctcctacatcggatggcttacatcactctacaccacgagggagcaggaaagtgttcagggtggaacctcggaagaggcacacccatccccttttgcgccatggaggcaggaagtgactaggtagcaacagaaaaccccaatgcctgaggctggactgcgatgcagaaaagcagggtcagtgcccagcagcatggctccaggcctagagagccagggcagagcctctgcaggagttatggggtgggtccgtgggtgggtgacttcttagatgagggtttcatgggaggtaccccgagggactctgaccatctgttcccacattcagcaagttcattcctgagggctcccaaagagtggggctggttgccagtcagaagaacgacctggacgcagtggcactgatgcatcccgatggctctgctgttgtggtcgtgctaaaccggtgagggcaatggtgaggtctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccactctccccagggctgcccctcccatctgccccttacctccatcccaggggaagtagagactgagaatgtgggtacaataggcacagaggttgtgcagcccacgcaggtggacctgcagcttcccactgggcagctttgcctgcagcagcagggccaagtagctgaagacgaaggcgtccaaggaggcagggctggagcagagagagaagggtgggatggaggagaaccactggggtagaaggggtaaagatggagctggaggaagagtcagccttgggaggtgggctctgggcagcaggcggccaccagggaaggacaggacacacagttctagacctggtatggggagagatccccaggtggcgccagcctggccctgaatagggctctatcccagggctgcataaagggcacactcagtgccccacagctcttcaggcccttcctgtgcctggctgccctcccaccctacccttttgtacctctgagaaggctctggccccacgcacagccccactgtcaccagggccagtatctgtctcagggacctcctatccagagcctgagccagccccagccccagccccagctccagctgctccatctgaacctgtatcttcttccaagccacccattaccctcttggagtcagactcacgcatctccaaagaagaacttttgagagcccaggcgctgagagagcagggtcagacactcccgagcctctcggtacagctgtaggggcgacacaggtaggcttgcagctgcgggaacagtgccacctccgcacctaagcactcccattcctggccagcatccttggggctcatctcatacaatagcccccggtctcagagctacctccttctccagctcttcctcgtcctcaggcctgtgctccccagtcagcagctgtagccgttccatgtactgccgctgcatgcggccaggcaggaagaagttgaggggaaagggcatagcctctgcataccacttccggggtcacttccacgtagttcttggtgtctatccaaaaagtatgtacctggattgggtgggcaggaagaaacaggcaggtctgagccagtgcacctgtctgattcaaggtgggcttctgacctccatgctctcctgagtctctgtgtgggtctgtgtgtgcccgtcccctccccggctggccatggatgctgggaggtctgggcacactcaccagcaccgggatcaacttctcctccaggagagacatgaaggccagggtgtctgccccttgctgagctgacagatcataatcagcattgtacttctgtggaggaaatatccatggcgtggacgctggggagctgcaagggcacttcaccagggaggaaggagtcctgtctggtacccccctcactggcctctgagtgcagtggaggtacagcaaggaacttttcctgccaaggcccccttgcctgggcccagccagtagcctgttgctgttggcaaaaagcctgggccttggagcccgctggccgtcaaggtcctgggcccattgagaagaaggaagaaaggttgggccgcaaactaggagcagctcccagaatttccatggaaagctggaacaatgcctgctgacagcaactttctaacagtaactttcccgacccagacaccacaaagctagcacaacggagctcagatgcaggctaggactcggtccatgcctcaggaaccagggaaagccatcctcacactccctggatccagggaacccacgcccagggccccccagcttgttccctcagtgcccagctcttggctatttctttcacttcattccatcgcccagacaccattaccacatacacattccatccatacccccaggtctcagcctgccctaccttcccaggctccagtccctgttcctcagcatcccccaccacatcctgagtaagctttgtccccagataacctcttcagcatgatccttaaatctccctaagcctcagtttctccccctgtggaatgggggtaagaatctctttctctgaatgcccctgtgttaggaaataatttagaatacttcgggaaacaaaaaagctctgttcacacctaagcaatcagggcagtggccctggccttgccaggaacttaggcttttatctggatcctctttccaggcctctcaattaattccccaggtccttaacctttgggaaattagaaattaggaagagtgtcccacttctgacactgtgttccctcttggaacctgaccgtcaatgctagaagaacccttggaaaacatgctggcccagccctctagttttacaaataagggagtgcacagccctgagaggttacatggcctgcccaagatcacgcagtcaatggcagagtaaagagcatagcctaggcctccccactcctctagtaatgctctttcatcttctccaacctggctctaagccttgtccatcctgagccccatatctagcccaacctagtccctgaaaacaagaagtggcccttagaaatctctctccagtcccactatcagaggccaactgctgtcttccagtctccttcagcctgtgctcctctccctccctgactgacaggcagaaggtactgtgcctctggatatccccacagtgccctgagctgcatctcttgctgactgctttaatacatcacagtgacattgtgtgtgtctctgccaccagactattgctccttgatgctctgggtcacctgcatctagcatggcatatatctagtgctcaataaatgtgtattgtacagaattgactgaacttctctcactggcagccccctctatccaaatcacccacctctttttgaaggtgggtgatgatcttgtgtggtactgaggtgacctctccatgactggtccaaagggcaggcagggttcctgatactgagagaaaagtataccaaccaggaccttagctgcctatccatacgtagttgcaacacattcctgcctatctcctgcttctcctcttgtacacacccttcctcacccccaagggatactgggtacctgaagggctctgccaggggttgctgatcttgtgctatatggtgcacaagaaacttttaagaaaaaagaaactttcaagacacactttccaaccacgaattctatctctgctccttttcatagcaataggttttctttttcttccctccacacttaaacatccattctcttatcacccacccccatcagactccttcccctgtgtttcttcagccactgctctgaccaaaatttgagtgaccaaaagtggtgtcagacccagtgaccatttctctgcctgcatttcacttgaccttgaagcagcaattaatctccataatcagcatcttcttgaatttttccctttgaggacattgctcttctactttgtgctctggttatcctttacaaacttttacacctctcctgaactggttaacagtagagggccccaagggtctcacgtaagccttctttgtttttgttttttttcttttattttattttttatatatttttttgagacggagtcttgctctgttgcccgggctggagtgcagttgcacgatctcggctcactgcaagctctgcctcccaggttcatgctattctcctgcctcagcctcccgagtagctgggactacaggtgcctgccaccatgcctggctaattttctgtatttttaacagagacagggtatcaccatgttagccaggatggtctcgatctcctgacctcgtgatctgcccacctcagcctcccaaaatgctgggattacaggcgtgagccactgctcccagccgtcatttttattttattttatttatttttttgagatggagtcttgctcttttgccaggctggagtgcatggtgcgatctcggctcattgcaacccccgcctcccaggttcaagcgattctcctgcctcagcctcctgagtggctgggactacaggtgcctgtcaccatgcctggctaattttctgtatttttagttgagacaggttttcaccttgttagccaggatggtctcgatctgctgacctcgtgatctgcctgcgtcggcctcccaaagtgctgggattacaggcatgagccactgcacccggccatcaattttttttttttttaaatggagtcttgctctgtcacccaggttggagtgtaacagtgcaatcttggctcattgcaacctccgcctcttgggttcaagcgattctcctgcctcagcctcctgagtagctgggactacaggtgcatgccaccacacccggctagtttttgtatttttagtagagacggggtttcaccatgttgtccaggatggtctcaaactcctgacctcaaatgatgtgcctgccttgaccttccaaagtgctgggattagaggcgtgaaccacattgcccaccgtaagccctcttttctacttccactctttctgtaggtggccctactactaacgtccatggctttaagtaccatctttctatgtgttaatgcataagtccagccttgacctctcttgagcgccatccaactcagcatatctggttggatgtctaatgagtatttcaaattcaacatggccacaactgaactaactgaactcttttttttttttaggcagagttttgctcttgttgcccaggctggagtgcaatggcgagatcttggctcactgcaacctctgcctccagggttcaagcgattctcctgcctcagcctcccgagtagatgggattataggccccgctacccggctaatgtttttgtatttttagtagagacagggtgttgccatattgaccaggctggtctgcaaatcctgacctcaggtgatccccctgcctcggcctcccaaagtgctggaattacaggcgtgagtcactgcgcccggccacacaactgagctcttcattcccaccccagcaccggttatttttccactgttcccatctcaatggcacctccattacccatttgcacattccaaaagcccaggaaccatggtgacttcttttcccatatccaacacaaccaatcctatcttgaattcatccacgtcccaccacctccccagctacctagttccagccaccctctctccacaacctctgaatcaatctttcacttttcccagcaatccattctccactcagcaaaatgatgataaagcacgtcacatcaaggctctgcctcaatttaatggcttcccattgtatttagaatcatctccaagctctcagagactatggtcagctacaatctggcccaccttctgttccagccaaatttcctcacagcacaaggacgtttgcacctgctattttccaagcacgaaaccctcgggcagatatatctggtgctgtcacctaatttcaggttttaactccactctcaccatttcagtgaggacctaatccccatcgcagtcattctatcacatagctttattttattttatttttttttgagatacagtctggctctctcacccaggctggagtgcagtggtgtgatctgggctcactgcaaacttccatctcctgcgttcaagcgattctcctgcctcagcttcccgagtagctgggattacaggtgtctgccatcacgcctgactaagttttgtattttcagtagagacggggttttgccatgttagccaggctggtctcgaactccttgacctcaagtgatccacctgcctcagcctcccacaatgttggatttacaggcgtgagccactgctcccggccacatagccatgttttaagcatgtatcactatctaaaattattttttgtttatacgtttgtgtcgtcctgtagaatgtaaggtcacaagatcagggacttgctcattgcactgggtctaacacacagtgcttcctcaacaaacactcgttaagatactaacgtggcagagtggggccttgtaaacagtttcaggaccctgtgcttgtaagagcaacgtggtgccctcccaaggaagacagggaggatgcaggagcactgcccagagatggcgtcaggctgcaagacatcttgaataattcaccatcgtaacaacccagcctcaggaagagatggggcaaggccagaacgaaacattaggtaagaggcggtggacaatgggattcccacagggcagcttttgggcactggacgttccctaacctgaggctctctgaagaggaaggttaggaatcctctcagcttcggtgggctggactcactgtgggaattcaatcgccccccccacccactaagggtgtgctggcgggaaagcgctgagacgcatgcgtagttctcgcgtctggcacccgctccctttccaatacgcttgcgccccatctgtgctacggatggtcagggagagttgtccgtcttcaaatggaccaatgagacttgtggaggggctctgagtcccgcctctggatgagtgaccgtctcttttccaagtgaggccccgccccgcctccccagggctgcttttctcgcggcacgggtggtggggctgcttcttgacttccgcgcctagtgcgcggggccccattctccagtcccgcccacgcgcctttggaggctgcggtgggatttccttttgccttcggttggggctgctgtttctcttcgccgacggtaggcattataaatatttcgccctttgaattttagctctcccctcccggcgttcgcacttagcctttttcatcattatcattatttttaatggtaaggatggtcaaattttactaatgaagcgattataaaatcttcaagtctttgtatccacttgctttttgagggctggagtgggaagaaaggtatataattcattcattcttcggacatgtgacaaacgttcacggagcgcggcaacgagcgccggtgtcgcgatgcgcactggggctgcacatgggagccaggatggactggactggtccctgccctgcccgctgacgattggcaggccactgcctttgatgagctgggcgctataactgccattaagccatttgtacaattaatcacaacagtgataagagcgacaaaggagctattcgggtggctgaggcgggaggatcttttgagcccaggagttcgagaccagcctggggaatagagcgagatcctgtctcaaaaaaagggggagaaaaagtgacaaagaagttgtgagggctatgagtttgcgttagaggaggtgtgtgaggtggggaggcggcagggggcgcggttgttcttagagaaagtgacatccgggctaattttgaaagaataagtgttaactaggctaagcggtgggaaagagtagtgtgtgctgaaggaagggaagaggaacctggcaagttcatggcaggctgtaattggatgctggtctccctccacacttgactcctacagtctgatttctacacagcacccaaagtgatctcttaaaaatacacatgtgatcttgtcacttcccagcaccaaactctacagtgaatttccatcttagaacaaaattcagactccttaccatggccaccaagaccctacacaatctggcctcccaatttccttttccaaggtcaccttttaccactatccatctcactcacactgctccagcactctctatgcttttatttttctttcttcctctttctttctttctttctttttctttttctttctttctttccttccttctctctctctctctttcttttcttttctctttctttttttttttttgagatgcagtcttgctctgtcacccaggtggtgtgatcttggctcactgcaacccagagcagtgggggtgatcttggctcactgcagcctccgccttccaggttcaagcaattctgcctcagcctcctgagtagcagggattagcgccatcagtcccagctaatttttgtatttttagtagagatttcatcatgttgtccaggctggtctcgaactcctgacttcaagtgatctgcccatctcagcctcctaaagtgctgagattacaggcaggagccaccacacctggctcagtatttgttttatttttgttgtgtttatttatttagagacaaggtcttgctctgttgctcaggctggagtgctgtggcaggaacacagctcactgcagcctccactacctcaattcaggcgatcctcccacctcagctgagactacaggtgtgcatcaccatgcctggttaattttttcgttttaccatgttggccaggtttgtctcgaactcttgggctctgctgtcctcctaccttagcctcccaaagtgctaggattgtaggcgtgagccactgtgcccagctggtgttcagtatttgaatccatatttcctgtagccgcaaccaaagttccactgttaggtctcactttgactttaataattgtgttcaggctgggcacactggctcaagcctgtaatctcagcagtttgggaggccgaggtgggtggatcacatgaggtcaggtgtttgagaccagcctgtccaacatggcgaaaccctgtctctactaaaaatacaaaacattctccgatcgtagtggcgggcgcctgtaatcccagctacttgggaggctgaagcaggagaattgcttgaacctgggaggcagaggttgcagtgagcggagatcacgtcattgcactccagcctgggctacagagcgagactctgtctcaataagtaaataaataaataaataaataaataaataaataaataaataattgtgttcggagtcagcatcattcttcctgaagttcaccactcctttgccaagaacacttcctgaaacactgacaagcaggaccttgaatagtggggtatggttggtaacaactcactcattcaacaaacattgagcacctattttgtgcttgcctctaaatgaagagctggttgtattatttatttttttaggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgagaagcagtctgtgtgacctgatgactcagaactgcttggaatttagattaggacagatatgagcttaggcttcactctgccacatatttaacttctctaagtcttagttttcttttctttttttttttttttgagatggagtctcgctctgtcacccaggctggagtgcagtggcacgatcttggctcactgcaagctccgcctcccgggttcacgccatcctcctgcctcagccacccgagtagcggggactacagtcgcacaccgccacgcctggctaaatttttgtatttttagtagagacggggtttcaccgtgttagccaggatggtctcgatctcctaaccttgtgatccgcccgcttcggcctcccaaagtgttgggattacaggtgtgagccatcgcgtctggcctctaagtcttaattttcttatctgtaatgtagagttgtcaggctagtgcatgtaataagcactcatgaaagactgactattatcttgcgaaaaattggaagagatcatgaggtacaaggaccttccatctgcactgggctgtacattgaatgttgtggttactgttgaagcattggtaaatcacatgaatccaatggtaaaaccacaccctaaggtcagactcagtggctcacgcctgtaattccagcactttgggaaaccaaggcaagaggattgcttgagctcaggagttcgataccagtctaggcaacctgtttctataaaaagttaaaaaattagcttggtgtggtggtgtgcacttctggtcccagctactcaggaggctaaggtgggaggatcccttgagcccaggtggtcgaggctgcagtgagccaggatcacaccattgcattccagcctggatgacagtgtgaggccctgtcttaaaaaagacaaaaacaaaccaaaaaaacccacaccctagtgggtaaggggcagcagaggtcccacccaagagtgaaatcatttttggtgtcagtaatcagggagagtaatataccctcaggccagaaactagaggtgagtgatggctcacgcctataatcccagcaccttgggaggctgaggcaggtggattgcttgacctcaggaattcgagaccagcctgggcaacatagcaagaccccatctctaaaaataaatttcaaaaattagttgggcatggtggcatgtacctgtagtcccagctactatggaggctgaggtgggaggatccaattgagcctgagaggtcaaagctgcagtgaattgtgattgtgccaagaccctgtctctaaaataaaataaaattacaattaaaaactagagctgaaaggacaggttctaggttaactggtagtagttgttcattcatctgtataaaaagtacttttttgagcacctactctgtgctgtgcatggaatgaacaaatgtctttatttgacttgaacacagaccatagaagtaactaacagtggaactgggagtggcactctccatgggacctaaagacctaggagcctgtgatatgatacctgtcagtgtgaaagggctggagtttgctatctgagccagacctacactccaagacaggtcttgctgggatgggatcaaaattgctgctgggtcagccgaactatttttgtacttctgcttttcacttatatttatgtcttccctaggtatatagctgtctttttttgtttgcttgtttttctgagtcagagtcttgctctgtcactcaggctggagtgcagtggcgcgtctcggctcactgcaacatccacctcgggttcaaacgattctcctgcctcagattcccgagtagctaggattacaggtgcccaccaccatgcccggctaattttttgtatttttaatagagatggggtttagtagagacagggtttcactgtgttatccaggatggtctccatctcctgacctcgtgatctgcccgcctcagcttcccaaagtgctgggattacaggcatgagccactgcgcccggccactggagaccccttttctaccaaaaaaaataaaaataaataaataaatatatatatatatttgtaaagacggagtctctctatgttgcccaggctggtcttgaactcctggcctcaagggatcctcttgtctcagcttcttaaaatgatggggttacaggcatgagccaccgtaccaggccttagcaaactctttttcaagtgctatacaaaggggacagaggaacgtgattgtggccacctagtatgcccctattggccactgcagtgaggcctaggtgtttgaagagaggcacctagggtagtggctctcaggcacaccctaggggcattttggaaatttgtggggcatctttaatagagacaatgattaggaggcactttgagaatttagtggatggagcccaggaaaggtagacattctgcaacatgtagtacattcatacacaaggaagaattcactcatttcacctgacttacaaatataaaatcaaatataaatcagtaggactttattataaaatattgcagaaaagtttcacaagaattttttgtagaaaaagcccaatcagggccgggcatggtggctcatgcctgtaatctcaggactttgggaggccgaggcgggtgaatcacctgaggtcaggagtttgggacaagcctggccaacatggtaaaaccccgtcttgactaaaaatacaaaaatcagccaggcatggtggtgtgcgtctgtaatcccaggtactcgggaggctgaggcaggagaatcgcttgaacccaggaggcggggtttgcagtgagccaagatcaagccactgtgctccagcctgggtgaaagagcaagactccgtcgaaagaaagaaaggaagggaggaagggaggaagggagggagggagggagggagggaaagaaagaaaaaagagaagagaggggaggggagggaagaggagaaaagaaggaaggaaggcaggaaggaaggaatccagtcgagatcgttaaatttgttgtaattttgtctttggcacaataaacattagtccttattaaaactaactttacttagaaaataaaatagaaaatcctcaaggacaaatcacattgtacaggaaatatgaaatgtgaaataatatccaccttggaaattttttttttttgaaacagagtgttactctgtctcccaggctggagtgcagtggcacaatcttgggtctctgcaacctctgactcctgggttcaagtgattctcgtacctcagcttcccaagtagctgggattacaggcgtgcaccaccacacccagctaatttttgtattttcatttcagatgggattttgccatgttggccatgaacacctgtcctcaagctatccactgcctcagcctcccaaagtgctgggattataggcatgagctaccgtgcccagccaccctggaaaaattttacaaaatgaagtataaaaagaagaaaagaggggcgggcatggtgccttgtgcgtgtaatcctagaactctgcaaagccgaggcaggagatcctttgggtttaggagtttgagaccaacctgcacaacatagcaagaccctatttctacaaaaaatacagacactaggctgggcgtggtggctcacgcctgtaatcccagcactttgggaagctgaggccagcagatcacgaggtcaggagatggagaccatcctggctaacatagtgaaaccctgtctctactaaaaatacaaaaaattagccgggtgtggtggcaggcgcctgtagtcccagctactcaggaggctgaggcaggagaatggcgtgaatccgggaggcggagcttgcagtgagccgagatcgtgccactgcactccagcctgggagacagagcaagactccgtctcaaaaaaaaaaaaattttgctcagtacctggccaaaaaagaagcagctcactccctgtacacagagggtaagagaaaggagatggttgaacttctaaactcgctaaagcaggagaggcaaatgtggaatgtgctcaggaaatatctgtgagatgaatgaatttgagggaagtaaggtactagataattacctgccctacccagaacaaatcctgtgcaacgtttccttgaagagcaggaagtcaggccgggtgctgtggctcacgcctgtaatcccagccctttgggaggccaaagtgtgcgaatcacctgaggtcaggagattgagaccagtctggctaacatggtgaaaccccatctctactaaaatacaaaaattagccgggcgtggtggtgcgtgcctgtagtcccaactacttgggaggctgaggcaggagaattgcttgaacctgggaggcagaggttgcggtgagctgagatcggccactgcactccagactgggtgacagagtgagacatcatctcaaaaaaacaaaaaaaaaagagaaaagcaggaagtctggaaggggtggctactgacatagtgaagcaactagttcaattctacaacttgacaactacccctgtgccaggctgtctacaaggatatttagaatgtgtaagacattccttcaaggaactccaggaacagaggcctgacatgttgcaatgtttagtgtcaagcagtgtactagagacacattatcacactcaaacctcacaacagttctatgaggtaggagttatcactccccttttatagatgaaatagaggcttagagtgattgatttactgaaggtcaaacagccagtaaatggtgtagcaaggattccaaccttgccgtctcactaaaactgtacaaaaaaagatacaaacaacagacaaatagttcccaggcgcctcccaagttgccaggcactgcatttacctcactgacccctttgaggttgtggcattgcctccattttctaggtgaggaaataggctgagagctggggttagtctggtcatgactgtgtgtgccactcccaccaaatctcatttgatgtggttcatgaggcaaatggcatggacaacttccttcacatgtccactaagcatatggccttttacaacactttctggtttctgaactactttaaaacctcactgtcctgtgaggaaggaagaacagttattacaatctgcatctggaagccaattgccctttagagatatggctgcaattgcctcactgcctgtgtcatgtgactctccgaggcccttaatgagtaaatgaggggtgctgcaggggagccaagctgaccactcccctccctccagtcctgccaccccactgccagtgtcccaccctccttgcgccctacacttcactggctaataacccccctcactttttcctgtgttgaaggcatcctggataattccccacccacgaatggtccctcctcatctcagagagctctccatgcacacctgttactgtttctgtttttacctgtaaatatctgtgtctgacttccatgcttcatgcacctctatagggcaaagactgtgtcttaaacatcacggtagcctcagcatgttgtgcaatgaaggtttttttgtttttgttctttgttttttttttggtattagctttatttgtatcattttgaaatttttatcaaaaaagcagcgtgcctgctgtggttcccatcctctgggatttaggaatctttacccgattctccatccaagtctgtctttcgtattctaggctcttcctaaagttgtcattcacatataccctccagaattttatagggtgtataatctgtaacaactcggaggaagccaattgccctttagaaatatggctgcaattgcctcacttcctgtgtcatgtgactctcctagtcatcacatgacccatccacattgggaagccagaattacttgcaggagtaacctagtgcctatagctatggcaggtacctgcatccttgtttttgtttagtggatcctctatccttcagagactctggaacccctgtgctcttctcctcatctagtgaccctgaggtgatggagttttcaagtccttccagagaggtaagagagagagctcccaatcagcattgtcacagtgcttctggaatcctggcactggaatttaatgaatgacagactctctttgaatccagggccatcatggctctttgagcaaggcacagatggagggaggggtcgaagttgaaatgggtgggaagagtggtggggagcatcctgatttggggtgggcagagagttgtcatcagaagggttgcagggagagctgcacccaggtgtctgtgggccttgtcctaatgaatgtgggagaccaggccatgggcacccaaaggcagctaagccctgcccgggagagtagttgaggggtggagagggacttgcttttcagtcattcctcattctgtcctcaggaatgtcccaagccttcgggtagggtaagcatcatggctggcagcctcacaggattgcttctacttcaggcagtgtcgtgggcatcagatgagtgagtcaaggcagtggggaggtagcacagagcctcccttctgcctcatagtcctttggtagccttccagtaagctggtggtagacttttagtaggtgctcaataaatccttttgagtgactgagaccaactttggggtgaggatttttgaaaccgtcttcagtctctccaaacagctgtgtccgttctccacatccttgtcagacctcacctctgcttgtgctccctccctcccaggtggtgcccctgcatccctaaaagcttcagtacagctcggtggtctgtgtctgcaatgccacatactgtgactcttgaccccccgacctttcctgccctaggtgccttcagccgctacaagagcagaagcagtgggcattggatggagctgagtacaggaccatacaggctaattgcaccggcacaggtaaccattacacccttcaccccccgggccaggctgggtcctcctagaggtaaacggtgtcagtgatcaccatggagtttctcccctgggcactgataaccctgtggatgtcctcaggcctgctactgatcctgcagccagaagttccagaaagtgaagggatttggaggggccgtgacagatgcaggtgccctcaacatccttgccctgtcaccccctgcccagaatttgctacttaaatggtacttctctgaagaagatgaggaggaaggggacaggatgacatagagccactgacacttttctttgccaattctttggaccctgacttctgcccatccctgacatttggttcctgtcttaatgccagtgaaataagatttcgccgcctatcatctgctaactgctacggactcaggctcagaaaggcctgcgcttcacccaggtgccagcctccacaggttccaacccaggagcccaagttccttttggccctgactcagacactattaggactggcaagtgataagcagagtcccatactctcctattgactcggactaccatatcttgatcatccttttctgtaggaatcggatataacatcatctgggtacccatggccagctgtgacttctccatccgcacctacacctatgcagacacccctgatgatttccagttgcacaacttcagcctcccagaaggaagataccaagctcaaggtaggcattctagctttttcaggccctgagggccctgatgtctgggggttgagaaactgtagggtaggtctgcttgtacagacattttgtcccctgctgttttgtcctgggggtgggagggtgggggctaatggctgaaccggtagcactggttgggctagtatgtgttccaactctgggtgcttctctcttcactacctttgtctctagatacccctgattcaccgagccctgcagttggcccagcgtcccgtttcactccttgccagcccctggacatcacccacttggctcaagaccaggggagcggggaatgggaaggggccactcaagggacagcccagagacatctaccaccagacctgggccagatacattgtgaagtaagggatcagcaaggatgtgggatcaggactggcctcccctttggccatgctgatctgtgtcccaaccctcaacctggttccacttccagatctgcctgtcctcagctcacctttctaccttctgggcctttcaaacttggatctgtcagtcttgcccactccatcaggcttcctgttctctcggtctggcccactttcttggctggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtaaggcctggacctccatggtgctccagtgaccttcaaatccagcatccaaatgattggctcccaaacttagagggatttttctacccaactatggatcctagagcaccattccccgggacctccagggtgccatggatcccacagttgggacttgaaacctctctaggctgggggtggtagctcatggctataattccagcactttgggaacccaaggtgggtggatcacttgaacctaaggagttcaagatgagcctgggaaacatggtgaaaccctaactctacaaaaaaaaaaatagaaaagttagccgggtgtggtggtggcacgcctatagtcccaagtattctggaggctaaggcgggaggtttagttgagcctagaatttcaggctgcagtgagctatgattgtgccactgtactccagcctgtgtgacagagggagaccctgtctcaaaaacaaaaacaaaaaatccctcccaaaacctctgtagttgcattcttcccaccacctaattcaggattcctacaagaggaactagaagttccagaagcctgtgggcagggtccagggtgacttgttcttcctttgcaggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacagtaagccaccccagtctcccttcctgcaaaggagacctcagacccattagtagtctcaccaaagactgatagaagcccttcctgtccagctttccccaggtagcctgcccttttgggcaactctggggaaccatgattccctgtcttgcctttccttcacaggtctgcacacctcattgccccttttgcaactactgaggcacttgcagctgcctcagacttctcagctccccttgagatgcctggatcttcacacccccaactccttagctactaaggaatgtgcccctcacagggctgacctacccacagctgcctctcccacacgtgacccttacctacactctctggggacccccagtgttgcgcctttgtctccttgcctttgtccttaccctagaacctcctgtaccatgtggtcggctggaccgactggaacccatcattgtagacatcaccaagcacacgttttacaaacagcccatgttctaccaccttggccacttcaggtgagtggagggcgggcacccccattccataccaggcctatcatctcctacatcggatggcttacatcactctacaccacgagggagcaggaaggtgttcagggtggaacctcggaagaggcacacccatccccttttgcaccatggaggcaggaagtgactaggtagcaacagaaaaccccaatgcctgaggctggactgcgatgcagaaaagcagggtcagtgcccagcagcatggctccaggcctagagagccagggcagagcctctgcaggagttatggggtgggtccgtgggtgggtgacttcttagatgagggtttcatgggaggtaccccgagggactctgaccatctgttcccacattcagcaagttcattcctgagggctcccagagagtggggctggttgccagtcagaagaacgacccggacgcagtggcactgatgcatcccgatggctctcctgttgtggtcgtcctaaaccggtgagggcaatggtgaggtctgggaagtgggctgaagacagcgttgggggccttggcaggatcacactctcagcttctcctccctgctccctagctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacaacagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtcagtgtgagtggctttattctgggtggcagcaccccgtgtccggctgtaccaacaacgaggaggcacgggggcctctggaatgcatgagagtagaaaaaccagtcttgggagcgtgaggacaaatcattcctcttcatcctcctcagccatgcccagggtccgggtgcctggggcccgagcaggcgttgcccgctggatggagacaatgccgctgagcaaggcgtagcccaccatggctgccagtcctgccagcacagataggatctggttccggcgccggtatggctcctcctcagtctctgggcctgctggtgtctggcgttgcggtggtacctcagctgagggtcaaggaaggaaggtgtgttaggagaactagttcttggatccctgcccactctccccagggctgcccctcccatctgccccttacctccatcccaggggaagtagagactgagaatgtgggtacaataggcacagaggttgtgcagcccacgcaggtggacctgcagcttcccactgggcagctttgcctgcagcagcagggccaagtagctgaagacgaaggcgtccaaggaggcagggctggagcagagagagaagggtgggatggaggagaaccactggggtagaaggggtaaagatggagctggaggaagagtcagccttgggaggtgggctctgggcagcaggcggccaccagggaaggacaggacacacagttctagacctggtatggggagagatccccaggtggcgccagcctggccctgaatagggctctatcccagggctgcataaagggcacattcagtgccccacagctcttcaggcccctcctgtgcctggctgccctcccaccctacccttttgtacctctgagaaggctctggcccccacacagtcacactgtcactagggccagtttctatcccagggacctcctatccagagcctgagccagccccagccccagccccagctccagctgctccatctgaacctgtatcttcttccaagccacccattaccctcttggagtcagactcacgcatctccaaagaagaacttttgagagcccaggcgctgagagagcagggtcagacactcccgagcctctcggtacagctgtaggggcgacacaggtaggcttgcagctgtgggaacagtgccacctccccacctaagcactcccattcctggccagcatccttggggctcatctcatacaatagcccccggtctcagagctacctccttctccagctcttcctcgtcctcaggcctgtgctccccagtcagcagctgtagccgttccatgtactgccgctgcatgcggccaggcaggaagaagttgaggggaaagggcatagcctctgcataccacttccgggtcacttccacgtagttcttggtgtctatccaaaaagtatgtacctggattgggtaggcaggaagaaacaggtaggtctgagccagtgcacctgtctgattcaaggtgggcttctgacccccatgctttcctgagcctgtgtgtgggtctgtgtgttcccgaaccctccccggctggccatggatgctgggaggtctgggcacactcaccagcaccgggagcaacttctcctccaggagagacatgaaggccagggtgtctgccccttgccgagctgacagatcataatcagcattgtacttctgtggaggaaatatccatggcgtggacactagggagctgcaagggcacttcaccagggaggaaggagtcctgtatggtacccccctcactggcctctgagtgcagtggaggtacagcaaggaacttttcctgccaaggcccccttgcctgggcccagccagtagcctgttgctgttggcgaaaagcctgggccttggagcctcctggccgtgaaggtccagcgcccaatgcagggaaggaaggaaggctccgccgcaaactaggagcagctcccagaatttccatggaaagctggaacaac

SEQ ID NO: 17201 - DNA, 15704 bp, Human
cattcctcccggagcgatctcggttcaccacaacctctgcctcccgggttcaagcgattctcctgcctcagcttctcgagtagctggcactacaggtgtgcgccaccatgctgggctaattttggattttttagtagagatggggtttcactatgttggccaggctggtcttgaactcctgacctcgtgatccgcccaccttggcctcccaaagctctgggattacaggcgtgagccactgcacccagccgtgttttgtccaattctttgttcaagatgccaagaacctggacaccctccaccggtgacagtaccttatatacacggaatcatacagtatctgtccttttgagtctggcttatttcacttagcataattgtcagaggtgcgtgaaccagagcaactccatcttgaatagggactgggtagaataaggctgagacctactggactgcatttccagttggtttaggcattctaagtcacaggatgagataggagattggctcaagatacaggtcataaagaccttgctgataaaacagattgcagtaaagaaactggccaaaacctaccaaaaccaagatggcaacaagagtgacctctggtggtcttcaacgctatactcctaccacatgctgtgtcgacatcagggagttaactgtatatggtctacaaagcagaggcatgaataatccaacccttgtttagcttataatcaataaataactgcctgggccaagtggctcgtacttgtaatcccagcactttcagaggtcgaggtggctggatcacttgaggtcaggagttcgagaccaggctggccaatctggagaaaccccctctctactaaaaacacaaaaattagctgggcatgctggcaggcacctgtaatccaggagaatcacttgaacccgggaagcgaggttgcagcctcccacgtagctggaattaaggcgcggaccagcacacctgggtaatttttgtatttttagtagagaaggggttttgccatgttgaccaggctggtctcagattcctgaccgcaggtgatccgcccaaagtgctggaattacaagtgtgagactcatcttttttttttttttttttgagacggagtcttgctctgtctccccagctagagtgcagtggttcgctggatctcagctcactgcaacctctgccttacgagttcaagcgattctcctgcctcagccctcctgagtggctgggattacaggcgcgcgccaccacgcccgactaattttttttttttgtatttttagtagagacggggtttcaccacattggtcaggctggtctcgaactcctgacctcatgatccacccgcctcggcctcccaaagtgctgggattacaggcgtgagccaccgtgcccggcccaagactcatctttcttaagcccttaaagcactttgcacacattacctcatggtattaccaccctcattcaacagatgaggaaagctagtttcaagcaagttcactgaggatcagagacgttaaatgatttgcctaaagttagagaactaataagtgagaaagctagtcctgctgcgttttactaacgtgccaatcagctgcccaggaagataatgaaaacttgagtaagacaggcagccaaagccacagcggggacgttcccagcctggctcgcttccggcactgacgcctccagccgcgacctctagacttcagcccttccattggtcgtccgtcacagtgccacagtgcgccatgctcacacgacggccagcagccaatcagcgcggctcatcttcgcccagccaggacacgcaggatcgcgttatctgtccctcccgcgggcacattgggagttgtagtctaattatatatttccgcccttagtgtggggagagcgggaactactcgacccacagagccgatcgcggagcggattctgcttttaggagtacccgccaacaagcgggaccgagcaggaatccgtatctgggaacaggtgagagaggatgtgtgctgggccttggaggaagggggccgagaccgggccttacttctgtaacgatactgtgaggcatcggaaggccagcctgttgtgtccgttttgaaggtcggtgggctagactggctggccttctaggggtgtggagacttcccaactctgcccttgtgctttcctggaatccccaatatgcccggaccccggtttactcctttgctgcgagcccttctctcccgtccagagttgctccgagcctatctgctcagtcctagcgattcctgtggggcttgggacgcgcggttcaagcaccccggaccatatggatgcagcacccatgggttctcgctccaatgcttctttcctccttggggcgtaactcagaccctgggcacccctctccactgcccaggggagacctgggttctagatttggctctgcctctactatcttcctacctcctagagcctcagtttggcttgtgtaaaataggatgacttaagggtcctttcagcccctaatcctggggtactttactctgtaccgcctccttacccagccttgtgcacgccatcttgaaggcactgagttctagcctgtttattgtaagtggtgattagttgggtctcagtcacccagccatacttttttgttccctgcgtatccttcctgtaattgtccccaagcacattccacaagagggaggggcactctgggctaaggctggggtgggagttatctggggagctgccaccatgcctctgcctttggtgcttgcccctgcagggagtgcttagtgccccctccctatgccactcccaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcggtgagtgtggttggggtgaggggccttggggaggggagcagctgatcaggtttctgacttgtttttcttctacttagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtgagggattcatgacttgggggagtaaggctttggttcagttgctctgtacctgtgtggcattcacctgtggcttatgggggacttttgacagatgtgagagaaagctttttttttttttttgagacagagccttgctctgtcacctgggctggagtgcgatggtgtgatctcggcttgctgcaacctccacctcctgggttcaagtgattctcctgcctcagccttctgagtagctgggattacaggtgcgtgccaccacatccagcaaacttttgtatttttaatagagacggggtttcactgtgttgaccaggctggtctcgaactcctgacctcaggtgatccacccacctcggcctcccaaagtgctgggattacaggtgtgagccaccgcgcctggccgagaaagcttttacctgagggactcgagtctgctctggagaggttggggcctgggcaagtatacttactcagtccatcaaccggacttttggctctgatggaaggtgggtcatccaaactgctttgctttgggggtggaggccttgaacctggcaagtcttagattttgtgtcctgaaatcagaagctgttaggttggcagagaccggggaagaaggcagtctgatattgtcctatctccctggggcctgagtgaagttattgtatcattagaaacccctattctagaacatgaactattgctgtgatacttgccaatttttttcctgttgattctggagtatctattaaaattctttttataaatgctgtctatctcatatatctcaggggaatgaagggaaaggggggctttgcctatactggaatggggattaaaagagtcttggcccggcatggtggctcacgcctgtaatcccaggactttgggaggctgaggtgggggggatcatgaggtcaggagttcgagaccagcctggtcaacatggtgaaacccccgtctctactaaaaatacaaaaattagctgggcgtggtggcgcccacatgtagtcccagctactcaggaggctgaggcaggagaatcacttgaacctgggaggcggaggttgcagtgagccgtgattgtgccactgcactccagcctgagtgacatagcgagatgaagtcttccctgttagttaggtctgattgatagccaggcagcagaaggcaaagtgagatgcaagaggagacactactggaggagtgggagatggatcccacagcgtgggtcccctgtaagctgtcttctggctgactttggagaggctttgttttaatataatgaaggaggcttttcatttgcaggagggttgaaccctggtaggcagaggtggctggaaaagtagggatgggttgtgaaggggaagtctaggagaggtggggatggggaaggaaactggggagggacctgaacaagccagtcatccctatagcatgtactgagttttccgtgggttcaagccctgttctgggtttgggagcagcatttaatctgcactatggaggttttaaatttattgggaggccaaggcgggtggatgacttgaggtcagtagttcgaaaccagcctagccaacatggtgaaactctgtctctactaaaaatacaaaaattagatgggcatggtggtgggcacctgtaatcccagctactcgagaggctgagccaggagaatttcatgaacccggagacagaggttgcagtgagccaagatcgtgccactgcactccagcctgggtaacagagagagaattcatctcaaaaaaataaataaataaataaataaataaaaacaaaaaataaatttactagggtagaccatgcagaaagaatgtgcctgggtactgggacctcttctagctttgctccagaaatttggggaaggagtaaagacagtagcaattccagaggctccttgaagaggagttggggttggggaggataaagttaggtggtggttggaaatgggagagagcaaggagaaaactcacagtagctgctgtatggaccctgataccctgtacctctttccttgccctccaggtcctggagtacaatgccattggaggcaagtataaccggggtttgacggtggtagtagcattccgggagctggtggagccaaggaaacaggatgctgatagtctccagcgggcctggactgtgggctggtgtgtggaactggtgagaggggtagggcaagggagaagaagtttcctgcaatggtggtgacttgggtgggaaggggagggatgggcctgaaacttatttctgggttgtgtttgtgtttctttgtctctagtgtgctacggccaaatttagagtgaatcactccaagggttaactaatgtggggagcctcttttggcattaggtatgaagatggctgtagatagttgtagacagtgtggactggggcctcgagactgggcagagaggtgtcagctctttcctctgagcagaggatggctataaaagtgacagaggaggccgggcatggtggctgacacctgcaatcccagcactttgggaggccaagggggaggatcatctgagttctggagttcgagaccagcctgaccaacatggagaaaccccatctctactcaaaatacaaagttagctggatgtggtggcacatgcctgtaatcccagctactcgggaggctgaggcaggagaatcgcttgaacctgggaggcagaggttgcgatgagctgagattgcaccattgcactccagcctgggcaacaacagcgaaactccatctcaaaaaaaaaaaaaaaaaaaaaggtgacagaggtcttccaaaggctattcagaagcagagattgaaaactggcagctcactgacagtattttgaaaatgttttacaattaagtctcctaaatttaacaaagagatttcacactaaaacctagatttctagcatggcttgggaaattgtaagatttgggtccatgttcccgcatagcaacaattggctgaagctgagtggatgcaacttctgcaagacggcatgtgttctcctgtgtgctttctctagtttgctccaatccccacatccccttgtcttctataccagttcgtcttggtcttgaaggtgtctagtttgctggcatggcctaaagctttcattagtggcagggggactgggttctgggaggggtgccatgcccgaggagggtggcagtgagcccaaaagggaagagcattcagaacttggtgagtgacgatgatgctgagtgcctggcctgagaggagcagctggctcaagggaagacgtgctgagcacagtcagcccgggtacgttcttggtatgggtggagcaggtggatctgcctgtcctgtgggcggtggaaattccagtctggaacttgtcggggagatgggtctggagaatagagatttgcttccaaggaggtaataggcccatggcatccagggagagggccctggatgacagggatgctgaggggctgaggggttcaaaatatggagatgacaggcaaggaaggaagggaaggaggatgagggcagagcagaggagtaaagctatgggggccaagggaagcaagaccttgaggggccagtggttaactggtagaatcagttcattttttttttgagatggagtctctctctgttgcccaggctggagtgcagtggcaccatcttggctcactgcaacctctgcctcccaggttcaagcaattctcctgcctcagtctcctaagtagctgggattataggcacatgccaccatccctggctaatttttgtatttttagtagagacggggtttcaccatattggtcaggctggtctggaactcctgaccttgtgatccatctgcctcgccctcctaaagcgctgggattacaggcgttacaggtgtgagccactgcacctggcctagaatcagttcttaaccctagcagcaccctagtttcacctgtaagtttttaaaaatttttaattttttttttttttttgatacagggtcttactctgttacccaggctggagtgcagtggcatgatcttggctcactgcaatctctgcctctggagcggaagccacccttccaccgcctcagcctcccaagtagctgagactacaggagcgagcctctacttggctttttttttttagagactaggtttcaccatgttgctgaggctggtcttgaacttgtggcatcgagtgatctgcccatctcggcctcctaaagtgttgggattacaggcgtgagccaccacgcctggtctaaatttttttttagagacaaagcctcattctgttgcccaggcttgagtgtagtggtgcaatcatggtgtactgtagcctcgacctcctgggctcaagcgatccttccacctcagcctcccaagtagctgagactacaggtgcctaccaccacgcccggctttttaaatagttttttggtagagatggagtgtcactatgttgcccaggctggtcttgaactcccgggctcaagtgatctgcctgcctcggcctcccagagtactgggataacaggtgtgagccactgtgcctggcctgggttttttttttttttttaatttccctaataaatagaaagtgctggtggggttaagaatcagtgctaggaggcagaggaaatttggggaggccatggaattaattatcttggagaccatcatggttgagtggtggtggctgaaacaagattgtccttgcagtcacccttgggagaggcagtgaatgggtggcttcagggaaaccatgctactccaaataaacacagagtcaattaaacatgtgcctttgatgtggaaagcccaggacctccacactactcttctgagtttaggtcagaggtaaagatgcagatggatgcctccttccctgaggaccctgcctataacagcagtgattgcaacggtcctttccccacggcccatgctgggctctggcaggcggtgttgcatgcttcctttgcaatgtggatccactacagcacacaggattaggatgggataaagtcttaaaaaccatgtcttctaggccaagtgtagtggctcatgcctgtaatcccagcactttgggaggctgaggcaggtggatcacctgaggtcaggagttcgagaccagcctgaccaacatggggaaaccccatctctactgaaaatacaaaattaggctgggcgcagtggctcatgcctgtaatcccagcactttgggaggctgaggcgggcggatcatgaagtcaggagatcgagaccatcctggctaacatggtgaaaccccgtctctactaagaatacaaaaaaaatattagccgggcatggtggcaggcgcctgtagtcccagctatttgggaggctgaggtaggagaatggcgtgaacctgggaggcggagcttgcagtgagctgagattgtgccactgcactccagcctgggcaacaagagcgagactctgtctcaaaaaaaaacaaaaaacaaaaaacaaaaaaaaaattagccaggcgtggaggcacatgcctataatcccagctactcaggaggctgaggcaggaaaatcgcttgaacccgggaggcggaggttgcagtgagccaagatcgcgctattgcactccagcctgggcaacaagagcgaaactccatctcaaaaaaaaaaaaacacacaaaccatgtcttctgctcaagcctgggtgacagagtgagatcctgtctcaaaagaaaataataataaaaattaaaacctgggtatagggccgggtgcattggctcacacttaaaatcccagcactttgggaggccaaggtggatggatcacgtgaggtcaggagttcgagaccagcctgaccaacatggtgaaaccttgtctctactaaaaacacaaaaattagccgggtgtgatggcacgtgcctgtaatcccagctacttgggaggctgaggcaggagaatcgcgtgaacccgggaggcggaggttgcagtgagccgagattgcgccattgcactccagcctggacaatgagagtgaaactccatctcaaaaacaaaaacctgggtatgtatctagaagtggaaaaacaaaaaaaggaaataagttatgaaaataaaaaccatgtcttgagctgggtgcgctggtgtgtgcctatatccctagattctcaagagttgagacaggaggatcacttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaatttgggaggcggaggttacagtgaacccacatggcgccactgcactccagcttgggtgatagagtgagactctatctcaaaaaaaaaaaaaaagaaaagctatttaaggaaccaaaacatagtttgactgactgcaagaagtatcacagggaatgttagagtgttttattaatttctttgtcagacaagtgtttaggaaactctcactccaggcctaatgctgtgctaggctctgcaaatgctaagagggggaagttactgtccctgcttccaaggagatcatggtctagtgggaaacccgacacgttcaggtaccttcagatgggcactcagaagagtaagcccttagttaatgtttaaagatgtttaaagatgtctgagactcataggtcaaagtcagatttcagttccaccttattagacctgcactgctaaggagctgctttaggtaaggctgtgttcctagtcaccagggtgttcaaacacagtgctgggggcaatgtgggaatagccttcttttatttaggaagtaatgtgaagtcagtttcatgaatagatcttactttaagcattcattgaggtttttggcaagaatagagtacggtatatgaaggtgtttcctaatctccctgacaccaggaataatctagggctcattagagatgtcaaagatctgttctagtttcttaacctaaaacaagagtgttttagttccattttataggcggggagtctgagccaaacatgttatgtcactttccaagtctccatagcacagaagtcttctgtctccccatcctgactttcccagctcatagggactgtcaaaggcagcagctctggccggctgtgatgcctcatgcctgtaatcccagtaatttgggaggctgaggcaggaggatcatttgaacccaggggttcaaaaccagcctgagcaacatagtgggaccctgtctctacaaaaaataaattaaaaaaaaaaaatagccaggcatggggtatgtgcctatggtctcaggaactcaggaagctgaagtgggaggatcacttgagcctgggagttagaggctacagtgagctgtgattgcaccactgcactggataatagtgagactctgtcccctaccaaaaaaaagcaaaactatatacagatataaagtagcagctctgttgctgatagaaggaacagtaatgaggagccctgcaggtcttattccactctttctagctgcaagctttcttcctggtggcagatgacatcatggattcatcccttacccgccggggacagatctgctggtatcagaaggtaatgtgggcaggaaaatagcagtgggtatggggacaggccacagggaggtggttatatatggcctggttgaggtgttggggtgatggctcttagtatgaaccgagactagagattgattgcttgtttttctgtctgtcatgacagccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcagggtacaggattgcagcgtgcctggaagggaaagaaagcgaggaagggtgttgggaagtggggttgtggtagtggcaagaaagggcttctctgtcctgtgtaattggaagaaagggtgataaaggactgtgtgtatgaatatgggccttaagttttggggctttctccccttctgttgcctttctgattctgcccagttgtcagctggtatgggatgttgggcttgggataccagggtttcgcatatctggagaaagcctggctcatggaccgtctttgtcttgcttagagttcctatcagactgagattgggcagaccctggacctcctcacagccccccagggcaatgtggatcttgtcagattcactgaaaagaggtgaggggaggtgagggacagcgcgaaccatgtctggacagcgagggagggctcaggatgtgcattgccctcctgaggagtttctcttctccccttactcaggtacaaatctattgtcaagtacaagacagctttctactccttctaccttcctatagctgcagccatgtacatggtgagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaggaaggtggatcagaatgacttggggactgacatttgtgagggaagagacaggctgtgcacctctagaatggattcatctcttttatgactcccaggaaggcctagccaaaaataagtgggattgaggttggaccatcagtcaggactgtctaggtcagggaagccaagatgtctgaagagagaggaaagatttggggctgcagtagggcaagaccccatgggaggaagcagccaggaagatgccggcacccctggggtttggcttattaacccccctttccctgcaggcaggaattgatggcgagaaggagcacgccaatgccaagaagatcctgctggagatgggggagttctttcagattcaggtaagaaggcaggaggcagtagcagagaacaggcaccagcttcactcctcctctgcccaggaacctcatccttcctcttttgctgccctccccctccctgcccaggatgattaccttgacctctttggggaccccagtgtgaccggcaaaattggcactgacatccaggacaacaaatgcagctggctggtggttcagtgtctgcaacgggccactccagaacagtaccagatcctgaaggtgcctgagagagggtggtgggtccctgagttggtggaaagggatagagcagtggttctcaactagaggcagttttcctcccgaggggacatttggcaatgtcagcagacattttttgccattgtcattacaactctgtgtgtgtgcatgtggtacagacatctagttggcaggagccaaagatgttgccaaacatgtagtacacagaacagctcccccagacaggattatctggtcccaaatttcaatagtgccaaggtggagaaaccctggagtagaggatgcctggtatgaggcaatatttgggatagggaagggaagcttgggattttagctacgtagagacacttgaaaattggagggaggaaaggagtgggtggctttggagatgttctggaatatgtgaatgaggggagtggaggggtcctggaggctctggggaaggccaagcccgttttcctgtctttcaacctcttccaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttcttgtggttctgttcttgctcggcccagccagagtctggctctttccagaatgtgcagggtggggtgctgggaggactcgctgcacggaaccaggacccaggggccaaaagcttaggatatatcaaaccctctaggtgggtgacaaaagacgctaaacgctgggggcgggtctgagctacgccacgcccatgcgcgaaggggtgcagctgcgcagcgcagggtaggttgtgctagtgcccctcccctcccgctctgtgccccgccgggcggggaccgtgggagccgcggacaagcccaaggccggagcggttccaggaggaccctggtgaggagggctcggcccatgggtgtagaccgatggacctgggcacgaggggcggggcaggacaagggagcaggagaaatgaatagagaaagggtgcggtggtggctgaacgatggagacgaatgcggagagaatggacataccgctgttccgaggggcgagggcgcaggctggagcccggccgaggcagccagcagatgcggagttgacaagctgacggctgctccatccttttcctctccagcccccacccctttcctgcattcaccagacaaactctgcgtattgccccacccccatcctccacctcctttcagggcatctgggtgggtctccctgggtcccttcctctgggagtaaggggtaggctggagggcagggccagattgcggcagcagggacctggaggtccattctgggcccggacctcttccaggcccccgccccccttcggagatccagagcgcagccgcgttctctgaccctcccggctccattcccggggggttacattcgactccatctgcaaacactgcagtggaaactaatggtcagtcgattgcgatttgcatctcattgaaatatcttccaaagcagccagagccttcaggcctgctgctgccgtcaagtcacctcggtgtccttccccgcagctcttgtcctcactggccgggcttcaccacctctgtcttctaggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggagg

SEQ ID NO: 17202 - DNA, 189560 bp, Human
  misc_feature (1)...(189560): n = A,T,C or G
agtacaggcatgagacaccatacccggccagtaccttttattgagccctcgctatgtgccagtcattgggcgaggtattttacttacattccttgtagaagtcataagacaactattttttcccttgagacagggtcttgccctgttgcccaggttggagtgcagtggcttgatcacagctcactgcagcctcgaccttcaaggttcaagtgatctcccacctcagtctcctgagagctgggactacaggtgtgtgccatcacaccctgctaatttttgtacttttttagagacaggattttgccatgttgcccagtctggtctcaaactcctgggctcaaagagtccacccacctcagtccctgaaagtgctgggattataggtgtgagccaccatgcctggccaggaatcttactctcttgttgtaatgaaaagtctcagggcacatcgtttaaaatattctacttcataaatggaactttctaagggataagatgttctccgttttccagatactagttctagatcttgactcagacatatgtttgacatgaagactagtctgtcagtcttcaagaatactgacttgttttgttttggttttattaatatattcactagtctctggctgggcacggtggctcacacctgtaatcccagcactttgggaggctaaggcaggcggatcacctgaggtcaggcgttcaagaccagcctggccaacatggtgaaaccctgtctctactaaaaatacaaaaattagccgggtgagtatggtggcttgtgcctgtaatgccagctactcgggaagctgaggcaggagaatctcttgaacccaggagacgcaggttgcagtgagctgagatcgcgccactgcactccagcctgggcgacagagcgagactccatctcaaaaaaaaaaaaaaaaaaattcactaatctccctaatgattatatggtaatctggtttcctgaggatctttatatttaaaatgggagtgctttgtggagattctgagattaggtgtatcacctattgtaaaataataaattagcacgctagttttaaaacattttgtgtatttggggaattgacacatgcctactatttgctattaggaaaacttgtaaaaataaattgctgatttttaaggttcttataacaacagtgattatttgtataaatatttgcttaatgtttgcccttctcactagagtataaaccttaaaatttaggaactgggttcattttgttgaatactgtattttcagagtgtagcatgatgcctggcatatgatagatgtttggaaatattttttgaatggacaagtgaatgattcagagttgaattgtatcctaacaacaaagataatatctgcataagttcctgcatcagagagtcctaacctcaaaaagcctgataatctcttctaaaagtttggaatactgaaaccagcctaagagataatttaaaaagaatttttataggtacatagcgtgtttaaatatttatggggtgaacgtgatatgttgatgcaggcatacaatgtgtaataatcacatagtcaatggagtatcaaaaaaagatgattttttaccttcaataaaactgtaggaaataaaagtgtacttcagcagaagagtggggaatatattcttttaaaactgatgagtgcgaaaatatatgaaagttattttgattttaggcaatgtttgcttgactgtaagtttcagaagcttcttggtgattcttaaatttgcatttgcaccataccactatggcttgtttatgatatctgtagaatgataaacttattctgaattttaaatgtatttataactaaatggatttacatctattttgaattaacatttcgatctaactgtgatttttttttgggtagttgttgacctccttgtcttcccctatacccattacttatgttaatcagtagttgcctcttttctgataaatttttgttatgatctgttctgcagagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagtaagtagaattcctaacaatatgtggttattgacaatattttcatttccctattaatttttatcctatatatgtatttccgggagtttgattttaatctatgttatttccagatagtttgtttttgtgagccttaaaataagccccaaggcttgtcaaagatgtaagttaatagcataaccatgtatgtatttgtacttgtaaaattattttaaaattttatttatttatttttttgagattaagttttgctcttgttgcccaggctggagtgcaatggtgtgatctcggctcatggcaacctctgccttctgggttcaagcagttctcctgcctcagcctcccgagtacctgggattacaggcacccaccaccacaccgagctaattttgtgtttttagtagagacggggtttcaccatgttggccaggctggtctcaaactcctgacctcaggtgatccgtccaccttagcctcccagagtgctgggattacaggcatgagccaccacgcctggcctatttatgcagtttttaaaggcaaaactccaaagtgctgggattacaggtgtaagccactgtgtctgaccgaaaaaagagaaatctttattgagatatgattcatataccatacagtttgcccatttaaattcagtgatttttagggtatttcattattagctttaaaaatttatgtgaaatcatttctttctttctttttttttttttttttttttttttgagatggagtcttactctgtcgcccagactggagtgcagtggtgcgatctcggctcaccgcaacctccgcctcctgggttcaagcgattctcctattctcctgcctcagccccctgagtagctgggattacaggcgcccaccaccgcacccagctaatttttgtatttttagtagagatgaggtttcaccatgttggccaggctggtctcgaactcctgacttcaggtgatccagccacctcagcctcccaaagtactgggattacaggtgtgagccactgtacccagccaaaataatttacttctaaacctttttcattatcccaaattaaaactccataaccattaaataatgtcttccatttcttctgtctgcagcgactggtaatatcgaatgtacttgccgggcgtggtagctcacgcctgtaatcccagcactttggcatgctgaggcaggtggatcacctgaggacaggagtttgagagcagcgtggccaacatgatgaaaccccgtctctactaaaaatacaaaaaattagccaaccatgatggcaggtgcctgtaatcccagcccttgggaggctgaggcaggagaatcgcttgaatccaggaggcagaggttgcagtgagctcaggttgcgccactgcactccagcctgggcaatgaaagcgaaattccatctcaccccccaaaaaattctaatgtacttttagcaactataaatttgcctatcctagctaactcatataggtgtaatcatacaatatttgttattttgtgtctggcttatttcatttaccagaatgtcctcaaggtgcaaccatgttgtagcatgtgccaaaacttcattccttttcatggctgaataatccattgtgtggatataccactttatttttatttatttatttatttattttttgagttggagtttcactcttgttgcccaggctggagtgcaatggcgcgatctcggctcactgcaacctccgcctccagggttcaagcaattctcctgcctcagcctcttgagtagctgggattacaggcgtgtgccaccattcccggctaatttttgtattttttagtagagatggggtttctccatgttggtcaggctggtctcaaactcctgtcctcaggtgatccgcccacctctgcttcccaaagtgctgggatgacaggcgtgagccaccacacccagccaccattttattttttatccattcatctcttgatggaatcttggttcacatccactatttggctattgtgagtaatgctacagtgaatgttgccatacagttatctattcaagttcctgctttgaatttttgggtatttacttgggaatagaattgctgggtcatacggtaattatttatttagcgctttcaggaactgtacacttttacagtggctatactgtttcatatcccatcagcaatgcatgagtttttgatttctctgagtcttcatgaggttttcttaatttttcttccctccctccctccctccattccttccttcttttctttcttccttcctctccccgtctcccctctacctctcctgctccctgtctctgcctctccccctctcttccctccccttccttttgttttcttccttcccttctctctctttccttcctcccaccgcccccccaccgcccccgttctcaagctgtagcacattgtggtttttgatttgcattttcttaacaactaatgatgttgaacaatttttcatgtgcttattggccatttgtgtatcttctttgaagaaatgtttgttcaaattatttgactacttttgaattgtgttttgttgttgaattgtccaggttctttatataatctgtatataggattttaaaaatattttctctcattctgtggatagtcttttaatttccttttgtgtcctctgatgcaaaaaaaagttttcaattttgatgaaaaccaggtccagtttattttttcctttattacctgtattattagtgtcatagcctagaaatcactgccaaatccaatgttgtgaaagtcttccccctatgttttcctgagggttttatcgttttagctcttatgtttagatctgtgatccgttttgtatttaagttttgtatatggtttaaagtaagggtccagcttcattcctttacatgatattcagttttctcagcatcgtttcttgaagagagtatcttttcttcattgaatggttttggcaactttgttaaagaaattattgggccgggcgtggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaattattggccatatatgtgagagtttattttaggactcttcctttccattccattggtccatatgtctgtctttctgcaagtaccacactgttttcattactgtagctttgtagtaagttgtttgtttgtttgtttgtttgtttgttttagatggagtcttactctgtcgcctaggctggagtacagtggcatgatctcggcttgagaccgcagcctctgcctcctgggttcaagtgattctcctgcctcctgcctcagcctccctcccaagtagctgagattacaggtgcctgctaccacgcccggctagtttttgtacttttagtagagacagggtttcaccatgttggccaggctggtctcaaactcctgagctcaaatgatctgcctgcctcggcctcccataatgctgggattacaggtgtgagccaccgtgcccttcctgtttgtttttaaagagagagggtcttgctccgtcatccaggctacgctactcactgcagcctcaaactcctgggctcaagtgatcctcctgccttggtctcccaaagtgatgggattataagcatgagccatcatggctggcctgtagtaagttgaagtcagaaagtgtgagtcctccaactttgttatttttcaaaattgttttggctatttggggttccttgagattccatatggattttaggatggggttttctgtttctttaaacaataatgttgggattttgatagaaattacattgaatctacagatcactttaggtagtgttgtcatcttaatatgaagtcttgaaatccaggaatgtgggatgtcttttgtttatttaagatttccttaatttctttcagcaatattttataaaatttgtggtgttcaagcctttcacctccttaaatttattcctgtgtattttattttttgatgctattgcaaccagaattgttttaaatttacttttcagattgctcattgtaaatatatagaaatacaactagtttttttaattattaattttaatttttttttagagacagggtcttgctgcccatgctggaggggcagtggcattgctcattgtagccccaaactcctggactcaagcaatcttcctgccttagcctccttttgtttattttaataaaaaaaaattatttttgtagagatggggtcttgctgttttgcccaagctggtcttgaacttctgacctcaatgattctccttccttggcctcccaaagtgatgggattacaggtgtaagccactgtgttggccacaactgattttggcatgtaggttttgtatcctgcaactttgctgaattcatttattagcttgaacaatttgttgatgttttagggttttctacatataaaactgtgtcgtctgccaacagagataattcagtattttaatatatgcctcaggtatttcttacattccagcagatttgggaaacactaggtttacttactgtgaaatgagagtaggttattttctgttcagtgagttagctactgaaaatagtgttcttttgtctactgaaatattatatataatttttttcatatttttaaaattataaactcccaatggccattactgaataggttacatacagtgttttgaatgtggtcaagcaacctctttagtggtccttaccggtagaagaacttaaacaactagtatactgaaagtagtagttgctggtactatagcaggaagacaaaagaagaggaaaacagaacgatagaaggcagtgtaagaaacaagaggaaaggatgatgataaagtgccatcaggctacctcaaaggataaagttttctgtccataatccatgctagtatagtatgtaggctaatctccgagttatattgatatatatgtatatatagattggtgcaaaagtaattgcagttttgggccatgcatttttttttttttttttttttttaaggcagagtctccttttgttgcctaggctggagtggagtgcagtggcttgatctcggctcactgcagcctccgcctcctgggttaaggcaattctcttgcctcagcctcctgagtagctgggattacaggtgcttgccaccatacctggctaatttttgtatttttagtagagatgaggtttcaccatgttggccaggatggtctcgaattcctgacctcaggtgattcgcctgcctcagtcttccaaagtgctgggattataggagtgagtccctgtgtccggccattgaccatgaattttaaatcatcataactaggctcaaacacatctttattaatcaaaataggaaccattacaataaaagtttgtgccaaaaagaaatcagtttgtttaatcctgtagcataaaaatctgtgcttctggattcaacaaactcttgggaaggattttacgcatcctgctggttgtggaagctgtttccctgcaaaaaattgttgagatgcttgaagaagtggtagctggttgacgagaggtcggttgaatatgtcaggtgaggcaaaacttagtagtccaattcgtccaacttttgaagcattgattgtgtgacatgtagtcaggcgttgtcctggagaagaattgggctctttttgttgatcagtgctggcggcaggcattgcagtttttggtacatctcatcaatttgctgagcatacgtctcaggtgtaatggtttcgctggcatttggaaaggtatagtggatcagactggcagcagaccaccaaacggtgaccatgaccttttttggtgcaagtttggctttgaaaagtgctttggagcttcttctgggtccaaccactgatctggttgttgccggttgtgatataaaatccactttttgtcacacatcacagtctgagaaatttttccttgttggtgtgtaaaatgccgaatgactgtagaatggttgaagttgccgagttcctcggcaacttctcgtgtagttaaaagaggatcagtttcgatgattgctctcagttgttgtgagcttctgacagccagccactgtgcttcttatcttcaaggctcttacctcctttgcaaaacttcctgaaccaccgctgtactgtacattcattagcagttcctgggccaaatgcgttgttgatgttgcaaatcgtctccactgctttatgacccattttaaacccaaataagaagatcgcttgaatttgcttttagtctaacatttccatagtctaaaataaatataaatataaatataaaataaacagcaagtaatcattagcaaaaaaacataaagtgagaaatgcgcattaaaatgatatataacataaccacatttaagaacgtattccaatatcaagtggcaaatttcaacagtgcaaaaactgtagttacttttacaccagtattacctgttttatttatagtttataacaattatatagttttaaaaaataaatgtgtgtatatgtatgtatatccgtatatataaactgtggtaggctgcatataacctgaactttttccattttaaccatttgtaagtgtataattttgtggcattaggtagatgcactttttgtgcgaccatgcccacccaccagctctggatctttttttgacattttccagctgacactctattaactcttcattctccctcctgcagcccctagcgaaaccactattctactttctgtctttgaatttgactactgtaattaccacatataagtagaatcatacaatatttgtccttaggtaactgccttatttcccttagcataatgtcctcaaggttgtccatcttggagtatgtcagagttgctttcgtttttaaggctgaataatattccagtgtatgtatataccaaattttgttcattctatggatatgtcagattcagaagctgtttgtgaatttttaggttaatgtgattgtcaactattaatttctagatttgttcagctattacttttctgggtagtattttactagataagttaatctagtccatctatggatggccactggtattgcttccagcttttaacagttgtgactaatgctgaacatgtgtgtagaaatatctgagtccctgctttcacatcttttgggtatgtatatatgtggaagtggaatttttggtcgtattgcaatttttttggtaagagattgggtgtcgctgtgtcacccaggctggacattgtaattcttttttttttttttttttgatacaggatctcactcctgttgccctggctggagtgcagtggcataatcacagctcactgcagccttgacctcctgggctcagatgattctgccatctcagcctcttgagtagaccggctacaggcatgcacaaccactcctggctcattttttgtatttttagtagacatgggggtttcaccatgttgcccaggctgatcttgaactcctggacaggctggacagtctgtctgtctcagcctcccaaagtgctaggatttacatgtgagccactgtgcctggctggggcattataattctatgtttaattttttgaaagaattaccatactgttttccacaggggctgtacaattttacattcccaccaggaactcacaagtattctggttcttccacatcctcggtaacagttattctgtatttttaaaaaattatagccatcctaatgtgtaggagttactcattatatttataatttattattatatatctatagttttgtttgtttgagacagcatcttgctattgcctaggttggagtgcagtgatgtgattaggctcactgtagccttgaccttgacctcctgggctcaagcaatcctaccgcctcagcctcccaagaagccgcggctacaggtgtgtgccaccacacttctaatatttttatattttgtagaaatgttgctccttatgttgcccaggctggtcttgaaatcctgggctcaagtgatcctcccatctcagccccccaaagtgctgggattacaaggtgtcagccaccgtgccagtgagccactgtgcccagcttgatatgtgtttttttgttttttaaacataagactaatcgcagcactttgggaggccgaggcgggtggatcacttgaggtcaggaatttgagaccagcctgaacaatatggtgaaaccccatctctactaaaaatacaaaaattagctgggtgtggtggtgagcacctatacccccagctactcaggaggctgaagcaagagaagctcttgaacccaggaggtggaggttgcagtgagccgagatcacactactgcacccctgcctgagtcacagagtgagactccatctcaaaaaaaaaaaaaaaaaaaaagtctaagatcctttgcctttctttttttttaaaagacagagtctcactctgtcacccaggcttgcatgcagtggcgtgatctcggcttactgcaacctctgctgcccaggttcaagccattctcctgcctcagcctcccgagtagctgggattacaggtgcatgccaccacgccctgtgctgcgcctggcggatcttttgcctttctactttatcttcagtgctccaaaagaagcagccctggaactcctattgagattgtgataaaggattgtgataaaggatagtattttctcctttactgaccatagggaaataagagaataagaaacaatcttggctgggcacagtggctcacacctgtaatcccagcactttgggagacccaggcgggtggatcacctgaggtcgggagttcgagaccagcctgaccaacatggagaaaccctgtctctactaaaaatacaaaaaattagccgggcgtggtggtgcatgcctgtaatcccagctacttgggaggctgagacaggagaatcgcttgaacccaggaggaagaggttgtggtgagccgagatcccggcattgcactccagcctgggcaacaagagcaaaactccatctcaaaaagaaaagaaagaaacaatcttgccgggcgtggtggctcacccctgtaatcccagcagtttaggaggccaaggtgggtggatcacaaggtcaagagatcgagactatgctggccaacatggtgaaactctgtctctactaaaaatacagaaattagctgggtgtggtggctcacgcctgtagtcccagtgactcaggaggctgaggcaggagaatcacttcagcccgggaggcggaggttgcagtgagccgagattgcgccactgcactccaccctgtctcaaaaacaaacaaacaagaaacagtcttggtttgttcatgaaagaatcttgatttgtttgtgtcctactcttaattgtaataccttgttaaggaataattgacagtggattgaagtttggaaagtctccagagagggaataaaacctcagaatctcctgaatctagaaaaacattgttaagtatatcaaactgcagtgatccctgtgggaattttgtagtttcagtgtagtgaagatggctaatgaattagactcaaaaatagaatgccacatttagattactgttctaatgtttctttgcataaactttggttccagtgagttcttaactgtggtggtgttttgcaaacaaagggaaacctgaagacattttcagtatattcgtcttctttatttcctttaagaaaaggttattctgcttgatgatttatgtatcacatatcatggatggttaatgcatagtatgttatgtcatatttcatacttttattacttggaaatttttattttaaaatgtcagactcatatttgaggttcaaaagttgagaatttttaggttaataacatgattttcaactgtcaatttctagatttgttcaggtgtcatttttctgggtaatattttgctatataaaagttaattatctaatcagtttactttcagtgaaaatttttgttctgtatatgtttactgtggcttccatcagcctattttagttaaaaaacaagacttaattttagctgggtagtctgggtgacagagcgagatcctgtctccaaaaaaaaaaatgtgttttcaggttcatcttcgcttggagaatcatatcacattaagaataaattgttgggaatcaaagttggtacaaagaaacttccagaagagtaactccaacattgctatctttggtatcttccagaaacatatttgcacttacaaaccagtatgcatcccctacatacatgttctttccccattttaaaatgtaaatagtagcacactgtacctactgctctgtatcttttttctattaaatagtatatactaaagatttttccataacaagactatgagaacttctttagcccttggaaatgtggcttatataattttttttttttttttttttttttttgaggcagccttgctctgtcgtccaggcttgagtgcagtggtgcgatctcggctcactacaacctccgcctcccgggttcaagcttttgtcttgcctcagcctcttgagtagctgggattacaggtgtgcaccaccacgcctgggtaatttttgtatttttagtagagacagggtttctccaaattggtcaggctggtctcgaactcctgaccttgtgatccgtccgcctcagcctctcaaagtgctgggattataggcacgagccgctgcgcccagcatataattttctttttccagtttgttatttgtctttagactttggttatgttattttgccatgcagaaatatttagctttttacctgatgtaatttataaatctttttaaggcttctggatttttgacgtgtcattagaaagaccttcttccttcgaagtttataaaagatttccttatgttgttttgcagatctttgtagtgttttgttttttaacatataaatccttgatccatttggagtttgttatggtttatgagttatggttccaaatttatctctttccaaatggctacatggttgtcccaacacttattattattattattatcatttgagatggagtctcgctctgtcgcccaggctggagtgcagtggtgcagtctcggctcactgcaacctctgcctcctgggttcaagcagttcttctgcctcagcctcctgagtagctgggattagagacacacaccatcatgcccagctaatttttgtatttttagtagagacaggctttcctcacgttggtcaggctggtctcgaactcctaacctcaggtgatcggcctgctttggcctcccaaagtgctggggattataggcgtgagccaccaagcccggcctcaacactatttttaagaagtccatctttacttctctgatttgagaggctgctttgtcatacactgaatttctttatgtacttggttctagtctgattttccttttagtatcaatgatgtttctgtttatttacattttttgtttgtttatttttaagagtctgagtcttgtcttttttaaccaggctgtggtgcggtggtgtgatcatagctcactgtaaccttgaactcctggggatcatcctggggatcaagctatcttcctgtcccagcctggcaaatcattaggattacaggtgtgagccatggcacccggccaccatgatacagttttaagtattttgttttataggtaggactaatccatcctcctaacttgtattttagtgtgctccctgtacttttgcctattaatttataaacaatgtaatttcagtgaaaataattttttttttctagaatgtggctgattataaagtttgtatattgttcatctttatctgtggttgaatttggagcctaatttgatgatgactactttgagaggctttgactttagttttccaggagttagggtacgttactgacacctttcctggggtctctattttgcccctagcgcatgacttgatgcacttacccactgtattattgtgcctatttaggtcagccctttttattcttttcttttggtcctgttggagcttcttcttactcctatgaggcagcagtgtaagaaacgtattttatgctggtttgagttattttgttgtaatagaagactcttcacagtatttagcgtagcatattgctctaagtagaaagcccctgattgttttataagaaataatgttcattattttatttttacttttgagactagagtctcactgtgtcatacaggctggagtgcagtggtgcaatcttggctcactgcaatctccgccttctggggttcaagtgattcttgtgcctcagcctcctgagtagctgggattacaggtgaatgccatcatgtctggctaatttttgtatttttagtagagatggggttttgccatgttggctaggcatgtctcgaactcctggcctcaagttatctgcctgccttgacctccaaagtgctaggattacaggcatgagccaccatgcttggactcattattaattttatagcaggttttcctgttttcttttttcctcccaagtggaaagaaaaactttcttgtaatttttctctaaaaatttatgtttggctttgatgcagttacatgtggtgtctgccatttcataagctgtcagaatggtacattcatttttctacagcagtattttagaaagtgaaagtagagatggaagtcacaatatttacttgtatttatcacacagtaacttaaaaggagatggagcaatggtacatttctttccagcatttaaagaaaattccgtttttggagttacataatacgtgattgtagttcatttagtatgcttagccaaaaaaaaaaaaaaagtcaagtatacaagcttgcaataaaaagttctactatattaggaagtcagagttgaggaggtacacaaaggcatcttggcaaaaatgcacaaatggtggatacataacattttttaagagacacggtcttcttctaaagaggcagtctgttgcccaaggctgtgcagtggcatgatcatggttcacagcagtcttggctcccatgggcttaggtgatcctcccgtctcagcttccggaatcactaggaccacaggtgtgtgccaccgcacttggctaattttattttattttttatagagacagtgtcttgttgtgttgcccaggctgttctcgaactcctgtgctgaatcgatcctcctgccttgtcctcccaacatactgggattacaggcgtgagccactgcatttggtcatatcattataccatgtctcatgattatgatgagcagattacgtattagtcaaatagcattgaaatttggtgctttgttgactaacatttttgtcattggatagtttatttgatgttactttagtctagatgagtggatttcatgagcacaatgaattacaagtaaaatttatagccataattataatttccagtccaaaaatggttttctgtttagaaaagaaaattctatgccatcttaatagatttaagaagcagttcgttgaagaaataattttgaatttcagtgaagcgtttttttttttttttgagacggagtttcgctcttgttggccaggctggagtgccatggcgcgatctcggcacaccgcaacctccacctcctgggttcaagcgattctcctgcctcagcctcccgagtagctggcattgcaggcacgcaccaccatgtctggctaattttgtatttttaatagacagggtttctccatgttggtcaggctcatttcgaactcctgacctcaggtggcctgcccgccttggcctcccaaagtgctgggattacaggcgtgagccactgcgcctggcctaagtgatttttttggagaattattattactttttaaacaaaatttgataaagttaaatatttttcttttttgtagaaacagtctggctatgttggccaggctggtcttgaactcctggggtcaaacgatcctcctacctcagcctctcaaagtgctaggattacaggtgtgagccaccatacccggctgagaattattaaaacccacatgaatccaagtattagacttaaagcctgtcctggaatttaaaattttataatgctatataactggtagattaatgtttctttttcttttttttatttgagatggagtctcggtccattgcccaggcagttcagtggcataatcttggccacactgcagtctccacctcccaggttcaagcagttttcccacctcagcctcccaggtagctggtactacaggcacacgccaccatgcctggctaatttttgtatttttagtagagacggggttttgctatgttggccaggctaatcttgaactcctgacctcaggtgatccacccacttcggcctcccaaagtgctaggattacaggcgtgagccaccgtgcccagcctaatgttgtttcttaaataagaaaaatggataataatagtgccttagttcttgctcggtagagattatttgcctggcagtttttaaagtgctgcaaacaagttccaattattttgaaatagagttgttggaaaaaaattggtatgacattacctaggttttggatttttttcctttgtatttgttagataataatagtgtattaacatatacaccaaggaatactatgcagccataaaaaagaatgagttcatgtcatttgtagggacatagatgaagctggaaaccatcattctgagcaaactattgcaagggcagaaaaccaaacactgcatgttctcactcataggtgggaattgaacaatgaaaacacttggccacagggtgggaaacatcacacatcggggcctgtcgtggggtgggggcaggggggagggatagcattaggagatatacctaatgtaaatgacgagttaatgggtgcagcacaccaacatggcacaggtatacatatgtaacaaacctgcacgttgtacacatgtaccctagaacttaaagtataataaaaaataatgataataatagtgtgttaggttttctagataataatagttcctttaaattataccctattttaagttagcccagttttctataaaatgtatatattttaaattgagatataattcaaatactgtaaaatttatccttttaaaatgtacagttcagtgtttttagtatattcagtatgttaagtgtatacagagttacgaaaccattattaataattttaaacattgtcatcttaataaacattttcatcttaaatttgtatctttcgtgtgccttttatacttaaaataactgatcaaaaggactaatattttgatttatactttcacaaaggaggttacagttttatatcacttaactttgcccatagtctctagtgcagagtcacaacattctttgatttgtttttccacgtgctgtaaaaaaaaattgtgctatgacatgataactgccatgatagaaatacatacggagtgtatatgtgaatcgcagaatcattggagaaggtggtgagcaagagaatatgcaaagaagggctcatgcttaaaattaggtgttgacaactttgtcagaatttgctggaaagagaaaggcttttgggacaaagtaaataataaagggaaaatgcacacttaggatgtctcacagggttttctcagttgtgctgtaaaacaagaatttgacagttctttactgtaggtaaatagtaagaaaatataaataatgaggccgggcgcagtggaaaaaaacaaaaagaattgcatgaccatacttattttttcttaggatttttctttggttttttgtttgtttgtttgtttttaagtttgtggtcctactttgtagtaggattcctcttagaggaaaaattaaaagataaaaccacttttttggactatttttctgtttcagaaatttgggtttgctttggtaagtaggggccctgtcatttatagctgtaatggtaaatctttttttttttttttttgagatggagtttcagtcttggttgcccaggctggagacaatggtgttatctcagctcactgcaacctctgcctcctgggttcaagagattatcctgcctcagcctcccgagtagctgggattacagttgtgtgccaccatgcctggctaatttttgtatttttagtagagatgcggtttcaccatgttggtcaggctggtcttgaactcctgacctcaggtgatccgactgccttggcctcccaaagtgctgggattacaggcctgagccaccgcgcccagccagtaaatactaacaaagtcagataagtacctgacttttattttacaaatatgtgcataattaatagtgaactaccctggtcttcatgagagagtgaaagtcaagctatataatattggggcagattcgtagagcttctttatcttacagaactgcaacagcaggtggcattagagatcaggtttaagggtgagttgcaacgtatttttaatagttgccactattaggaagggaagtaacacatattggggattcagggtacaactggcaaagctcagcttgacccttgggtgttgctgatctgttagaagattctccgtatgtgtatatatttttttaaactaaccactaaaaaatatagcaattaagaattaccttccaagaagaaagggaaaataatgttttatgtctaatacctacctttccatatcccaaactaaacagttgaaaaataagagggtgtcatccagggcctacttaataacgtttaccttttctttacaaatgaatgtcattttgcaccagcagatgccttatgtcaagagttatgggctggacatggtggctcccacctgtaatcctagcacttagggaggccagggtgggtgggtggcttgagctcaggagttcaagaccagtctggcaacatggtgaaacccccctgtacaaaaaatacaaatgttagccaggcatggtggcttacacctgttgtcccagctactcaggatgctgaggcaggaggatcacttgagcacaggaggtcgaggctgcagtaagttgtgttcatgccactgtactgcagcctaggtgatagagagatgaagtggaatatatgattggataaggacttacagggaagagggtggtagtttacatattaactgtggcttccctggaactgcttaatgtaaatacggatctttctataatctggattatgcatactaatgctttagtttctctaaaatcaatgacctaaattgagagaatactgattattaaaagaagataatgtcaacaaagatgtcagaaatgttattaaggtgaaattgtaaccagaactcacttttgaaacaaaacaggtactgaactagtgtttattttttaacagccaagtcctaatttactatgtatattttacttttatttttggaaaacatatcaaagtatacaagcttgcaataaaaagttctactatattaggaagtcagagtttaggaggtacacaaaggcattttgacaaaaatgcacagatggtagatacactagaatattttagctgtattgagtgaagctacattgaattactaacatctgaggatatatatgaaggcacaaaaatgatcctaacatctttctgtaggatttgatagtaactctcacagtaaaaacagtgaaacaaaatggcacctgcttctcagcctcactttttcatttcttagcaaaattactgagtgtgattattgtgtagttccttgcctagtctttgattttacgggctgggggctccaaaagattgctgaggagatcaaaagcagatgctgaaaattataagccaaggcaggggagcttggtaacctttctttctaagctgtttgttgattataacggttagggcaattatgaaggttaggaattatgaaatatggaaattctcctaagcatacttggtaactcttaaaaattctatttgtctcaacctcgataactaaaattacctaagataaatgagaaaaattagaaaagcaaatttaatcactaaatttctaaataaaaagcaaaaaggataaaaaagtttcactgtgcaaggagaaaggaaggaggatgagggaatggaaagactcagcttagacatcccccaattctgtgaaacgttccctgaacctttctaggaggttactctatcctctgtgtttccattgcatatatttctgtttttaacatatagcacattgtataataattattaattgatttctctatttctttggctccttcagtgtcagggtgatcttttaagtttgtgctttttatgagcaacacagaaaatgctttaaaaacagttcagtaagactgaagaaaagatctgtaagcataaaacaaataccatcatcattaccaaaaattcagtgcttaaaatatagcttgagaatgtgagtatttatttccttattcctaagattttgcttttgaatacactatctgccgggcgcggtggctcatgcctgtaatcccagcactttgggaggccaaggcgggcgaatcacaagatcaagagatcgagactatcctggccaacatggtgaaaccccatttctactaaaaatacaaaaaattagctgggtgtggtggtgcgtgcctataatctcagctactcgggaggctgaggcagaagagttgcttgaacccgggaggcggaggttgcagtgagccaagatcgcgccattgcactccaacccggatgacagtgtgagactctgtctcaaaaaaaaaaaaaaaaagaaaagaaaagaaaagaaaactgtcataactgtattactcaaatatttcctcttctctcatttgctaaaaatatatagtaaaactttcatgcctatttaaaacaatctctaggccgagtgcagtggctcatgcctgtaatcccagcattttgggaggttgaggcaggcggatcatgaggtcaatagatcgagaccatcctggccaacatggtgaaaccccgtttctactaaaaatacaaaagttagctgggcatggtggcgtgtgcctgtagtctcagctacttgggaggctgaggcaggagaatcgcttgaacccgggaggtggaggttgcagtgagccgagattgcgccactgcgcttcagcctggtgacagagcgagactctgtctcaaaaaaatgaatgaataaaacaatctgtagattgctatttttaagaaattgcggatgccaaggtgggcagatcacccgcggtcaggagttcaagaccagcctagtcaacatggcaaaacctggtctctactaaaaatataaaaattagccaggaatggtgacacccacctgtagtcccagctacttggagggatggagtacgataatcacttgaaaccgggaggtggagattgcagtgagctgagattgtgctactgcactccagcctaggtgatagagtgagacaatatgtaataaataattaggaacatctgaaagtaatcttagtttaagaaaacattttgaagttgggcatggtggcttaggcttgtaatcccagttactcagaagacttgaggcaggaggattgcttgaggccaggagtttaaatccatccttggcaacgtaacaagaccccatttctgattttaaaaataaggaagaaagacaaaacatttttagatgtcaaacaccttttgaaagagtttaacacatcttaatgacttaccccaaataggtggtaccatatgaacccaagtcaaacaattttattattaatactatggggtattgtgtttttccaattgccttttgttttgtttttattttttaaaccaattctttgtgtttaggctccttagctctttttttttaaatatagtttctttttatttagagacagagtctcattctgtcgcccaggctggagtgcagtggtgcaatatcagctcattgcaacctctgcctcccaggttcaagcgattctcatgcctcagtctcctgagtagctgagattacaggcatgtgccaccatgttcggctaattttgtatttttagtagagacagggtttcgccatgttgaccagtttggtatcaaactcctggcctcaagtgatctgcacgcctaggcctcccaaaattctgggattacaggtgtgagacaccacgcccagtctaggctcctcagctcttaccagagaatttgggacttgttaataggagaagataggcacattctgtcatcttacttgtgccctatgggctgcgtgccatctcagagtgcttttttttttccttatgcctatttatgaagaggtccagaatgcatgtctacattatttgactgctgcgttttcacttccatgttcttgttgacaaatgctattcaagcaagaagacccgattgtatgtaggtatctctgagtcttgctatgatggattctgtagtcttaccttcatcttgattgtttactttaaaagctgcttaagctagaggtatttttatggtagagaagagaacagttggcacagagcccagcttctccatggcagcagcaattatgcaaattatcctggatctttacatttcagtaaaacctttcttccccctttacatacacaaaatagacagctaaggggctgtgatctgtcctaaagccttggagataaaacaggatgtcactcttttctcaaaatgacttctattacggaagcatgagctcccttaaatggaagggcaaagcaaatccctgccattgggctctgcagcctctgctataaatgtgccaggaagattaaaactaccgtaattagtttaatcaggttcatcctcaattcttgctttcattatgtagtaggaacttccctaatcagtactgcatttggctgattgaagagttcactttcatagctaggatatctgctggagtctgtattgtggtttgttttaatggtgtatatatggtgaatgtgaatgtttctcatttcattgttgatcttgctaatggaaaaaaaaaatcattattgaaccaaattgttagaaggtatatcttctttagtcccagagaattaagcctaaatatcattactttcactcactaattcgtatactgctttttatggttgtctgctcatatctttgatttcattttaatgattgtaaatcactccagagatcctcacatacggctgctcaataattacacattactaattaattctgagctacagctgtatggaaatgaatgaaagctttttgagagacatcagaattaaaggtcctatatgataagatgacaaaacctggaacttttatgaaaattcattaataggaagacaagatgaaacttaatgatgaaagaaaagtttcctctctgacctcactttgtgagtcaaaatcactgagtacatagttcaaaattgtacctctttcgtaactagttagatggggatagggagaaatcctgtgagaaagactatagatgaagtcagatttgcagtggtttttcatgttgggaataaaagaggtgttaaaaagaccctgaagactttgtcctctgccactgggacaaattgacaccttatgtctattccttaaattatatagcaagaagaacttcttgggtggtggaagtttacatcacatgatgatttctatattagtattgccattattttatcataatttatttaagaaattatgctagtaacatgttttggcttactcttgatcctatgagggccatataatgaggatagaatttggggcttcagtgtggaatataaaattcaagttcagcatctaatggttttgtaatttaagaaaagcccattgtggtctgcttttgaaaagaaaatatttggtgactttctattaaaatgcattcttgacctatatgtttaattttctttaatatttctttttggctttttttttttttttttactcctgttctcagatgttttggttctcttttgattatatgccacaaactgaagcgtacttttcttgaaagtgttttctgggccaggcgcagtggctgatgccaaggagttcaagaccagcctgggcaacatagagagaccctgtctctacaaaacatttttaaaaactagccggctggtcaggcacagtggcttatgcctgtaatcccagcactttgggaggctgaggcaggcagattacctgagttcgggagttcaagaccagcctgaccaacatggagaaaccccatctcgactaaaactacaaaattagccaggcgtggtggcacacacctgtaatcccagctacttggaaggctgagggaggagaatcgcttgaacccgggaggcagaggttgcggtgagccgagataatgccattgcactccagcctgggcaacaaaagcgaaactctgtctcaaaatacaaaaaacaaaacaaaacaaaaaaatgaacaaacaaaaaccaaaaaaactagccatgcatggtggtgtgtgcctgtagtcccgtcttctcaggaggctgaggtaacattaagtacatttacattgttttgcagccctcaccatccgttcttctctacagtttttttttaatcttctgcaactgaaattgtgtatctattgaacagtgactcccctgttacccctcctagaagcccctggcaaccactattctgttttctgtctttatgaatttgactgttctggttacctcatatgtaagtggaatcatgcaatatttgtctgctggtgactggcttgtttcacttagcatagtatctttaaagtttatccatgttttagcattcgttagaattttcttttggccgggcgtggtggctcacgcctgtaaccccagcactttgggaggccgaggcgggtggatctcaaggtcaggagatcgagaccatcctggctaacacggtgaaaccctgtctctactaaaaatacaaaaaaaaattagccatgcctggtggcaggcgcctgtagtcccagctactcaggaggctgaggcaggagaatggcatgaacccgggaggcggaacttgcagtgagccgagatcgtgccacggcacttccagcctgagcgacagagtgagactccgtctcaaaaaaaaaaaaaaagaattttcttcttttatggctgaataatattccattgtgtgtacatttgaccctttaacaatgctgaagttatgggcaccaactccacacacagttgaaaatccaagtataacttttgactcccccagaacgtaactgctaatagtctactgttgaccagaagccttaacgataacatagcctgttaacacatatttaatgttatatgtattatgtactatattcttaaagtaagagaatagaaaatgaaatatttacactgttcattaagttgaagttgataaggttgtcatccttatcgtcttcattttgaataggccaaggaggaagagtaggggttggtcttgctgtctaaggggtagcagaggtggaagaaaatctccatatgctatgaagcctgcacagttcaaacttttgttgttcaagaatcagttgtatataccatatttcatttattcatccattgatgaactgtgaagcagcctgcttttggctgttgtgactaactaatgcttccatgaacatggatttacaaatacctgttccagttcctgctttcacttcttctgggtgtctgcaagtttaagaatcaaaattttaaacaaatcaaattggcactagataagttacttgtaaggtttgtatggaaaaataagcaagagtagccacaacttttctgaaaagaacagtaactagaaatcaggcttattagataataaaacagaaattaaaagggttagaatattgtggttgtggtggactggcagacggaaaatcactgacgccgaatagaaaatctaataattggctgggtggggtggcttacacctgtaatctcagcactttgggaggttgtgacgggagaattgcccgagcccgggagtttgagaccagcctgggcaacatagtgagacccccacctctctacaaaaattaaaaaaaaaaaatagccaagcgtgattgcacatgcttgtgatcccagctactcaggaggctgaggtggaaggattgcttgagcccaggaggtcaaggctacaatgagccacgttcttgccactgaactccagcctatgtgacagagcaagactccacctcaaaaagaaaaaggaagaagaaaagaaaaactagtagtagactcgtgtatacgtgaggatttagtacatgggaagtgtagcatttcaaatcagaggatgaaagatggaattattcagtcaattccattagaaccggtagttctgtagtagattttatattaccatacacgcatatacatgcatacatatatattaaacttcatgagtgcatgtcttttttctttttatggctacatttactttgagaagacaaagatgtcattttccacattcaaaagaaactacagtcgcgtgctgcgtaatcatgtttggatcaatgacagatcacattttggtggtcccataagagtataatggagctgaaaaattcctgtcacctaatgatgtcttgatgatcctgaccctgtgtagacttaagctaatgtttgtttgtgttttagtttttaacaaaaaagttgaaaaggtaaaaacaaatttaaaaatttttaaataaataattgtaaagatacaaagaaaagattttgtacagctgtatgttatatttgcattttaagctgttactacaaaagagtcagaaagtaaaaaaatgtaaaaggtaataaagtaaaaaaggaagctaaggttaatttgttttgttttatttatttatttttttttaattgagacagtcttgctcttgttgcccaggctggagtgcaatagcacgatctcggctcactgcagcctccgcctcctgggttcaagtaattctcctgcctcagcctcccgagtagctgagattacaggctcctgccaccatgaccagctaatttttgtatttttagtagaaacacagttttgccatgttgtccaggctggtctcaaactcctgacctcaagtgatccgctggcctcagcctcccaaagtactgggattacaggcgttgagctgctgtgcccagccagatgaatttattattgacgaagggaaatttttaaaaatttaatgtagcttaagtgttcagtgtttataaagtcaacagtagtgtacagtaatgtcctagcccttcacagtcactgagcattcactgactttcccagagtgtcgtacagtcttgcaagctccattcatgataagtaccctatacaggtgtacttatattttctataagtagatttttatcttttataccatatttttactgtaccttttctatgtttatatacaaaaatcctattttttttgcagtggcctatagtgttcagtacagtaccacgctgtacaggttagtagcctaggagcaataggttattctatacagcttaggtgtgtggcaggctatatcatctagatttgtgtaattacacactatgatcatacaatgacaaaaatcacatttcttagagacatttcttagaatttatccccattgttaggtaacacacaccgtactttgattctacttcatcatctagctgtcaccccacttcactgtttcccttgctattctttacttactttttagatttctctttccattctctttcaaacccatttcaaccaggtttttgctccttaataaaggaactgctgttgcatgattaccagtgactccaatccaacaaacaaatgtatgttctcatttctacttgacttgtcagcagcatttgtcgctcctggaaatatgtgcttcatttgggttccaagataccacacattcattctctctctctctctctctctctttttccttattcttttctggcttctcaatcttcatgatctttaatgttacaataccttggtgttatcagtccttagtttactgttcggtttacattcaccctcactcggttatgtccagtctcaagcttttaaatgtcaatatgctgttgacttctaaatttgaatctttcttcttaggcttctctactttgatgtttagtaagtatttcaattttaacatgtctcaaactaaactcctgatcatcattttcagtcttcctctaagtgagttaataatttcctcacttctgtcgttactaaaatgttagctgatcatcgcagcataacctaattgcctaattaattttgcaagccctctcctagtattcacttgctgtttatcccctaacacttgccaccttctaacaaataataatctttaaaagttttttgtgttttttctttactgtcctctctgcaattgtctgtcttttccttgacatatccacaacagtaagtacccataaatattgttgaatgaatggtcaagtcatatacctcttcataaaatcttcgaatggcttcctctttcttggactgaaaaatgtccattttcctaccacctgcaacattactcttctcttgcttactctagtactgcaaacatggattctttattgttctttaaacagacaagctcctggctcagggcctttgctttcttggttcctgttttttcccacatacctacatggatccatctttgtctttcacctccttttcatttctgcacaattgagttttcaatcagaactttccgacagcccgttttaacattgtaaattctttccatccctggccttttcaattcctccatgctctgattttctccatagtgcattttatcatctgatataccaaatattttacttattttctctactttgctcatgcattacaatgacatctccatggaggaagatgtttttggatttttttttaactgctgttatcctcagtgctcaatagtaggtacttagtaaatacttgctgaaaaaatgaaaaaaaaatttttttttgagatggagtcttgctctatcccccaggctggagtgcagtggcacgatctcagctcactgcaacctctgcctccctggttcaagctattcttccgcctcagcctgccaagtagctgggattacaggcacacactgccacacccagctaatttttttttttgtatttttagtagagatggggtttcaccatgttggctaggctggtcttgaactcccaacctcaggtgatcctcctgcctcagcctcccaaagtgttgggattacaggcgtgaaccgccatgccccccctgaaaaatgaattattgatgaagcaagaatttaatattataaaatgaaatcaagtgttcttgaatactatcagttatagttagaaagtattctgtaacagcaagaagaatttattaataaaagaaacagcagaatctatgaaatacttagaaatatatttaacagcacatgtttaggatttatatagatataaatacccagaaacacgaaaaagcttgactaaatacatttactttgttattgtagagctaaagttaatgttgagatatgtttttctacattaagatacaaagttaaagccatgtgaggttttttaaaaacttcaatcatatctcaagtttgtgaggaagtatacgtatggaaaaacagtccgatgaaaaggttattaaagtagtggtgatatttgcacaattctgtaactatagttaaaaaaaacccactgaattgtgcactttaaaagggtgaatttggttgggtgcagtggcacatgcttgtaattccaacactttgggaggctgaggtagccagatcacttgagctcaggagttcgagaccagcctgggcaacaaagtgagtgtcttatctctagaaaaaattagccaggcatggtgttgcattcctgtgatcccagctacttgagaggctgaggtgggatgttggctagagcttgggggggcaaaagttgtggcaagctgagattgacactgcactctagcctgggcaacagaaccgggccttgtctcaaacaaaaacaaggtgaattttatggcatgtgagttaaatctcagtaatgttgtaaataaaatagagaatttctataggaatacaagaaaaaaaaaaaacctacttgttttcaaatattcaaacgttattatgaagttataatatccatatattagtggcacaataataatcataaatatgaatgaaacaaaaccttaggaatttagagtaagatccaaatacgaataagaatatgtaataagtatgttattacattacattaattataaataatcaatgggcatgaaatgagtaatgttcttagaacaatgagcaatgttcttagaacaatgagcaaaccttttggaataaaggctgcttccctacccccagattatatttttagaatttaacatggcaaataaaggaaaaacgaaaagaaaccgaaaaataattaattgaaagtgtagtgaagattgtcgtctagaaggacatgatttttccaagtataagaaaacaagactgggcgtggtggctcacgcctgtaatcccagcactttgggaggccgaggctggcggctgaggttgggagttcgagaccagcctgaccaatgtggagaaaccctgtctctaccaaaaatacagaattagccaggcattctgtgcatgtgcagtggcacatgcctgtaatcccagcgactcgggaggctgaggcaggagaatcacttcaacctgggaggcagaggttgcggtgagccaagattgcaccattgcactcttagcctgggcaacaagagtgaaactccatcaaaaaaaaaaaaaaaaaaaagtaaacaaaactatattccaccttaggctggaatatattttttcatgaatgaaaaaaagagagctgggtacggtgactcacgcctgtaatcccagcacattgagaggctgaggtgagtggatcgcttgaggtccagagttcgagaccagcctggccaacatggtgagactccatctctactaaaaatataaaaatcagccagacgtggtggtgggtccctgtaaaccagctagctacttgggaggctgaggcacaagaattgcttgaacccaggagacggaggttgcagtgagccgaggttgagccactgcactccagcctgggtgatagagctaaactcagtctcaaaaaaatgagagagagaaaaaaccccaaaacaaacctataaagttaaagagactattttatttaatgcagtgattaagcactttagttatgaaatcagactatgtttaaattatttcttaatcatttactggttaagtgaccttgagcaagttagccaatgtctaaaccactctttaatcttttaaatgaggatagttatagtaatttcactatatggtggttgtaaggaatatgtgaggtaattagtacagtttttcataagtatttgaatacataaaagattttggccaggcacagtggctcatacctgtagtcctagcactttgggaggctgaggcaggagattgcttgaggccaggcgttcaagaccagcctgggcctttcactttttaataaaaatttttaaaaccttttgtttaagattttaacttcaagaagaatagtaggtgaaagagagctggtaaattgggaaaaatgtgcaacatgtgagaaagaagtattatattaagggcccatctaaattagaaatgacctccacaatttagaaaaatatggaccaggatcttgaacagcttttcactgcaggagaaatacagatggccagcaaaatcatgtgaaaagacgtttagaataatagataagtcaaatataaacaaatgcaataggaagtcttttttttttttttttttttggaatcagggtctcaccctgtctcccaggttagagtgcagtggtgtgatcatggctcatggctcactgcagccttgacctcctggctcaagccattctccacttcagcctcccatgtacctgaaactacaggcatgcaccactgtgcccagctaattttggagatttattttttgtagagaagggggtctccctgtgttgcacagggtagtctcaaactcttaggttcaagtaatcctcctgcctcagcttcccaaagtgttgggattacaggtgtgagccacgaggcctggccagaaaaagagagagagagagtgtgtgtgtatgtgtgtgtgtgtgtgtgtgtgtgtgtgtgtgacgtagtctggctgtgtagcccatactggagtgccgtggtgcgatctttgctcactgcaatctccgtctcctgggttcaagcaattctgcctcagcctacctcagaagctgggattacaggtatgtgctgccacttccagctggattttttttttttgtatttttagtagagatggggtttcaccatgttggccaagctggtctggaactcctgacctcaaattatccacccaccttggccttccaaagtgcaaggattacaggcatgagccaccacgcccaaccctggatgtctttatataaggttgtgacatcttacatactgacaattggaaataaaaagtcttttttggccgggcatggtggctcacacctgtaatcccagcactttgggaggccgaggtgggcagatcacaaggtcaggagatcgagaccatcctggctaacacggtgaaaccccatatctactaaaaatacaaaaaatcagccgggcatggtggcgggcgtagtcccagctacttgggaggctgaggcaggagagtggtgtgaacctgggaggcggagtttgcagtgagccgagatggcaccactgcactccaccctgggcaacagagcgagactccgtctcaaaaaaaaaaaaagtcttacatgtcattgtctagtgtgtaactaatgcatatgcccttcagctttgtactttcacctttaaaaatttacctgaaggaagtaattgaacaagtatggaaagaaaaatgcaattggatgtttaccatattgttatttatttatttatttatttatttatttatttatttattttgagacagtgtctccccatttatttatttattttttttgagacagtgtctccctctgttgcccaggctggagtgcagtggtgcaatgtcagctcaccgcaagctccgcctcccaggttcacaccattctcctgcctcagcctcccgagtagctgggactacaggcacccgccaccatgcccgtctaattttttgtatttttcgtaaagacggggtttcactgtggtcttgatctcctgacctcgtgatccacctgccttggcctcacaaagtgctgggattacaggtgtgagccaccgtgcccagcccttttttttttttttgagacagagcctcggtctgtctcccaggctggagtacagtgacacaatctcggctcactgcaacctctgcctcccgagttctagtgattgtcctgcctcagcctcctgagtagctaggattacaggtgcgcaccaccacacccagctaatttttttgtatttttagtagagatggtgttttcaccatattgatcaggctggtctcaaactcctgacctgatgttctgccctcctcggcctcccaaagtgctaggattacaggtgtgagccaccgcgcccacatattatttatagtaacaaaaagccagaaactatttaattacagtcagtaggtggttgattttatgaattatgaactattgtgaaactgttgaatttaacatctaactcttatttacacataaaggtgtcatatcatttaaagcaaatgggctacaaaacagcaagcattgttggctccatttgtataaaagaatgtacacttgtttattttgatgtatatggtaaaatatctgaaatgtaaagtctttattcatgaaaggtattatttatactttggttcttttttttaaatgagagtattttatatgtggactaaagctatttttctgttggaaaaaattacatgcttaatatcatgttttaatacagcatctttttcagtgcctaattgataatatgctctcttaaagtgataactcttatcagtcattttaaagtgttcttacaagtgtaagaggataatatcatcagtaccaaatacagttttcaaaatctttttttttttttttttttttttttttttgtgacagagtcttgctctgttgcccaggctggagtacagtggtgtgatctcggctcactgcatcctccgcctcctgggttcaagtgattctcctgcctcagcctcttgagtagctgggaccacaggcatgcgccaccctgctaattttttttttttttttttttttgtatttttagtataggcgagtttcaccatgttggccaggatggtctcactctcctgacctcgtgatctgcccacctcggcctcccaaagtgccgggattacaggcatgagccaccgtacccggcttcaaaatcttaatgttgtctcattcatttattttatatagtatcaggatttggaagaaaagatttttgaaaccaacatcaaattatctgtgtgccttatttagtcatagaccatttactgtgggatatgaactctgttttaaactgcttttaatttctctcagatatttatttcaggtaaaagtgaaaaaccaggccaggcacaatggctcatgcctgtaatcccagcactttgggaggctgaggcgggtggatcacgaggtcaggagttcaagaccagcctggccaagatggtgaaaccccgtctttactaaaaattcaaaaattagctgggcctgctggcgggctcctgtaatcccagctactcaggaggctgaggcagagaattgcttggacccgggaggcggaggttgcagtgagccgagatggcgccactgcgctcctgcttgggcaacagggcaagactccatttcaaaaaaaaaaaaaaagtgaaaaaccaggcttgaacacattcattagccaattaaggaagctgaatatgtttctactttacttttagacagaatttaaaaaataacttcctatttaagtataacatacatatagaaaaatacccatcataaatgtaacagctcagcgaattttcatgaactcagccatatgggacaaccaacattcagattaagaaatgtgtttgccaggtgcggtggctcacccctgtaatcccagcactttgggaagctgagggaaaatcacttgagccccggagttcgagattagcctgggcaacaaagcaagacctcatctctacaaaaaaaccaaaaaacaaaaaacaacacaaaaaaattagccagacatggtggcttgtgcctgcagtcccagacttgggaggctgaggtgggaggatcacttaagcttagaagttcaaagttagaatcaggtcactgcactccagcctgggccacagagtgagaccctgtcttaaaaaaaataaaaaagtagtatgacattgctagcacccagtaagaaccccttgggcttctttctcattactgtccttaccatgagtaataattttttttatttttaatatcataataaatttttcctctttgtggtctttatataaatgaagtcagaataggtactctgtttttctggctccattaattcagtgttgttcgtgaggctttttgtatgtttgtttgcttttgaggtggagtttcatccttgttgccctggctggactgcaatggcatgatctcagctcactgcaacctccgcctcctgggttcaagcgattatcctgcctcagccttccgagtagctgggattacaggcatgtgctaccacacccggctaattttgtattttcatttcagacggggtttctccctgttggtcagtctggtcttgaactcctgactttgagtgatctgcccgcatcagcctcccaaagtgctgggattacaggcgtgagccactgtgcccagccagagctttttttttctttttttttttttaaactgtaatacatggtattgcgtgtaatcatagttcacatttttaaggataagttttaaaattggaagtgtcattttcaggcataaatatgtttaaaaatatttaaaacaaactgcttaatatttgtttttaaaagtataaaagtaatgaatgggaattgttttttcatttttaatttttgtggatacatagtgtatttatgggatacatgagatgttttgatacaggcatgcagtgtgtaataatcacatcatagagaatgaggtattcatcccctcaagcatttatcctttgtgttgcacaccatctagttatactcttttagttatttcaaaatgtacaattaaatgattattgactatagtcacactgttgtgctgtcaacagtaggtcttatttattcattctttctatttttttttttttatttttggtacccattaaccttccccacctccccgggattctttaatataatgtgaagaaagtgtgtggggtttatttaattttcaagttaacataagtctgagtatatgagactgtcaaagccagtttgcccttgggcaaaattataaggtccagtccaaaagaagagatagttccctttattctgagtcaatcaagtaccacatgtattgtgttcatttaaaggtgccacatgtaaagagggatatttacaaacttaaaacacttgcatcagaaaatgaccagaaagaagtgaaactgttgagtcaggaagttaaatattttggttgagttcaaatgtctgacagccattgggaagaagaggaattagacttactctgtgatttttagaaagtgagacttggaccagtaactgaaagttgcaaaaaaatatatttcactttactcttaggaagaacttttttttttttttcaatagacacatttcattatgggaaatttaatacaaaaacatagtgactagttcaaagtgaagatactagagttagatacctgtcactaggatcatcttttatatttcttgtctaatatttggaaacagtcatttctgcaggagccctgattcattttaatgggaaatggttttagagaccacggtcttgaggtgttcattgctaatgggttgtcgatgtttgtaggcattttaatggatagagaggtagatagacttcatatatttttaattctatcttaaaagtatagccttttacttctttgattttatagttgtacgttttttgcttctaacattttggttcctagtgatattcacatggttacctattttatctatgtatctgttagtcatctatctgtctaaattcaaaattactatatgtattaccagtaatatgctcactgagggcaatttaccactttcttttgctgggcaagatggcttgtgcctgttagcccaactactcagaaggctgagcggggggaggatggcttaagcccaggcattcaaggctgcagtgagctatgactatgccattgcactccagcctgggtgacagagcaagaccccatctcttaaaaaaaaataaaaataaaaataaaaaatagagaggtagaggttctttggtatttggttttgggttttttttttttttgagacggaatctcgctctttcgcccaggctggagtacagtggtgctatcttggctcactgcaacctccccgtcccaggttcaagtgattctcctgcttcagcctgctgagtagctgggactacaggcatgcgccaccatgcccagctaattttttgtatttttaccagagatggggtttcaccatgttcgactgctctcaaactcctgacctcaggtgatccacccgtcttggcctcacaaagtgctgggattacaggcatgagccactgcaccgggtggttggttggtttttgtttttgtttttgtttttgtttttttttttttttgagacagagcatcactctgtcacctaggctaaagtgcagtggtacgatcttggctcactgcaacctccccctcccaggttcaagcaattctcataccttagcctcccaagtagctgggattacaggcgcccgccaccacgtccggctgatatttgtagttttagtagagatggggtttcaccatgttggccaggctggtctcaaactcctgacctcaggtgatctgcccacctcggcctccaaaagtggtgggattacaggcatgagccactgcgcctggctggcttgcttgtttgtttgttttttgggtaatgttttgagatttaggatgtagattctcaatattgtgttttatagtaattcaaaataattacttttcatatacttatataactaattttctatatattgaatagatgaatttcttttttgtttgtttttgagacagagtcttgctctttcgcccaggctagagtgcagtggcgcaatctcggctcactgcaacctctgcctcccaggttcaagcgattctcctgcctcagcctcccggtagctgagataacaggcacgtgccaccagccccagctaatttttgtatttttagtagagatggggtttcaccatgttggccaagctggtctcgaactcctgacctcaggcgatctgcccacctcagcctcccaaagtgctgggattacaggcgtgagccaccatgcccggcctattgcttttaatatttggagatctgggatgctttcctttattatatataactttgtttcataactatgtaaaacacttccaaactgaaaaccataaagttagatgcataggggtctagtttctaaccctgtttactttcccataagtcactattttcgctaatctttggttcattccattttaaaatataatcggtaggcatatatatattcatattcttcatccccattttcttatacagaaggtatattatatgtataaggcatagcatagcatagcatattataaccattgttctcaaccttgctttttttcatttaataatatatcctggaaatcactccatagcactatattgatatctcttcctactcctcctacttttgtttttgttgacaatttctcaatattccattgtacagatgtaccttactttattcagccagttttctgtagataattgtttggatttttttagggttttttttttttatattaaaatagtggtgcattttggacccttgtgcagacattatatttttaagagtgtatcttgggtagaccctcaaagtaggatttctgggtcaaaggatgtagttaaatgcatatggaatttttctagtttataactagattgtagcgttttccatgcagtacattttcatacgtgcttgaatttggttttatgttttctgtcctgtttcattggtttgtttgtcttttcatttgtcacttctgtactgtttcaatgattggggctttgaaaaatgatatttggtatggttattccctggcttttctacattttaggtttttctagctattcttgcatatctattttccccattgaacatcacaatcaatttttctaaatgccaaagaaatctgttggtatttttattgagattgcattaaatttataaatttgcttagggaaaattgtcgtctttatgtcttcctatccacaaacacagtataactttacatttgttcagttctgagtattttatatttaggaagaactctttagtggttatccaaaagtaaaacagactattgtgtgaagtagtgaattcatttctagagtatatagtgaggattcatgaattagcattttacggtaaatgacttaaatgttacttcccattctaagattttatataaaaacacattctgatgaaaatatgaatttttaaattgtctttcctattccacattaagagagagctctactgctcactcaagaccataattgagaatgagttataaaagagtagaagtaggttagggattgtcttctataggtttagaatcatttaagtcaatgaaggaggtaggcagtaaactattattttagatgacgaccataggatactgtaactaaaaataattttcttttcaaaaatggtaacttcatatgcttcatttatatttacccagtcaaaagtaagatgaaagtagactattgatttgccatttaaaaaatgtcaaaaatatcagggatatttctaaagaccctctaatgtatagttttatcgtgttgaaagtcaacaaagataatataccatgatagcctctcgtatagcagcagatgagctaacatactgtgacataagtataatattaggttttttaaaaaccactgttgcctattgtttatctgatatgtgatccattagtttgttggattgttaagctaagctaaagtggtgtaaggtttactccctctttaacttttttcttgttcaaattttaggacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggtaagagggttattttgttacctgttatttgttaaagaaataggttattttccacaggtgcctgataaatgtagatgaacttttaatatatatatctttttttgttttttaataagtgtattttgaaatctcagtattccttttccttaagatttaagaagtagggaatgtctatattatttttttgttttgagaagagctattgtcaaaaagaaaaaaagaaagaaatatacataacttttggaaaccaggaaaaatcattcatcttttttatgtagacaggttattacacaatttttataaagacaaatggctcataggtctgttagtagtatgcaggatctcccaccaccccctgcccccaccaccccaagaggtaaaaggtaatgctggaaggatttttaatgtatattaatccagtagttataaatgcatctttgttacaggaagaatatgttattaatactgtatgtctcataataaaaattcaaacattggacattttcagcattgtaaaatttaactgaatattcattcagacagacttcattttgcagcataccttttgatgttttcataaaagctgcttcaattagatagaaaaaaaagaaatctggaaaatgcatttgtacatctagaaagaattgtacatctttttctctcttaattatacaccttttaagaattgagaagatagaaaacaaagagtaagcatttgccactcgaataaaagattagaagttctttgtgagagatcttaagcctaagagtttgtaaaataactctaggaagtccataaaccctctgatgttgtaagtaaaattacgggtatatatgtttgtgcatcttttttagtgataatctagaaaaatttcatcagattttccaagtaaattctctaaacctcagtatattctctaaacctcctatataatgggatttgtaggggtattatgaaaagtaatcacatagtaagcatgcaaatattagttattattattattcccctaaaagattaaaaacttgtgcattaggccaggcgcagtggctcacacctgtaatcccagtgctttgggaggccgaggtgggcggatcatgaggtcaagagatcgagaccatcctggttaacacgatgaaaccccatctctacttaaaatacaaaaaaaattagccaggcatggtggcaggcgcttatagtcccagctactcgggaggctgaggcaggagaatggcgtgaactctggaggtggagcttgcagtgagccgagatagcaccactgcacttcagcctgggcaacagagcgagactccatcttaaaaaaaaaacaaaaaacaaaaaaagacttgtgtattagggaaaagataaacccctcgaatacaaagagtttttgttcctgattttcattattcatgaacttttgaaaaattaaaacttagtggagaatctgagtgttccttagcttttaacagtgtttatttatttattcatttttttattttgagacggagtcttgctctgttgcccaggctggagtgcaatggtgcaatctcggctcactgcaacctccgcctcccgggttcaagcgattctcctgcctcaccctcccgaagtagctgggactacaggtgcatgccaccacacccggctagttttttatatttctagtagagacagggtttcaccgtgttagccaggatggtctcgaactcctgacctcgtgatccgcccacctcggcctcccaaagtgctgggattacaggcttgagccactgcacccggccagcttttaacaacgtaaagagagaaaaagtcttatgcttaggtccattcaacaaatagtttatttaatcagtaatagttactgaatatcaggtatttaccaggcattctactttgtgggcccttgttatataatagagaatgaggcacacaggttcattgagtcatggagattatagtagaggaggtagataataaacaaaaaatcacattacgtgttgttaaaattgtgataaggactgtaaaagggagagagtacagcatgaaatggggagcctaacccagagaagtctttcctgagaaggtgatcctaaactgagacctggcagatgtgcaacatttaactggataaacagactcattcattattcattcatttactggttcatatgttgaattcctgaaacatacaggactattctagtcactggcatatacaatagtaaatgcctgatatctgacctcataattttcagcttagtgaaggaagacaaaccatagagtgataagcaaataaataatggcttaattgagaaaaatgctataaagttaataccatggagtgttatgatacagattaaagggctggcagaaggggatctaattagatagttactagttatggctgaggataaaaagttgagacttaaaggatgagaagccacagtgaagtccaggcgcggtggctcacgcctgtaatctcagaactttgggaggctgaggtggccagatcacttgaggtcaggagtttgaggccagctggccaacacggtgaaaccccatctctactaaaaatacaaaaatcagccgggcatggtggcacgtgcctgtagtcccagctacttgggaggctgaggcaggagaatcgcttgaacccaggaggcggagattgcagtgagcccagatcacgccagtgcaacagagtgagactgtatctcaaaaaataaaaataaaaaaaaagccacagtgaagaacatgttttaagattctcagttgggaaggagtttagatattggataaactgaaaaaagcttcatcgtggtgaaagaggaaatacagagagagtagtgagaaatgtggcaaaagaagagaccaaacaatgtgttaagaattttggattttatattaagaacaaaagacaaaggagtattgattttaggtttgcatttttaaatgatgattttgccttctgcatgaacactggatggagaggataaaaataatttgaaggaaactggttaataggcaattgcagtagtctagataacatgatggtgcttagattaggttagtggcaggcttatgtctgaacatatgggagattggagataacatgcactaagagagagaagactataggaggagcagatttagaggagaacacagtttttttttttcttttgtttttgagacaggctctcactctgttgcccaggctggagtgcagtggcacgatcttggctcactgcaacctgtttcctgggctcaagccattttccagcctcagcctcctgagtagctgggactacaggtgcaagccaccaatgccaggctaatttctttgtatttttgtagagatggggtttcgccatgccgcccaggctgatcttgaactcctgggctcaaagggaccctcctaccttgccctcccaaagtgctgggattataggcctgagtcaccactctgagccactttttaatacatacagtttgaagtgtctgaacgttgaagcggaggatttgagaaggtcgttgggtatctagttctcaggcttagtagagaagcttgacctggagataagagcatttcctctgagtatttgaaaaattgtgttaggcaatatcattcactaaaaagggcttctgggtgaaataaaagttaggaacagactctcaaaaacctgtgcaactttataagcagagcatcaagaaaagtaataattttcaaaaacagcagttaaaaagacatactagaccaggcacaatggctcatgcctgtaatcccagcactttgggagaccaaggcaggcagatcacctgaggtcaggagttcgaaaccagcctggccaacatggcgaaacctgtctctactaaaataaaaaaattagccagcagtgctggtatgtgcctgtagtctcagctactcgggaggctgaggcaggagaatcccttgaacctggaaggtagaggttgcagtgagccgaaattgtgccactgcactccagcctggatgacagtgtgagagtctgtctcaaaaaaaatatatgtatatatattgttaagactaaatgtcttaataaataaagaggctgggaatggtggctaatgcctgtaatctcaacactttgagaggtgaggttgaagtatcacttgagcctaggagttgaagaccagcctgggcaacataggagcctcccatctctacagaaaaatgttttttaaattagctgggcatgatggcatacgcctgtagtcctggctactcaggaggctgtggcaagttgatcacttgagcccgggagttcaaggctgctactgtaagctgtgatcgtgccacttcactccagcctgggctggcagagtgatactctgtctcaaaaaaaaaaaaaaaaaatagaaatactacaataaatataggcattaaccttccaggaaaagatgaaggtcgcttgtagggatataaagaagggttgaagctgctcaactgtaggcacagaaggatgtcattggtagataaatgtagcaatgccagacatagctggttctagtgtattgtacctgtttgtttcttttgtacaaacattgagagaagccacacaataaaaacacttgcagaaaagtctgttgccagtaggagccaagaggaagaatgtggatgaatgtacattttgaacagaactacattgcttatggctttcttcatttagtttgtgttggtgtactccttcgttcagctgctagttttgtcctgcaaaatatttatgtgctttaaaagtcatgtattaaccaatacaacttccatattctggtatcattcttgtatttatcaatgatacaagagctatttaactatatagaaacacatacaataacaaaacatactgtatacctttgtgaatttttatatgtataatcatgagagtaatgatattttccttgggagagaatagggagtgaaaaacaaacagccttgggtagctctgaggaactgcagtatttaaagtagtgcttaaaaaactgtcagcttttggcccacatgtgattctttgtgatgatctctacactttttaaaaaattgctcatattaaaaaatgtagcaattttacataaaaatgtggaattctgcttctcagaaaaatcagaacatctggcaacaattagtccacatttcgtggataatagggatggctggggctcagtattggcaggccctttttcattgctgcttgtattcttttgttcgccacagtcctcactgttttctgttgtgtgttgtatctggccctcttcagctatttaaagagggaacttttggatttgagatccctaatttcagagtcatgagaaggagattataaaggatgagtaaattgaggtgaaggtgatatgagatgacaggttaggatgttgaatgtatcatctacatggacattgaaattacccaagaggacagttacagaagttggggtgaaaatggtggatgtgaacctggtttcagggtccttggggaatgagaaagatagcagggaagtttatgcaaaagtacctgtgttaagtacgaatttgtctttttaaaaatttccttctttatttatttgagatggagtctctctctgtcatccaggctagagttcagtggcgtaatctaggctcactgcaaaacccgcctcctgggttcaagctgttctcctgcctcagcctccgagtagctgggattgcagaagtgcaccaccacatttggctaatttttgaattttttgtagagtcggggtttcactgtattggccaggctagtttcaaactcctgaccgcaagagaaccacctgtctcagccttccagagtactgggattacaggtgtgagccactgcacttggctttttttcttctttataaaataacatacagaaaccacaaagacctctctgaagtcactgctctgacactagttctctatcaccaattggatgttgtacaatttagttcaattctgaatacaaattacctgaagctagtgaagacctcaagttaagagcagagttcatcatgagactgcagatgccagtcacaaattttggtgttcctgagacatccatacttctgcctggcctgctaaaaatttgcaacttcgtgcaaccccctcaattttggtaacttgttaaaaggactcacagaacttgtgaaagcactatagtatgattacagttttgttacaaaggatgcagatcaagaacaactagttgaagagatacatagagcagtgtttggtgcaagaagggtccacagacctccatgcctttccccttgtggaatccgggcacattgccctcccagcacatcactatattcaccaacctggaagctccagtgaacctcagtgtccagagtttttattggggctctgttaggtaggccggattgattagatcattggccatgttttttaattcaattttcagttctccactcccttgaggttggggtgacccaaagtttcagatttttaattatgtgatttggtctttctggtcaccggcccccatcttgaagttacctcaggctttcatctcactgtcgtaacagagacattcctgtcacttgggtaattacaagggtttttgaaactctgtgccaggaaccagggacaaagaccagctatattctttacttgatcataagtctaaattcttttgttaattgttctctatcttggaatctctccatcttcttcacaattactgttgataagtacatggagatgtgacttgattttctaatagaaacttaatatacttttttcaggtagatgtgagaataggtttagttgtcttaacaaaaaccagtcgaggaaaagtttttagttaagcagaatactaaataaaaatattaattcaggctcagatatcttttgttttgatccctttgaaagtcagaactggttttgtttaggagtattttatgtatttgatttttattcttaactattcccttatgatggtagctgttctttcagcaaacagttattttgtgcctattgtgtgccaggagaaggaacatgctgtaattccagcactttgggaggccgaggtgggtgggccacttgaggttaggagttcgagatcagcctggccaacatggtaaaaccctgcctctactaaaaatacaaaaattagccaggcatggtggcacatgcctgtagtcccagctactcgggaggctgaggcacaagaatcacttgaacccaggaggtggagattgtagtgagccgagattgcaccattgcactccggcctgggcaacagagcgagactctgtctcagaaaaaaaaaaaaaaaggtaatttctgctttaaagttgatttatagtttagacatgtatatgaatagttattgacagtttttttttttgtttttttttgttttttgttttttgagacagactcactctgttggccaggctggagtgcagtggcacaatcttggcttactgcaacctccgcctcccaggctcaagcaattctcctgcctcagcctcctgagtagctgggattacaggtgtgtgccaccatgcccagctaatttttgtgtttttagtagagacggagtttcaccatgttgaccaggctggtctcgaactcctgacctatggtgatccacccgcctcggcttcccaaagtgctgggattacaggtgtgagccaccgcgcacagcctgacggttcttaatattgagatacttacaaggcattttggggagcagagaagtgagggactgactttaaaggtcttgggaaggaggagggagttttgaatttagcagcgaagaataatgtgtgacacgtgtttcttacactagatatcagctttgcaagggcatggggatgtgttactgtgcttagttaagtgttaatggtttgatatgggacccaagagatgggactggaaagataggcagatcataaagtcctcgtttatatgagactcccaagagtatagagtttactttataaggtatgagaagttaagggttttaagatggggaataatttgttgagattacattgacagcagtgtgatagatggattagtgaaaagagatcaggtagatcagtttggaaactgctcccacaaaatattatgaggctcttattatgaggctctgagccaaggtagagatgatgtgattaagtgaaatgagatatgcaaaaggataaggttggaaataggtaataaatttggatttcaagcctgttttgtaggacagatggatctgtagctcaaaggagaggtaaaacctgaagataattatagatactttattattaaggctatgagaaggaatgacaatatttatggtgaattcagtgggtttcttaagtgagtttattatagtcaagagtgtcaagtgggtggacgtggtggctcacgcctgtaatcccagaactttgggaggctgaggcgggcagatcacctgaggtcgggagttcaaggccagccttaccaacatgacgaaaccccatctctactaaaaatacaaataatagccggacgtggtggcacatgcctataatcccagctattcaggaggctgaggcaggagaattgcttgaacctgggaagtggaggttgtggtgagctgagatcacgccattgcactccagcctgggcaaggagagaaactccgtctcaaaaaaaaaaaattaattaattaaaaaaaagagtgtcaagtgttatgggagattggttaggtaagtactgaaagtggatgattggctttggcggttagtttgtcttgtgtctgagagccatttgtatagtggcaaatgttagatttctggaggctgaggaatggaagttaggaaatgcagacaattaaaattcttacacctttacattttgctattttttcctcagtgttttcttttgtagcacttctgactggtttattatttgctttttccttacaatgacattgttattctatagcattctgttgaagatgtaattacattttctcaatctgtgatgtcaggttgctttttgaagtataaaggtttaagaaatacataattacatatgatttttaagtgatcttctcggtcttcagttgattttttccatatataaatttaaggtagattcattttacatttggtatcatgttaaaatgctcccaaaactacctactgtataataggtattgcaatattgttgatcaccttcaggatattattatcctgaaatgtctcccagtggtccaagctgggacagtttgagcaacaaaataaatatgagaggattggattataacctaaaaaataaagtcaatatctataaatccatgttgatttaaataaatgattgactaaataaatacttggcagaaaagaagcaaatcttccttacagaaaaattccaaataatatatgtagaacacactttcaggaggtggaacttaatttacctcttcttgaatatggactggactgctgacttttaaagaacagagtatgaagagggaaaagcagtaactttacagtgaagaggcctggcagacagcaccttaaccaagttcaaggttaacttcaccaatgataaggcatggtgatatcatgtactctctgatagaatgtgttaaatctaagcagaaaaaaaaaaataataataataataaagggcattctacaaatacttgaccagtactaaaaagtatcaaggacctgaaaaaacaaggaaagtctgagaagcttttacagaacagagaagactaaggagacatgacaactaaatacaatgtgatatcccagattgacagtgaaaaaaggacatgagtggaaaaaaattggctaaatctaaacaaagtctggaattttgttaatagtattattccaatattaatttcttggttgtgacaaatgtactgtagttatgtaagatgttaacattgggggatgttgggtaaaggacatacgagtattctctgtactatctttgtaacttttatgtaaatctgaatttattccagaataatgagtttttttaatacagcagaatacaaattgttaagtaaaacatatctcaaactgataattgatgaaataagaaataaaggttatttactatttgtattgagtggattcctcataagtgttggttgggggtaaaacaggcatatttgataaatcatgttgatataaatttcaggaaaaataaatgaaaccagattagggacactggaatgtgtagcttggaccaaggcatttaacccttctctccttgtttcaaaaatggggaatcaaactgacttatcactttgagcatttttaaagtaaacaagtatattcactgtaaaattaaatcttatgaagacttaaaaggaataacagctataatcacttttataaattatgtgcatatggtagttagcttatttttctaacatatactgttctgtactgtacagactaacagctataaaatcagcttgatgcaagtgaaattacagtaaaattacacacttaagtaaggccaggtttcctggtttctcccaatcctgatagtgattctatttaatttatgtatgtatgttaggtagacatgaaataggtctcatgggcaagagtttctgacttggatgagcaagagtttctgacctggaatgtcagttatttcatccctgtttttcagcatatgtgactcatggctggctacacatgacagaacttacaaacctggattctaaaattggcagagcagtagaatggagtattttcatttagcatttatagcttacaagtcatagaacaagcagacaatggaacattattataaatgatttactacatgtaaattatatacattatttggtgcattcagtgatgatgaatattttgtcctccaagaataagtgaggcttaaaccttttttttttggaaaaagtatattcactgtacaagcatatagattgaagcaaagaatactgagttttctctttaactgaagagtataagctttgatcagaatatactgatctcaaacaatttctctagtgctgtttataagacacacctatgcaacagttagaaggaataagttcagatgttcagtagcagggtggggtgactataggtgacagcacaatattgtgtttttcaaaaatagctagaagagaggacttgaaatgttcctgacacagaaatcataactacgcaaggtgatggatacccaaaatactctgacctgattcttatacattctatacatgtaacaaaatatcacatgtacccaataaatatgtacaactattatgtatcaattttaaaaagatttaaaacatgatagaaaaaagatatgcctataaaggaagtgtgaacctacagagatgaaagaaaattgtttgtggtgtggttagtgcagttaggggaatttccagaagaattccatttcagtgaatgatgtcatttgggcattatgaaaaatagcctagttagagaaaaaaacagagtttttgttttgttttgttttgttttgtttttttgagacggggtctcactctgtcgcccaggctggagtacagtggtgctatcttggcttactgcaagctctgcctcccgggttcatgccattctcctgcctcagcctcccaagtagctgggactacaggtgcccgccaccacgcctggctaattttttgtatttttagtagagacggggtttcaccgtgttagccaagatggtctcaatctcctgacctcgtgatctgcctgcctcggccttccaaagtgctgggattacagacatgagccacagcgcccggccaaaacagactttatagcttaaaaatcgccagaacaggctctgagtcatactctcttgtagtgcatttagttggtgcatcagataaaatgtattgctttctgtatttcccacaattgaaaacagctgtttttattgtggacccagcttttaccttagcattcagctcattcacaagaaggttccaaggtggctatcaactgtgaaccataccaaaggattcagaacttgaatctgggaacaaaaaaaatcttgaccagaagttctcaaatagtttgatattttatgttcatattcctttactatggtagccatttttattacaaccaattttggttcagtcgttgtttaacacacattcccaaatagctttgacttataaataatgaaagaagagaaatcttttttaaaactaaacttttgtaacaatttaattttggtgggaaggaacaatttcagtgttagaaacttttaaagtaaattattttaaaatcgataatatcttagaactgactactgcatagcattcttccaaattagcatacttaatttatttttctgtaattcacccaaagatatttctagcattgcaaacatcaaacattccactcatataaatgatttcttagttacttgtgtctttagtgttgatctccagagtgtgactaaaattcatactatattaagttataaaagctttaatagtgaacttaggctaaagaaacatatgttttgtccaaccaactattgatttaattcactgtttttttttttttttttttttttgctaatttgtatttggcaccagggaaattccttgtttttctaggctaggatgctcagggcttcaatgagtagttagttgaatctttattctcatgatttctttgggatgcctccaccactgcagacactattatcagtgagaattttatctattctgctatctttgcctgttttactgtcttcacacccaggcatctgtaaaagtagcattacttttatatctttggtttgttttagttcctccagtggaaatgtcaatcaagattttttgtggcaaatcaatttgaaaacaggttcttggtttctgctcattttctgtttattataaagattttcataatcttatttctttatgatccagttatgttctttttttactttttcaactttgacagtttgtatccctgatttcatcttacagttttgctgtaaaagcactacctttcccctcttgtttaaattggcaaaaatgtttctgtaaatcctgtctttatcttcaaaagttcatcaaatactggccaaataaaatccagagagtctataattaaaatcacttccaaggttccttcacatttgcaagtttggttttaattcttaattttctctgtattattccaatttatggtattctctttttctgtcttcctctttactagtagtctgccttgtttacatgagggcctttatttccaacggaagaaaaactatttcccttaataatctacttatatttattctgaaatccaattttatttaggtactttttttttttgcagcttgcctataatttctacttcctgcatttatgtgtgtagaatttccaaacatattctgaagttgtcatcatctgagtgatgagacacagcggtggtctacgtagtaatattgtgaactaaggaattcctatttgtagtctttattcacttctgaaatacttattctgctttatagtattttgaaatgaaaaatgatgggaactctttgatatctacaattgtgttctttgtgtgtatgctttgaggaagtgtcagattttcttgaactagaattcatataaacctcttgtcctttgtggaatggggagcctccacacatccttccaggcagatctaaaatggctactcttgagacatgagcaaacatttgtcacatgatggagacagcaaggaaaagggctaagtaggggaagcagaaaactactttctcccttgggaaaaaactgagcagaaagccagacgtcttctggttctgactcatctcttgggcatactctgcaaaagctatggcgaagagtcagtgaattagaagattcactcagagtaactttttcctaccctgcaagtacctaccagccctggaggtgcctatatgagtagtacttcttaattggattcactctatgtttaaggtaaatgcttgatgttaataggttagttctagctccctactgggtataactcactgctcttctttctatcattattattattattattaaggcaagggtctcactgtcgcccaggatggagtgcagtggtgcgatcacagcttgctgaagcctctacctcctgggctcaagcgatcttcccacttcagcctcccaagtaactgggactacagggtatgcaccactatgcccagctaatttttatttttttttgtagagactgagtttcgccatattgtccaggctagtcttgaacgcctgaactcaagcaacctggctacctcggcctagcaaagtgctgggattacaggcatgagcccccacacctgcctatgtaaaaattccataataaacctaaggactcaattaatatatagtagtcactaatatttataaaacattttgaattttataaaattgtttttggattacattatctcgttttgggactcacaacaatgctgtaacttagctttattaaaccaaagcccaggcacatttacttctatagattctctctagtttaatttgtagcagagccaggagtcaaacccaaggatgctttactccatagtccatgtactgaacacgatatcgcactcgactctgctctgcattatgttttaggtttggacacatacatatatattggtctctgttgaattggacatactagttctctgggcattatctggttctttctggaagcccaactgcaaattggcgtttataaaacagtgtatttctggcaatgttacagatgtttgcagatttcatatgattcctactgttaggctaattttaacatactttgaacatcttttaactggttgctatttcttttacataagtgatagcatcactttccagtcttaaacttggttgctttatatcgttaatgttttttcagttatcctcatcttcttactgcctctgtgagcactgcttttaagtgaaataagatgctagagctgatgattaccaagcgatagagatctgtatctcaaggatacaacttgattctttttaaatatggaatattgttaagaatagctctgctctgtatgaacagggaattcaaacttttaaaaatgaaaaatgagaaccttcctgaatgaaattttactcaaatctcctattaaatcctaagaataggctgctggcttccattactttcaggaaatgaaaaatggcttagaagctaagtgagctaagtaagccatctctctctcaattgtttcagtttctcaggaattgctgccaataatgctgccaataatgatctccatggatctgacccccattccatctcccactgcctctgaagctccagatgtcaccaaaagaaggagctttgaagaaagtgcctgtaccctctttttaccctgaggtgggtgaggccaggcagggtgattctcaggatatcctgattatcaaaggtacagttgaagccttcatcaagactttcttgaagatgaccaagaaattcaggaaacactaccaaatagcctaagaactgaagatggagctcaagaatggatggcacaagtgccacctaaaatgtagtgcatgatgatatacacgatgattagtaagctccttgagggcagagaccattacaccatttgtagtcttccccctaccttcacaatatctagcatagtaccaaacatataaactatactcacttaataaatgttagtttattactgagagaaaagactatataaaaagtgctcttagggctgggcgcagtggctcatgcctataatcccagcactttgggaggctgaggcgggcggatcacttgaggtaaggagtttgacaccagcctggccaacatgatggaaccccgtctctactaaaaatacaaaaaattagctgggcatggtggcccatgcctgtaatcccagctactcaggaggctgaggcaagagaaacacttgaacccgggaggcagaggtttcagtgagccaagattgcaccactgctctccagcctgggagacagagtccgtctcccaaaaaaaaaaaaaaaaaaaccctcaaacccctcttttcttagtacttaatccatgatcaggaatggtgatacagttgactattatctcaggcttcttggccactattgtcttctgtcttgactatgtgttgggtaggaaatatgtatctgtctgtatattaagttttcagtattaatacttaaagttatgtcttctctgatgcctgggctttttatttcttagatgtttcattgcgacattcagttatttaatggaaatatctcatctgaaccacactcgaggaggatttattatactgtcagatataaaaatccatcttgtatctgttgttaagattcaacaataaacaatcttgctgcttgaataggtctacatcagtcatcattgtgtttcagaagtaggatgtactatcacatcaattttctaaaaaaaaatttaacgtgttactcttgaatgacagcatatagtcttacatctcacctgagcagtgcttcccatagcctgctaaaagactatttacagcaatgtgatttaagatactacttaattgaaacaaggctcatggtctatttctcttagagaaaaggaaacagcaacttagctccattcagttcttctgaccctaagttttcttagagaattaatcacatcttcttttaggagtgaactttcatttagaggcagatcttgaaaatcttcaactttttgatttattgtaccttttgcggctccagttacatgtaagtttttttatttgtaattttttcccatcaataagcatttcagattactagttttttgacaaacatgaggtagacattcattaccaactcttaatagctggcattttagattataaagaatccaatataagaatcaagtatattttattcaggaaaataatcttacatcaacaacatacttttcttttgagcgggagatgtaatatgctctatagatttgcggttttgctaaaagcatgaaagtttttgaaaggaaattgagtttctttgtcttcataagcttttatgtatatagccaaggatccttaagtgtacagctttaaaagaaacttactgtatttcatggataaattaattaccagtttttctagaatttgcaaaaggaagaaaaacatagaatctgaaaataatttctgtgaattggataggatgtgtgggtttaaggtttgaggctttactttcttttttttgagatggagtcttgctctgttgcccaggctgcagtgcaatggcgcaatctcggctcactgcaacctctgcctcccaggttcaagcgattctcctgcctcagcctctcgagtagctgggattacaggcatgtgccaccatgcctggctaatttttgtattcttagtagaggcagggtttcaccatgttggccaggctggtctcaaactcttgaccttgtgatccacccgcctcggcctcccaaagtactgggattacaggcgtgagccactgcgctgggccctcacatcaactttttaataaattacattgtaaattttgtcagtttatatgatgaattttaatcaataatccagaacagatttggttaaaatattgttagtaatttgtatcaatattttaaataatgttttaggctagtaacacatgaaaactaaatcatatcttgtttattcttccattaaaattagtttttcctctggtaatgtaacaggagaacttatgtatataagatctgtgaaattctgacaacaacatatagtgtgatttgtcctctgcttattttcctcctaatatcaggttacaagtcatgttattacaggggatgacagtggcagcaactaaactgtaacaagttctaacaaaagatggtttcacattatttttaaagttgaattttcctatgatttctatctttttctctttctccaggctcccagccaacctctgataaaccctcccagcggccatcagagagcacaaattgtagccctacccggaaaaggtcttcatctgagagtacttcttcaacaggctagtgctatttgttttaccagattttcaagatagtttcccatttgttatttgtgaataaggagttacaatattgtagaaaaaataatggggactgtatcatatatggtattttatttttccattcaaaggagttgaaacaatagacttggtatttgagaatcagtaatgtacattgaaacaatatagtagtcttcccctttacaaagctgaattaaagtaaaagtgtgtgttgggaataataggggaatgtggattgtagctgtttaataaagatttagatacatataaaattgcttaaggccaggcgctgtggcttacgcctataatcccagcactttgggaggctgaggtgggtggatcacctgagatcaggagttcgagaccaccctgttcaacatggtgaaaccccatctgtactaaaaatacaaaaactagccaggcatggtggcgtgcacctgtaatcccagctacttgggaggctgaggcaggagaatctcttgaacctgggaggcggaggttgcagtgagcggagatcactccactgctttccagcctgggtgacagagtgagactctgtctgaaaaaaaaaaaaattgtttagtaaactagtaatttccaaagtagcattcagaaatctctagggatatgcaaaataattaagagttcatgaggagaacctctattaatagttatttttaaacttcttaattgctaatgtttatatatttacaacctgttaatacatacaacatatttgtataatttatacagaaatttagggtatgcttccaattttctttttatggatagtttgtgtgtttaccaaaaaaaaaaaaaaaaagagagaggatgatttatacctgttttctgccttttcctgatggttgaagagtaagaaataatttttttaatgtattaattttactgagagagatggagagtgatagattaattccagatagtgaggaatatattaaagagaatttagagtgttcaggaaaataaataaaaaagccagtgtggtcagactaaagacggttggttggttggttggttggttggttggttggttggttttgagatgagtcccactctgttgcccaggctggagtacagtggtgcaatctcggctcactgcaaccactgactcctgggttcaagtgattctcttgcctcagcctcctgagtagctggaattacaggtgcccaccatgatacccggctaatatttttgtatttttagtagagactaaaattcgccatgttggccaggctggtctcgaactcctgacctcagatgatctgccggcctcagcctccaaaagtgctgggattacaggcatgagccaccgcacccagccaaagatggttttttaatatgaggctggaaacgtagtagagaattagtgatgtagagccttaaacacagttggaagttgtggaaacgtaaacaaggaagtgacattatctcctgcctttctatctctaggtctttgaagaagtagaaggcctttcaaattgtatcaatatggtatttgttgaatttagttgatgattatctttagaagctctttgttagtccagttgtctgcttggcagcaagtgatagttgtatctctcttggtgctttgtttttatactaccatggagagacttttgtactctaacaagaagtgacttaatttctctgatgtttacctagaccagggtaaggaaactcagcctatgggccaaatgcagtccaaggcctgtttttgtgtagccctcaagctaagaattatttttaggtttttaaaggcttggggagaaaagatgaagtataatatgaggtaagcattatatatgtcctcaaaagcctaaaatatttactctctggccttttacagaaaaagttcaccaacccctgaacaaatgaatgagattttgataagggacatatcaatgttgaaaatcaccaaaatattttacttttgtaaacaaaagaaagaatatctaaattcataatgtttcttttgcaatgagactattctgttcattgaattagatttctgttgagggttgctgtgagtagtgagcactgggaatacaaatacgagtaagattgagttactgccctcaataattcagacatattcactgaaaagcaatgtattaaattctgtaacagagcagtgtacaaaatgctatgacacagagaaattcaagcactaaccacttgaaatgactgaagaagatatcactgaataagtcacgcacactactgtatattgaatttacttaagtaggcaagtgggacaacataaagggtaataatgtagcacagtaacaacagcactttcgaagaaaggcacaaaaccatgaaatagcatagtgtttttgaagaataacccattgttggatatgactaatgtacataagtggtggtgatggtggttggaaaaggaggttgtaaaagcaataatggggactatatcatatatggtatgtttttttcattcagaggagttggaacttcattgtacatgcaattgggagctactgaacaatttctaacaaggaagataaattatttgatatgctctatcagtaagaataggataggtcttggagtgttaaaaaatgatccccaaatctcagaggcttaaaacaacaaaggcttattttttgttcatgctgtgtgaccatcaagagtccactccatgttgccttccctctaggaccccggctaacagagaacctgtaccttgaatgttgcttgtcttctggcggaggggaaagggccatagtaaagcactaagtggctattaaaatttctgcattaaatgttacttctcagtttcagtgccaaagcaagtcatgtggttaagtcttgtgtcaatgggactagaaagtataatccttttggcggtggggggtggatagcaaatatttgtaagtaatattatagtctatcatatgtgtatgttaaaaaatgctataacattacaatatgaagaatggagtgtgacaaatgcatgcagacagagtagataagggcttcagatttggatatattaaatttggactgtctttggcctatttaggtagagatattgaatagaccgttagaagcagtggtttatacttttagagacatctgtggtagagatctaccagtatatatatgaacttgaatttggcagtgaaagagatcatccagggagaatgtgttaagtgaggtgatggggacggagacctaagaaactcgagcattttggagggaagtggaagaaaagatgtttagtgaaggacacttaaataagaaacatcaaactgtatatgtcacagaagcctaaacaagacttcagaatggaatagattagtcaacattagatgtcacaaagagatcaagaagagttcgatcagaaagtgtcaaatgattgagaaaataagaaaaaatagtctgagaatgtgaaagtttggagcttgaaagagggaaaggagacttaaaattcaggtggcattgaaataaattagagctctttatttccagcaatgtggtagattaggtgtgcagagcaagcaaacaccttgttatctaaaacctgaaaatacatggacaacatttcttacagtatgactgaactttgaagtaactaaataggaaaccagaaacttcagaaagttcaattcaacagagataaagagcattagagctgcttgacatctgcttgatccctggtggctgggagtctggtaattggaacacatccagctggaagagacaaaagacagagcctaggactctagtagaacaaaaaaccacatatgcataaagttggaacccccaaaaggtgacacttaacaatgtacgggaaaatagaaataaacctatcatagaaaaggacagtttcttgttttagttttggctttggaaggaggaagaaaaaggagttcctgaccacaagctcttactaattctctgcctctcctacagatttatattgtttgtcagacccagaaaaaagttaaaataaaatttgtcataggtttgtaatgttcccagttgcattgcagagccaaatgcaaatactctagagaattgccattaaatataaacctgagctttcaaaatcactgtattcacaattttggttgacctagctttctcatatattgtagcaacacagggaatgacagcctttattttgcaatttaaaggcaaagaaataaaccagaatcatgtcctaaccttctaggtatagtcaaaggaataccatacctctagaaaccatctgtttagtaaactgaggtatgtaaacaactgtagaaacaaaaagcaatttgtattttggataagatgcctcaaggcccatccttgaactaaattcctgtttttgagataaatccaaagggataatatactaacagtatatgattttactgaaatctgtagtctttattatgcatatcaggaacccatagtaacaaaattattattgatgagtacaatctaagccttttctggaggtttttaatatcttattaggtctttaggatgtaatatgaggataactattttcatttctgaaatgagtatttgcaaatactctgttaaagtttacatctctcttagaggtctttttttaaatatttgtagcttttaagatatttatgtctctttgctcatttctcaggtatttgacataactgaagatttttataattaggacacaaatccatggtaattttcacattctagagaacataaatcccttcaatagtgtttcacagaatcatttcgtctttttatagctggtttacaaatattgttacattgatgagagaggtagttcttttataattttattactgagcaactattatattcaggctaccaaattcaactactattttaagccaaaagactataagagacattccataataccaaggaacttatgttaagatcaatttatcttgagagcaacaataaaatatgctagtgattttacataaatttatttatttatttatttattatttttgacagagtctcgctcttgtcacccaggctggagtgcagtgtcacgatctcagctcactgcaacctccacctcccaggttcatgcgattctcctgcctcagcctctcttgtagctgggattataggcatgtgccaccacgcctggctaatttttgtatttttactagagatggggtttcaccatgttggccaggctggtctcgaactcctgacctcaagtaatcagcccacctcggcctccgaaagtgctgggattacaggcctgagccaccactcctgacctgtatagtattattctacacataaccgaatgctgaaatgatggaaagttaatcagaaaatgcttccataatctttgtattgaggtttaaaagacatcatacatatgccatgactgaagaggtaagtgggagaagaggagaaggcattttgatgtaatgggaaaactatgtacttttgacttagatctagttgattcacatttagcaatatcatgtaaccttgtggaagttacataaaccattcaacccatggctttcttatctgtaacatgaggctactacttctatttatcttgcagactagtgggaattagagtaagtggataagaaattcttatcactgaattagtttttgagtaaatggtaacttctcttattttttgagatggagtcttgctccgtcgctcaggctggagtgcagtggtgcgatctcggctcactgcaagctccgcctcccaggttcatgccattctcctgcctcagcttcccgagtagctgggactacgggcgcctgccaccacgccccgctaatttctttttgtatttttagtagagacggggtttcaccgtgttagccaggatggtctggatctcctgacctcgtgatctgcccgcctcagcctcccaaagtgctgggattacaggcgtgagccactgtgcccggcctttttgttttttctttttttttgacacgcagtctccctctgttgcccaggctagagtgcaatggtgcaatctcggcttactgaagcctctgcctcccgggttcaagtgattctgctacctcagcctcccgagtagctgggactgcagatgtgcaccaccacaccagctaatttttatatttttagtagagatggggtttcactatgttggccaggctggttttgaactcctgacctcaggtgatccacctgccttggcttcccaaagtgctgagattagaggcgtgagccactgcacccagccataaatggtaacttctgttgttactgttgctaccgttggccctcctgccattattatgacggtatggaatgagaattaggtcatatacaagggagacggagtatagtggtaaagcataaaaaaagattgcaaaggcgtttagccacatttttttcttttttatgggatggagtcttgctctgtcacccagactggagtgcagttgcatgatcatggctcactgcagcctttgcctcccgggttcaagtgattctcctgactcaacctccacagtagctgggactataggtgtgtgctaccacgcctggctaagttttgtatttttagtagggacagggttttgccatgttagccaggctgatcttgaactcctaaccacagatgatctgcctgcctcggccccccaaagtgctgggatttcaggcctgagccactgtgcctggcctgtttagccacatgtgatgagtagtcttaaatctttgctggctactaggccctccttgcatagagtgaaactccaaaaaaatggcctaagaaaaactagggagttgtatatgaaaaattcctaaggtttacatgtggcatgagacatttgaactctgactaccaactgtagagtccttggggacaattatgaaggcccccataaagattacatcttggtcagacgtggtggctcacacctgttatcccagcacattgggagaccaaggcgggtagatcacttgaggccaggagttcgagggcagcctggccaacatggcaaaaccccatttctactaaaaacacatataaattagccagacatggtcacgcacacctgtagtcccagctacttgggaggctgaggcaggagaattgcttgaacccaggaggcagaggttgtaaacccaagattacaccactgcactccagcctgggcaacagagcaagaccctgtctcaaaaaggaaaaaaaaaaaaaaaaggttacaccttagcagggctaaagtatctctggaatgaagattacactagaccctagtaatgatttaaaacaggattcaaggaatcaaactgtcaaactgttctacaaataactgatttttaaaacaaagttcaacatttaaaaacattttaattgtgaaaaaacaaaaattttttttaattgtggcaaaatacagacaatataaaatttaccggcaggacgcagtcggtcacgcctgtaatcccagcactttgggcggccgaggtgggcagatcacctgaggtccggagttggagaccagcctggccaacatggcaaaaccccgtctctactaaaaatacaaaaactagccaggtatgatggcgggcgcctgtaatcccagctactcgggaggctgaggcacgagaatcgcttgaacccaggaggtggaggttgcagtgagccaagatcatgccactgcattctagcctgggtgacagagtgagactgtctcaaaaaaaaaaaaaaaattaccatcttaaccatttctaaagccgtgtgcaatggctcacgtctgtaatcccagcactttgggaggctgaggcaggcggatcacctgaggtcaggagttcaagactagtctggccaacatggtgagaccccatctctactaaaaatataaaaattagccggccatggtgacacatgcctgtagtcccagctactcaggaggctgaggcaagagaatcgtatgaacttggaggcggaggctgccgtgagctgagatcacaccagtgcactccagcctaggagatggagctagactccccatttcttttcttttctttttttttttcagagtctcgctcctgtcgcccaggctggattccaagtacaagcgattctcctgcctcagcctccaagtaactgggattacaggtgtccaccaccacgccagccaatttttgtatttttagtagagatggggttttgccatgctggccaggctggtcttgaactcctgacctcagggtgatccgctggccttggcctcccaaagtgctgtgattacgggcgtgagccacccggcgctgcctagactccccatttctaagtgtacagttaattcactagtgttaagtacatttacattattgtgcaaccaatctccgtaacttttttcatcttgcaaaactgaaactctgtatccattaaataagaacttcatattcccctgtcccttcagtccctggcaatcacccactaaagtggaaccatacggtgtttgtttttttgtgactggcttacttaacttagagcataagttcctcagggtttattttttatttatttttatttctttttttttttttttttgaggtggagttttgctcttggtgcccaggctgcagtgcaatggagagatctcagctcactgcaacctctacctcctgggttcatgtgattctcccgccttagcctcccgagtagctgggattacaggcatgtgccaccatgccaagctaattttgtatttttagtagagatagggtttcttcatgctggtcaggctggtctcagactcctgacctcaggtgattcgaccgacttagcctcccaaagtgctgggattacaggtgtgagccactgcacccagacagggtttatccattttttagcatgtgtcagaattgccttcccttttaaggctgaataatattcctttgtatgttttaccacattttgtttattgttatttgtttataaatggttacttgggttgctaccaaccttggccatttgtgaataatactgctatgagcaatggtgaacagatacctcttccagaccctgctttcagttctttctggtatatacccagaagtggaattcctcgattatatggtaattccatttttaattttttgatggattgtcctactgttttccacaatggtgtgccattttacattcccatcaacagtgtacaaatgttccagttttttcaacttcaacattttttaaaggaagacaacaaaatccaaacacttaatagttatccaaaatgaagtacagagtggaataaaagattgaccaaaaaaatgaatgaaactttagtgacctgtggtacaatatcaagagggctaatatacatgggatagagtctcataaagaacaaattgggaatagcagttgaagaaataatgtttaatatttctttcacactttcattaaaactatatcccacagatcgatgaaactctacgaatcccacgtaggataaacacactgacagcatacatagacatattaaaggacattattaccaaatttctggaaaacgattgtaaagagaaaatcttaaaattaaccagcagaaagaaaattaaaaacacatacatacaaacacatacagaggaacacagtaacaactatcagcagacatattgtcagaaattttacaagccaaaacacaatggaatgatgtctttaaatgtggaaaggaaaaataacatctgtcaacttaaaattttttaaccagcaaaaatatctttcaaaaatggaggcaagataaacattatcagaaaaagaaaagtttaaagaatttgttgccagtagacctacagtagcagaaacactaaaggacgttcttcagatagaaagaaaacatagtaggtagaaacatggatctaccaaaggagtaaagagtgccagaaattgtcaaccaatgggaaaatataaaacacatttttctcggctgggcgcagtggctcacgcctgtaatcccagcactttgggaagctgagacgggcagatcatgaggtcaggagatcgagatcatcctggctaacatggtgaaaccccatctctaccaaaaatacaaaaaagtagccaggcatggtggcgggcgcctgtagtcccagctactcaggaggctgaggtaggagaatggcgtgaacctgggaggcagagctggcagtgagccgagatcgtgccactgcactgcagcctgggtgatagagcgagactctgtctcaaaaaaaaaaaaaaacaaccacatttttctcatattcttttgaagtgcgtgtggaattataccaagataccatcctattctgggtaatcaaatgtcttgatacgttttaaaagattaaactcatgcagaatatattttcagaccacaacagaattaaattagaattcagtaacacaagttatgaaattctctaaatatgtggaaattaaataacacacttctaaataattcataagtaaaagatgaatccccaaaaatgaaatcagaaaatactttgaaatgaataaaaatgaaagacacatagggccgggcgtggtggctcacgcctgtaatcccagcactttgggaggccaaggcgagtggatcatgaggtcaagagatcgagaccatcctggccaacatggtgaaaccctatctctgctaaaaatacaaaaaaattagctgggcgtggtggcacatgcctgtagtcccggctgcttgggaggctgaggcaggagaatcacttgacctcgggaggtggaggttgcagtgagacgagatcgtgctactgcactccagcctggcaacaaagcgagactccgtttaaaaaaaaaaacacacacacacatagaaatttgtgggataatctaagaatatttatagctgagattattaaacaccaaagatctatctaagtcagttctcacctttaggaagctgaaaaaagaagagcaagtaaaacctgcattagaaagaagatagtgggctgggcgcagttgctcacgcctgtaatcccagcactttgggaggccgaggcgggcagatgaccaggtcaggagtttgagaccagcctgaccaacatggtgaaacccagtctctactaaaaaaatacaaaaattagctgggcgtggtcacgcgcacctgtaatcccagctacttaggagtctgaggcaggagaattgcttgaactgggaggcagaggttgcagtgagctgagatcgcaccattgcactccagcctgggtgacggagcaagtctccgtctcaaaaaagaagaaagtgaaagttgggtggtgtggcacccctgtgcctgaagtcttagctacctgcgtgactgaggcagggaaaagactacttaagccaaggaggttgaggctagtctgagcaccttggcaagacccatctcaatacaacaacaacaacaacaacaacaaaacgaaaagaaaaataaaaattagcccagaatagccaaagctatttctaagctgaaagggagaaataactttacctgacttcagttatgctacagagctatgataaccaaaacagcatggtactagcataaaaatagacacatagaccagtggaacaggagagagaacccagaaacaaatccacacacctacagtgaacttatttttgacaaaggtcccaagagcataaagtctcttcaataaatagtgctgggaatactggatattcatatgcaaaagaaaaacttgacccctgtctctcagcacatacaaaaactgaaatcaaaatggatgaaaggcttaaatctaagatctcaaaagtatgaaactactataagagaacattgggaaaactctcccggatattgatctgaacaaaaatttatgagcaataccccacaggcacaggcagccaaacaaatatggataaatgtgatcaaatcaagtaaaaaagcttctgcacagcaaagtatacaatcaataaagtgaagagacaacccacagaatgggagaaaatatttgcaaactacacatctgacaaagtgttcataaccagaatatgtaaattcaaaccactctataggtaaaagtctaataatctgtttaaaaaatggacaaaagactgaagagatatttctcaaaagaagatgctacaaatggcaacaggcataggtattcaacatcattgattatcagaggaatgcaaatcaaaactacaatgagatatcatctcaccccaggtaaaatggtttatacccaaaagacaggcagtaacaaggctgagtgtggtggttcactcctgtaatcctgtcactttgggagcctgaggcatgcggattgcctgagctcaggagttcgagaccagccttgagcaacacgtgaaaccccgtctctaccaaaaatataaaaattagccagtctcataacccagtctcaaatcaattaataaattaatattttttaagaaaaacaatacatgagaaaaatcacctaattgtctaagtagattaagggaacatatttgacaaaatttgacatccattcatggtttttaaaaaaaagctcttagaaaataagactagaatagtatttgctcaacccattacagggtgtttgcagaaaaacctacagctaacctaacacttaatgttgaaagactgaaagcttcctccctaagattggggaaaaggtatagatgtccactacttctattcagcattatagggaagtcttaatgtcttattcagaaataatacaatttgcagaaaattcccaaggaatttgttaaaaagttgctggaacttaataaatgagtttaacagtacaatttctgtgtgtttaagctcaacatatagaaataattgtatttctacatacagtgaacaattagaaactgaaatgtagcgccgggcgcggtggctcacgcctgtaatcccagcactttgagaggccgaagcgggcggatcacgaggtcaggatcacgatgaaaccccgtctctactaaaaatacaaaaaaaattagccgggcgcggtggcgggcgcctgaagtcccagctgctggggaggctgaggcaggagaatggtgtgaacccaggaggcggagcttgcagtgagccgagatcgcgccactgcagtccagcctaggcgacagagcgagactccgtctcaaaaaaaaaaaaagaaaaaaaaaaaaaagaaactgaaatgtagccaggcatggtggctcacacctgtaataccagcactttgggagacagaagtgtgtggatcgcttgagcccagaagttccagaccagtctaggcaacatggtgaaaccccatctctgcaaaaattacaaaaattagccgggcgtggtgccgcacacctgtagtctcagctactcgggaggctgagacatgagaattgcttgaacccgggaggtggaggttgcagtgaaccaagatcatgccactgcactccagcttggatgagagcaagaccttgtctcaaaaaaaaaaaaaaaaaatttaattaattaattgaaatataaataatactatttacagttgtattaaaagccattaaagtcttaacgataaatttagaaaaacatgtacgggatctgtataataaaaagtacagtggccgggtgcggtggctcacgcctgtaatcccagcagtttgggaggccgaggcagatggatcatttgaggtcaggagttcgagaccagcctggccaacatggtgaaaccccgtctctactaaaaataccaaaaaaaaaaaaaaaaaaagtacagtgtaggcccagtggttcatgcctgtagtcctagcaacatgggggaatgaggcaggaagatcatttggggccaggagattcagaccagtgtgggtaacagtgagaccttgtcccttagggaaaaaataaaaaataaaaaatgtacacacacacaaacacacacacacacaatctatgtactcactaaaattaaaattaaatcacaaaaaattaaaaaaatacaaagtctttttgagaaaaattgaagaataagtgggagagatatgtcagaggcatttttgaaagactcattattgttgagatgtcacctttctccagatcactctgtagagtcagtggactcaatacagttgcaacaggattttaatataaactggcagactgattctaaaatttacatagaggccagccgtggtggctcacacataatcgcagcactttcggaggccactgcaggaagatcacttgagcccagaagttaaagaccagcctgggcgacagacacttcgtggcttatttttttttaattattaaaaatgaaatttagaccaggtgtagtggctcacccctgtaatctcagcactttggaatgctgaggtgggcagatcacctgaggtcaggagttcgagaccagcctggctaacatggcaaaaccccatctctactaaaaatacaaaacattagctgggcatggtggtgggtgcatgtaatcccagctactcgggaggctgaggcaggagaattgcttgaacctgggaggtggaggttgcagtgagcagtgatcacgctattgcactccagcctgggcaacaagagtgaaactccgctaactttcaattgatttttgacaaatgtgactatttcaatgggacaaggatagtcttttcaacaaatggtgctgtaactactggatatccttatggaataaaaagatcactgaccctgtttcataccacatgaaaaatttaaatcaaaaaagatcatatacccctatgaaatttcggaaataataaaacttttagaagaataggaaaaaatctttaagaccttgggagatggtcaaagatttcttaaatagtataaaaagcaagggccatttaaaaaaatttgacttggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcaggcacctgtaatctcagctcctcaggaggctgaggcacaggaatcccgtgaaccccgggaggtggaggttgcagtgagccaagattgcaccactgtactccggcctgggtgataaagcgagacttcatctcagaaaacaaacaaacagaaaacattatttaagaaaatgaaaatgtaagccaaaaaataaaagaacccaataaaaataatcggcaaaagatctgaatagaattttctcaaaagaatgcatatgaattgccaataagctcatgaaaatatgctcaacatcagggaaatgcaaattaaatttataaatgagaacacacccattagaatgattaaaatgtaaaagactgcataataccaagtcttggtgaggatgtataggatctttaactcagtcattgatgatgggactataaaatagaacaatcactttgtaaaaatttcttaaacatacaattagttgatttagtaattctaggcaggttgcagtggctcacacctgtaatcccaggactttgggaggccaaggcaggtggatcatttgaggtcaggaattcgagaccagcctggccaacatggtgaaattctatctctactaaaaacaaaaattagccaggcatggtggcaggtgcctgtagtcccagctactcgggaggctgaggcaggagaatcacttgaacccgggaggcagaggttgcagtgagccaagatcacgccactgccctccagcctgagtgacagagcgagactccgtcgcaaaaaaaaaaaaaaaaaaaaaagatttagtaattccagtcttaggtattcacccaagagaaatgaaaatatgtttaaacaaaatgtcatgtgcacacatgttcataggatattttttctttatgactaaaaactggaaacaacgcagatttccaggtgaatatgtaaagaaattgtggtatattcatataattcagttgtaaaaagaaatatgtgaatagtaaaaaggaacagtaaaaagaaatgtggcaatgtgaatgattctcagatttatgctgtgtgaatgaagccgtacaataaaatacatattctttcttttcatgtatatgaacttctagaaaagcaaacttaatatataacaggaagcagatcagttgtttcttctctgaggctgtggatgacaggcaatttattttcttggaaaggacacacagtaactttttagggtgacagaaatgttctatatattggttatgatgatggctacatggtaaatttttcaaaactcaaaaatgtatatataaaaaacatgcattgaattttatgtggtactttaccacagtgaagttaattttgaaaataagttacatctaaaatatagtgtgcagcatcatgtcctagactaccaagaaacataaattggcaggccagaatttgtgaagataggaacaattcaaaaatgaagtgtgaggtattaatagctctaggtgaatggcccaggaaggaggcttcaaaagtgtgtacccattttaggattctcttttaaactgatattcatggattaaatgcattggtagctctgagtagttgatgaagggatagaggagataaaaataattccaagattttgatcccaggattcattcttcaactacgtgttaatgaattatgtcctggtcattggagataaaaagtgattttggtgaatatagtcaccgcgttaatggaccaaacattgtttgagaattacatacattaaaccactaatttgaagtgtgattagtgttaggaaaggagaaagtattaggataattcttaataggggacctaaattaagaatgaagagggtgcttcctggtcaggtaaataacctttcaggaaattatgtcctcactgtaaactaaagaatgaatagtcattaagcagatgaatttgtggagaaagattgttccaggtagagagaaaggcagactcaaaggccttgaatcaagaaaaaacatgatgagtttaaggaactgaagtttattattactagaattagggtctaagataatatgagattgatgctagaagaaaaggtaataataattttgaagttgttttatgtggtaagagcctttttaagagttgtaagcagaagctgaaacctgataaaatttgtgaggtttttttttttttgattttttttttttttttttttgagatggagtcttgctcttgtcgcccaggctggagggcagtggcgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaaaaagattctttattcaaatatctggtggttgatactggttgttggctgtgacctcagcaggatctgttggccagtatgccaactcattgcttgggcttccttgcagcttggaagcttgaatccaagggcttgtggcggggccggggtgggagtggggggtggagatagagagagagacagaccttttctaacctaacattggaaatcatcacattcttctattgaatttctttgctaaggcaagtcttcagtggcagcagagagggactagactacaacttgatagggaaacttcaagagattaatgtacgtattttaatagccccacaaggaattacactattgcttcagggcagggagataacattatcttagtcttgatggctgtagtagaagaaaggaaagtggacaggttcaagagtttaaactaacagaagacagaattttatgatttgtggggagggtgaaggagccagaataaatgatgtggcctgagcttagataaccaacgtcctgccacacgatggatggtcagtatacataatgttagctttatggtatcattcactgatgtagggaatctggatggaggagctagtttgaagggagcgaaaatgaaatgagatgtgaatatgagtttgagaaatctgtgaaacatgcaaaagtagacaattagaagaaaggtctattcagaaaatagaaattcagtagtcatcagaatatagatgatagttaaaagaattgctaaagagagaatagagagtcagacaggaaaaaagctcaggctagaaagtttttaaaaactatagcatttaaaggttggagaaaaggaaggggtcatttttcgttttggtaattttcagataaaactgaagattggtatgaatatttagaagtcacttacatactgatgataattgagactatgagaataaacatgttcccagtgggaaagtaagtataaaaggtaaataacaagtactctgtattgaggacctccgcagttaaatttaatggagttgcaagtaattgaaagttaatcaaaggatattatagaaatagtgtaggcaggattttaaagaattatgaaatcaaatatagctgagagtttgaaattttttcctttttttaaattttattatttttctagagacagggtcttgctctgtcatccaggctggaatgcagtggcgtgatcatagctcactgcagcctcaaactccatggctcaaacaatccacccgcctcagcctcctgagtagataggactacgggtacaggaaaccacactgggctaatttttattttttgttgagacagggtctcagtacgttgcccaggctagtctcgaactcctggcatcaagtgatccttccacctcggcctcccaaaatgctgagagtaccagtgtgagccaccgttcctggcctgaaaatgtttaaatatcaaattgagacaagggtctataggccagagttgatgataaaataaaaaaaaaagtcttaaaaatttagacaaggctattggatattatttgaagaaagttattggtaatttgagaaaaattccacagtctgatgatattggaatctagaatgcctgaggctaataaaggaatatctagtatagttatcacatttaaaagtcatatagataagaaatccattaattaactttggagaagtatgacccatgaataatagtagtaaactaggcagcatgggaagtgacttattttgaactgatttttaaattattagtattttttgagacagggtctcgctctgtcgtcctgattagagtgcagtgactcactgcagcctcgacctcccaggctcaagcagtcttcccaacttagcctcataaatagctgtgaccataggtttcagccagcatgcctggctaatttttttatattgtttgtagagacatcttcttgctatgttccttaggttgatctcgaattccttagctcaggcattcctcctgccttggcctcccagaatactgggattacagacatgagccactgtgcccactctttatccaacatttaagtcccttagcttaactggaccttaatttattttttatttattttttatttttgaccttcatttttgaagaattaaatttttttctttctaatccttacctcaaagtgagagttgttctttttaaatttacatattattagagaaatataggccaactttggttttatcttgttgtaataacctttttcaggaaagtaaaccatcaatttacctatgatgtgtaatcttgctatggaaaatagagtagtactcccttttatctgtgtaaaaacttatttaaataactagccgtgtccaattttgtctatgtgtgatttattgtctctttcagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaaggtaattcctcatttaacatattatctgagtagaggaaactagctttgaaaaactgtaatgtaactctatagctgaattatttcatcttataacctttcattttttactatatgagaccatttcttttcaaaaactgttcttatgtattgcttttacaagttataattaagaatcagagaggctaggtgcagtggctcacacctgtaatcccagcactttgggaggccgaggtggatggatcacttgaggtgaggagttcaagaccagcctggccaacatggtaaaccctttctctactaaaaatataaaaattagctagatgtggcagcgcattcctgtaatcccagctactcaggaggctgaggagggagaattgcttgaatccaggaggctgcagtgagccaagattgcaccgctgcactccaacctgggcgacagagcgagaccctgtctcaaaaacaaacacaaaagaagcaaagggcaagtaaccatccactctgaacccactcactttacagacaaaggaaatcaaggcccagaaagattatgtattttatccaatatagagatgtatgagctctgtgatcattttatgtgcataccacattttgcttatccattcatccattgatggatacctggggtgtttccatgccgtaacgccgctatgacagcgggtatacaaatacctctttcagaccctgctttaaccttgggcatattctcagaagtggaattgctggatcatgtgacatttctatttttaattttttgaggaactgccatactgttttccagaagggctgtaccattttgcatgcacaaagatttcagttacaatgcacaaggatttcagtttacatcctcaccaacacttgctattttcaattttttttttatagcagccatccaaatgagtatgagatgggtatctcattgtagttttaatttgctgttccctaatgattagtgacaaacatattttcatacgcttattggccatttatgtatctttagagaaatgtctactcaatcgctttttcaattttttgattgggctatttggtttgttgttgagttttagcagttctcaatatattctggatattattctcttaaccggcatataagcaaatcttttctcctattctgtggattgcatttttactttgtttatgctgtcttttgacgtacaaaattttctgatatctatgaagtccaattgtctgttttatctataaagctatggtaatcaaaaccgtatggtagtagcataaagagagacatatagaccagcgaagtagaatagagagcccagaaataaaaccttgcatgcatggtcagatgatttttgacaaaggtgccaaaaccattcagcagggtaaaagacagtctttttgacaaatcatgctgggaaaactgggtatctgcatgcaaaagaatgaagttgtagtcttactttaaaccatatacaaaatctaactcaaaatggatcaaagatgtaaatgtaaaatctaaaaccagaaactcttggccaggcgtggtggctcacgcctgtaattctagcagtttgggaggccaaggtgggcggatcacgaggtcaggagttcaagaccagcctaaccaacatagtgaaaccccgtctctactaaaaatagaaaaattagccaggcgtggtggtgtgtgcctgtaatcccagctacttgggaggctgaggcaggagaattgcttgaacccaggaggcggaggttgtgatgagccgagattgcgccactgcactccagcctgggtgacaaagcgagactccttctcaaaaaaaaaaaaaaaaaaaaaaagtccacgcatggtggctcacgcctgtaatcccagcactttgggaggctgaggcagctggatcacctgagggtcaggagttcgagaccggcctgatcaacatggagaaaccccgtctctactaaaaatacaaaattagctgggcatggtggcacatgcctgtaatcccggctactcaggaggctgaggcaggagaatcccttgaacacgggaggtggagaggttgcagtgagccgagattgcaccatcacactccagcctgggcaacaagagcgaaactttgtctcaaaataaataaataaataaataaaaataaaactgtaaactcttaggagaaaatatagggcaaaagcttcacagcattgaatttggccgtgatttcttagatgtaataacaaagccacaggcaataaaccattcttatttttatttatttattttttgagatggagtttcactctgtcacccagcctggagtgcaatggcacgatctccactcactgcaccctccacctcgtggtttcaagtgattctcctgcttcagcctcttgagcagctgtgattacaggtgcgcaccaccatgcctggctaatttttgtatttttagtagagacgaggtttcaccatgttggccatgctagcctcgaactcctgacctcaggtgatccacccgtctcagcctcccaaagtgctgggattacaggcgtgagccaccacgcctggcccatatttaatattttttaatgaaccaatttaatgttcatcatttataaatggcttttcttaatgtggcatgttcactcttactcatattctctatcatctctcctggtgaatcctgtatagagagggtttttttttttttccatccacctatataaaaataattgcttttttctagagaatatattttttaatttcaggagcaatacacgctggtaataaataatttaattaaactagtagtttactgatttaaaagtaaaagtctcttttcacatgctctcacttgctcttatcccattcttctctccatggataacgctattaacagtacattgtgtattctttaatgctgagagcttgtcatcagaacatacagaattaccttatactgtggtaggaatatatcataatttatgtaattacactgttgtgattgactagatcttgcttttttatatttagctctttatgtcacttatgtaatactgaatattagctatgagttagaggtttaattttctttcagtactattgattagtttagccattcccaacttatttggaatgatacatttatcatacactaagtttttgttgttgctgttgttgttattgtttttgagaccgagtcacccaggctggaatgcagtggcgcaatcttggctcactgcaacctctgtctcctgggttcaagtgattctcatgcctcagccacccaagtagctgggattacaagcatgcgccaccatgcccagctaatttttgtatttttagtagagacggggtttccccatgttggccaggctggtcttgaactcctgacctcaagtgatccgcctgccttggcctcccaaagtactgtgattacaggcatgactcaccacacccagcactaaattctttttttctttttttttgagacggagtctcgctctgtcgcccaggctggtatacagtggcacaatctcggctcactgcaacctctgcctcccaggttcaagtgattctcctcctgagtagctgggattacaggcgcacaccaccacaccaccatgcctggctaatttttttgtatttttagtagagacgggtttttaccatattggtcaggctggtctcaaactcctgacctgatgatcctcccgcctcggcctcccgaagtgctgggattacaggtgtgagctacggcgccccaccatcctaaattcttatatactgttagatcttagggtcttttcaattttttttttttttttttttttttactgtgtcccaggcttaagaaaaaagtgatacatgatgtgggattaaaatcaagaacatcattgaacttcaccttccctccaaccagttgccccaaactcccctgcccccaccctttgtgttcccaattccttccttagtgaatgaagaacttaattccaaaagccctggcacaaactccaggttctctttccctagctcctcccctccccctgtcccccattcctagaagggcaggcacctcagtttgaatgcatgggagagcccagggtggtgacggagacgggggaaaggcttccccctcagggaaagggaccgaggagtacagtgcagtgaagtgagggctcccatagcctggggtaccaaaatggggccctggggccagaggaaaggacactggtccccctgagaaaggagacccagcagcctcaaaatcctctcgttgtgcatagtcgctgcttgatcgcttgcccttctggcgccggttacagaaccacactcggaccacatccttctcgagcccaagctgctgggcgatgtggctgatctgctgcagtgtgggtttcgggcactgcaggaacaaattctccaggttgcctctcactcggttctcgatactggttcgctttctctttcgggcctgcacgagggtttctgctttgcatatctcctgaagattttcattgttgtcagcttcctccacccacttctgcagcaagggccgcagcttacacatgttcttgaagctaagctgcagagcctcaaagcggcagatggtcgtttggctgaacaccttcccaaatagaacccccagggtgagcccacatcggcctgtgtatatcccagggtgatcctcttctgcttcaggagcttggcaaattgctcgagttctttctgcagagctttgatgtcctgggactccttcgggttttgctccagcttctccttctccagcttcacggcaccagaggggacggtgcagggctccggggaggccccatcggagttgctctccaccccgactcctgcttcgccctcaggctgagaggtctccaagccgccttggggcactagccccactccaacctgaggcccacagtacgccatccccccacagaactcatacggcggggggcatgggggaatcccccacacctcagagcctggcccaacccccggcccgattcctggccctccaggagggccttggaagcttagccaggtccgaggatcaacccagcccggctccggcccccctggcccatcacctccaccgcctggagggggcaagaaggcaggcatccgaagccaggtgtcccgccatggggaaggaaggcgccccaagctgggggcctggtgaaatgtcaaatatttttatattcctttctatcagtctattttggtatctctgtcatagcagtttaattattgaagctttaaaacactgacaaggaggatgatttctgcctttactgtagtttgagacatcttgaccatttatgttaggaagggtcatctttaaaatgtgcttcaagaaaaggctttcatcagcctgggtaacatggtgaaaccccgtctttaccaaaaaatacaataaattagctgggcgtggtggtgttgcacgcctgtggtcccagctacttgggaggctgaggtggggggatcgcttgagccagggaagcagaggttgcagtgagcctagattgtaccactgcactccaacctggatgacagagtaagacttcgtctcaacaacgacaaaaaaggcttttgaataggttagcctttctattccagcaaattctagtatcatggtcagcaaaattaaacacatactttttcacaagattgtattctgagatttgaagagattataaagagaaagataaaatttctgccctcaagagattgtgtagggaaggacatgacacactgagttcccagagatagcaacagtttttcaacttgttctaattggagcttacactagtacttgttatataatatgtattcatttattttttcaattagtatttgttggaagattattatgtttcatgtacttagaattgatagagtggtgaataaatctagaaacttttcctaccttcatggattttaaccatccaagtgctattatgaagagttacttagagttataagagtactgtatataatagaaataactaacttagtttcccagaaaaagtaaggactatgctaaaaatgtgaagaataggcttcatctgttatttaaaggagtgaggagagagcatacacaaaagtctgaaaaagcatgatagtttcaggcaagcgaaagaaagcttttgtggtcaaaacatggagtagagtagcatgggatacagatagaggttgtagggatcagattgtgccaagaaccttgtatgatatattaaagattttggtcactatttgttgattaatataaaaccagaatgcacaggaagaatttaatggttatgaggtgggcttctagactcggaaaacctaggttcaaatcctggttttaaaaagaaaaaggtatatttttaaaacacttataaatttttgctgtaaaaaataaaatcaggccaggtgtggtggctcacacctgtaatcccagcagtttgtcaggctgaggcaggaggatcacttgaggccaggagttcaagacagcctgagcagtgtggctggttgtagctaccgtttctacaaagaactgtttgtttgtttgtttattttagacagggtcttgctgcgtcccccaggctggactacagtggcacaatctcagttcactgcaacctccacctcccgggctcaagcgtctccacccccatccctcccccacagtggctgggactgcaggcgggggccaccaggcctggctaatttttgtgttttttgtagagatggggtctcactatgttacccaggctggttttgaactcctgcactcaagcgatcctctcaacttgacctcccaaagtgctaagattacaggtgtgagcaccgcacctggtccatctctacaaaacatttaaaaattaaatgagcgtggtggctcgtgtctgtggttctagctacttgggaggctgaggtgggaggatcacttgcactcaggaggttgaggctgcaatgagctgtgttccttcactgcactccagccttggtgacagagtgtgaccttgcctctaaaaatacatatatattatagcaagactttgtctctaaaaatatgtatcttataatgtatattatatgtaaatattatatatatatatatttttgttgttgttgagacggcatcttgctctgttgcccaggctggagtacaatggcttggctcactgcaacctccacctcttgggttctagcgattttcctgcctcagcctctggagtagctgggattacaggtcctgccaccatgcccggctaatttttgcatttttagtagagacagggtttcaccatataggccagggtggtctcgaactcctgacctcaagtctgcccaccttggcctcccaaagtgctgggattacaggcgtgagctaccacacctgaccgaaaaaaattgttaagagcttgctggccacaccaatagtctcagctactctggaggctgaggctggaggattggttgaacccaggagtttgagaccagcttgggcaatggcaaaaccctatttctaaaaacaattttatgaaaataagaaattaaaagaacaagtgaatgagcctgaaaatgatattggaagaatgtaaaacatacaccttaagttaataaaataaggcaaatgtataacagtaagagtcacttttaagaccaaagttctttgaaaactaataaaatagacaaacttctggtaaagccgatcaataggaatgagaaagggaataaatagggatttaaaaggaaataaagtgtatataagagattaaaaatttactactgtgagaactttaagcccatcaaatgggaaaactgttgaaatggacatgttcctagaaaaatacaattttaacaaaacatactcaaaagaaattacctgagcactcctattgcctaaattgaatctattatttaaagtcttgccccaagaacagcatcagacccaattttaacttctaccacactttcaagaaaaatattattcccatctcattaaagagaatatgggctgcaaacagaagaggatacatctaaagagaatacataaacaggccagatgaggtggctcacacctgtagtcccagcattttgggaggcagaggcaggagtattgctggagcccaggggttgaagaccaccctgggcaacatagggaaactccatctctacaaaaaacttaaaaatcagccaagtgtggtggcgcatgcctgtaatcccagctactcgggaggctgaggcaggagaattgcttgaacctggcaggcggaggttgcagtgagctgagatcgcatcagtgcgctccagcctgggcgacagagtgagactctgtctcaaaaaaaaaaaaacttaaaaatcagctggacgtgctgatgtgtgcctgtagtcccagctactagggaggctgaggtgttaagggattgcttgagcttgtccaggaggtcgaggctacagtgagccataatcgtgccaccacattccatcctgggtgacaaagcgagaacctgtcttaaaaaacaaataagagacaaacaagagaatacataacataagctaagtaaattttctgtagaggtcgtacccatataaatattcaggaggtgaccatactttccctgtttgtaaaccccttttcttgccagaagctataaccaatcttctgacttttaaggtaaccacatatttaccttttaaaatactatttatgtgtgcagctctaaacaatacagcttattcttcctgaatttcatgtaaatctaattatacaggttgggtgccatatcatgcctgtaatttcagcaattttggaagccgaggcgtgtggatcgcttgaacccaggagtttgagagtagcctaggcaacatcgtctctactaagaatacaaaaagttagccagttgtggtagcacacgcctgtagtcctagctactcaggaagccaagtgggagaatcacttgagcccaggaggtagagattgcagtgagccaagatcacatcactgcaatccacccagggtgacagagtgagaccctgtctcaaaaaagcaaaaacaaacaaacaaaattaattacagaggacatatactattgtgtctcacctttttttgctcaacatagtcatgttaaattatgtatgttaatgcatgttgctgtagttttaatgtgttgtttcattgtttgtgtgtaatacagttcttcgattttactcttggattattttcaacttgaggttattgcccaaaaaaactgcttttaatattcctctaatgtccactggtggatatggacactaatttctctaaagcattgtatatatatatatgccgagaccagctcggtcggggagaccctaacccagtggcgctagaggaattaaagacacacacacagaaatatagaggtgtgaagtgggaaatcgggtctcacagccttcagagctgagagccccgaacagagatttacccgcgtatttattaacagcaagccagtcattagcattgtttctatagatattagattaactaaaagtatcccttatgggaaacgggattaactaaaagtatctcttatgggaaacaaagggatgggccgaaataaagggatgggtttggccagttacctgcagcaggagcatgtccttaaggcacagatcgctcatgctattgtttgtggtttaagaacgcctttaagcggttttccagcctgggtgggccaggtgtttcttgcccttattctggtaaacccacagccttccagcgtgggtgtcatggccatcatgaacatgtcacagtgctgaagagattttgtttatggccagttttggggccagtttatggccagattttggggggcctgttcccaacatatatatatatatttttttttttgagacggaatttcattgttgtcgcctaagctagagtgcagtggcacaatctcggcttactgcaacctccatctcctgggttcaagcaattctcctgccctcagtctcccgagtagctgggattagaggcgcccaccaccacacccggctaatttttttgtacttttagtagagacggggtttcaccatgttggtcaggctggtcttgaactcctgacctcaggtgatccacctgccttggcctcccaaagtgctgggattacaggcgtgagccactgcacccagacttaaggcattatactaatttgttctcacattgctataaatacctgagactgggtaatttataaagaaaagaggtttaattcgttcatggtcctgcaggctgtatagtaagcatgatgctggcatctcctaggcttctggggaggcttcaggaaacttacagtcatggggagtatactggttacagggctagagcaggagcaagaaggagaaggacgaagtgccatacactttttaaagcaccagatctcaacagaactcactcactatggcaacgacagcatcgggggatggtgctaaactgcttaagagaaaaccacccccatggtccagtcacctcccaccaggtctcaccaccaatattggtgattacattccagcgtgagatgtgggcagggcgcacatccaaactgtatcaggggccgggtgcagtggcttgtgcctgtaatcccagcaatttgggaggccgaggtgggtggatcacctgaggtcaggagtttaagaccagcctggccaacatagtgaacacccatctctactaaaaatagaaaaattagccgggcgcagtcgctcttgcctgtaatcccagcattttgggaggccgaggtgggcggatcacctgaggtcaggaatttgagaccagcctggccaacacggcgaaaccctgtctctactaaaaagtacaaaaattagccaggtggtgggcgcctatagtcccagctactcaggagcctgaggcaggacaatcgcttggacccgggaggcggaggttgcagtgagccgggatctggccactgcactccagcctgggcaacaagagcgggactccatctcaaaaaaaaaaagaaaaattaaaattagccaggtgtggtgctgcatgcctgtaatcccagctactcatgaggctgaggcagcagaattgctagaaccttggaggtgaaggttgcagtgagctgagatcagaccacttcactccagcctgggtgacagagcgagactctgtctcaaaaaaaaaaaaaaaaaaattatatcagagtatatacctggaaaggtaattactgaataaaataaaggatttgtcccaagacttaatttcaagctatggagtattaaggtggtgtggaattgaatagataaaagaaacagacctacacatatatggaagcttgctgggtaacagaggcatataaagaactgttcaacaaattgtgcccagtaagttgaaatccctggggatcagaaggaaattggattctgtcttatcctctatacaaaaaatcaactcccagttgattaaatacagttgacccttgaacaacacagatttgagatttgcgatacttaaactcacagatgaactgtgtagcctagaaaaaaattttttagtttttaatttttattttttgtggatacatagtaggtgtagcctagaaatagtcaaaaaaattaaaaagtatgtcatgaacggataaaatatttgtagatgttaatccattttattgtttgcagaaagacataagatatacacaaatctattataaaaagttaaaatttcactgggagtctgatgtgggcagatcacctgaggtcagaagttcgagactatcctggccaacatggtgaaaccctatctctattaaaaatataaaaattaatgggccaggcgcggtgtctcacgcctgtaatcccagcactttgggaggccgaggcggtcggatcacgaggtcaggagatcgagaccatcctggctaacacggtgaaaccccgtctctactaaaaaatacaaaaagctgggtgcggtggctcatgcctgtaatcctagcactttgggaggccaaggcaggtggattgcttgagctcaggagttcgagaccagcctgggcaacatggtgaaaccccatctctactaaaatacaaaaaaaaaaattagccgggcatgatggcacactcctgtaatcccagctactagggaggctgaggcaggagaatcacttgaacctgggaggcagaggttgcagtgagccaagatcgtgccattgcactccagcctgggtgacagagtgagaccctgtcttaaaaaataaataaataaataaataaaattagccgggcatggtggcaggcgcctgtagtcccagctacttgggaggctgaggcaggagaatggcgtgaacccaggaggcagagcttgcagtgagccgagatcgcgccactgcactgcagcctgggtgacagagcgagactccgtctcaaaaaaaaaaaaacaccacaaaaaaaattaggccaggcatgggggctcccacctgtaatcctggtactttgggaggctgaggtgggtggatcacctgaggtcaggagttcgagccagcctggccaacgtggtgaaacctcttctctactaaaaataaaaaaattagccctgcttggccgggtgtggtggctcacgcctgtaatcccagcactttgggaggccaaggcaggcagatcatgaggtcaggagttcaagaccagcctgaccaacatggtgaaacctggtctctactaaaaatacaaaaaattaagcatggtggcacatgcctgtaatcccagctacttaggagtctgaggcaggagaatcgcttgaacccaggaggcagagattgcagtgagccaagatcgcaccattgcactccagcctgggcaacagagcgagactccacctcaaaaaaaaaaaaaatagccctgcatgatggtgagtgcctgtaatcccagctacctggaggctgaggcaggaaaatcacttgaacccaggaggcagaagctgcagtgatccgagatcgcgccactgcactccagcctgggcgacagaggaagactctgtctcaaaaaaaaaaaaaaaaaactaggccgggcgtggtggcccatgcctgtaatcccagcacttttgggagaccaaggtgggtggatcacttgaggtcaggagttcgagttcgagaccagcctgaccaacatggtgaccctgtctctactaaaaatacaaaaattagccgggcatggttgtgcatgcctttaatcacagctactgaggaggctgaggcaggagaataacttgaacctgggaggcggagattgcagtgagctgatgttgctccaatgcactccagcctggccacagagtaaggctctgtctcaaaaaaaaaacacaaaaactagccaggtgaggtggtgggtgtctatactcccagctacttgtgaggctgaggcagaatcatttgaaccctgggtagcgaaggttgcagtgagccaacatcatgccattgcactccagcctgggcaaaaaagcaagactctgtctcaaataaaaagttaaaatttatcaaaatttacaaacacaaactatacatgacgccattctcagttatgagaaatgtaaacaaagacatacagcattaatcataaaattaactgtaataggccgagcatggtagtttatgcttgtaattccaggactttgggaggccaaggcaggcggatcacctgaggttgggagttggagaccaacctgaccaacatggagaaaccccgtctctactaaaaatacaaaattagcccggcgtagtggcgcatgcccgtaatcccaggtactcgggaggctgaggcaggagaatcgcttgaatccaggaggcggaggttgcagtgagccgagatcgcaccatctcactccagcgtggacaacaagagcgaaactctgtctcaaaaaaaaaaaaactgtaatacatactgtactactgtaataatttcatagccacctcttgttgttattgcaatgaagaaagtgttgccagaatccacttcaaagccatatgacactaatcatctccaagtgagcagtttactggaatctctccagtaaattacgtatcacagtacaaagtgatctcttgaagttctttatttctcatcgtttttactacgattccataaaccttgaatgaccctatgagacctatatgaagtgccattagtgatgttagaagggcttccaagaacaagagaaaagtcatggcattacaagaaaacaaaaagttgaactgcttgatatgtaccatagattggggtctgcagctgtggttgcccaccatttcaagataaatgggccgggcacggtggctcgcacctataatcccagcactttgggaggccgaggcaggcggatcatggggtcaggagttcgagaccagcctggccgacatggtgaaaccctgtctctactaaaaatacaaaaaattaggagtggtggcgggcgcctgtaatcctagctactccggaggctgaggcaggttaattgcttgaacctgggaggtggaggttgcagtgcgccgaatcacgccattgcattgcagcctgagcgagagactgagactccgtctcaaaagaagaaagataaatgaatctagcataaggacttgaaaaaagaaaaggaattttgcaaagccatcaccgtagctgtgccagcaagtgcgaaaacttagtactttttccaaggtatctttttatctcatattgaaaatgcaggggtttttttgtttttgttttgttttgttttgtttttgagacagagtcttgctctgtcgccaggctggagtgcggtggcacgatcttggctcactgcaacctctgcctcccgggttccagcaattccccgacgtcagcctcccgagtagctgggactaccaccgcacccggctaattttttgcattttagtagagacggggtttcaccatgttggccaggatggtcacaatctcctgaactcgtgatctgcctgcctcggcctcccaacgtgctgggattacaggtgtgagccaccatgcctggccgaaaatgcagtttttatgtggatgcaggattgccttaaaaaagcatacatgtccaggcgtggtggctcacgcctgtaatcccaacactttgggaggccgaggtgggtagatcacctgaggtcaggagattgtgatcagcctggccagcatgacgaaacactgtctctactaaaaatgcaaaaattagctgggcatggtggtaggtacctgtaatcccagctactcggaaggctaaggcagggagagttgacttgagcctgggaggcagagcttacagagagccgagatcgcaccactgcactccagcctgggcaacaaagcgagactccgtctgaaaaaaaaaaaaaagaaaggccagctcaatggctcacgcctgtaatcccagcactttgggaggccgaggcaggcgatcatttgaagtcagtagttcaagaccagcctggtcaacatggtgaaacctgtctctattaaaaacacaaaaaaatagccaggcgtggtagcgggtgcctgtagtctcagctcttcaggaagctgaggcaggagaaatcgcttgaacccaggaggtggaggctgcagtgagccgagatcacgccactgcactccagcctcagcggcagagtaaaactcagtctcaaaaaaaaaaaaacagaaagaaaaagaaaaaatcaaggtaaaaggagaagcttctgccaaccaagaggcagtagacaagttcccagatgctattaagaaaatcattagcagccggacgcagtggctcatgcctgtaatcccaggcatgcctcccactttgggaggcagaggcatgtaaatcatctgaggtcaggagttcaagagcagcctggcaaacatggtgaaaccccgcttctactaaaaatacaaaaattagcagaccctggtggcccggaggttgcagtgaggcgagatcatgccattgcactccagcctgggctacaagagcaagatgccatctcaaaaaaaaaaaaaaaaaaaaaattagctgggcgtggtggtgtgaccctgtaatcccagctactcgggaggctgaggcaggagaatcgcttgaacccaggaggtagggttgcagcgagccgagatcgtgccactgcactccagcctggttgacggaatgagactctgactcaaaaaagaataaaagtgaagtaagccagacacaagtggacatatattttatgattccactagtatgaggaacctggaatagacaaattcatacaggcggaaagtagaatattggttattaggggttggagggaggatggaatagagtttttctttaataggatcagttattctgtctgggaggatgaaaaagatgtggagatggatggatactggtgatggttgtacaacaatgtgaatgtactttgatgtcactgaactgtccagaccacttaaaatggtttaaaaggtagatattatggtatatgcattttaccacaatttttcaaaaaaaaaattagtcatatgtgtatctatttctacactctattacgttgttctacatttattttgtgtagctagtatcacattgtcctgattacaatacatttacagtaagtcttgaaattagataaatcctccaatttttttttagtttttttttttgagatggagtcttgctctgtcgcccaagatggagtgcagtggcgtgatctcggctcactgcaacctctgcctcccgggttcatgccattctcctgcctcagcctcccgagtagctgggactacaggcacccaccaccatgcccggctattttttctatttttagaagagacggggtttcaccgtgttagccaggatggtctcaatcttctgatctcgtgatccacctgcctcggcctcccaaagtgctggaattacaggcgtgagccaccatgcctggccttaggttttgtctttccatagcaatttgtgaattatcttggcattttctcaaaaaaaaaaaaaaaaaaaaaaactgttggtacttgagattgtgttagatctatagatcagtttgggggaaagttgcaatcaccaactttttttttttttttttttttttaagacacagaatcttcctctgttgcccaggctggagtgcaatggcttactgtcagccttgacctcctaggtttaagcagtcttcccactttagcctcttcagtagctgggactacaagtgtaagccatcacacctggctagttttttaaaattttttgcaaagatggggtctgactatgttgcctcggttggtctccaacctctgggctcaagtgatcctcctgcctcagcctcccaaagtgctgggattacaggtgaaagctgccaagcctggacagaaattgccatcttaatgacattcagtgtttaattccatggacatccatggacatggtatgttactgcatttattttaggttatctttgatttttttttttttttttaatggagccttgctctgtcacctaggctaaagtgcagtagtgcgatcttggctcactgcaacctccacctcccgggctcaagtgattctcctgcctcagcctcccgagtagctgaggttacaggtgcctggcaccatgcctggctaatttttatattttagtagagatggagtttcaccatgttggccaggctggtctcaaactcctgacctcaagtgatccacctacttcggcctcccaaagtgctgggattacaggcatgagccaccacacctggcctttttttttttaaattcattgttttgtttatactcttatgtactgcatgtatttgttagatttatattttggttttcttttaaatttgtactttattatatttatacatttataaagaaattatatttctgtattattttgtttgatttatatctaagcatttaatgcttttcttgtttttttgtttttgtttttttttttttttgagatggagtctcattctgttgcccaggctggagtgtttttttttgagatggagtctcattctgttgcccagccaagatggaaccattttggctcaattcaacctccacctcctgggttcaagcgattctcctgcctcagcttcctgagaagctgggactacaggtgtgtgccaccacacccagctaatttttgtattttgtattttaagtagagacggggtttcaccatgttcaccaggctggtctcaaactcctgaccttaggtggtccgcccgcctcatcctcccacagtgttgggattataggagtgagtcaccctgcctggctactattctactgtttaagtagcattgtttaattttgatttcagttttctcattgatagaacatacaaatacagttgaatttgaccttggattctgcaacattgttgtgtatttcactaattgtagtactttctcttttgtagagtctttgggtgtttttatatagacaatcacacaatgtgtgagtagagatagtttgtaattcttccttttcaatattgttttctttttctggcctttttgcactggctaggacctctgttatgatactgaacatatatgatgaaagcatatgtttgccttgtccttaataatagggaaactttatgcaatttaacctgtacatatgaggcaaatcaaatatctgggaaacttcctgcctggtcattgccagtacatttgcttatgtttattttatagacaatttccagagtttttagttgtacttagtaaaatgagaggtagatgtgcatctgttcgatttttgtgtggaacaagaatcacctgtattattttttaagtaaaatgctttgtttaaaaatatggaacacttcacaagtttgcatatcattcttgcaccagggccatgctcatctctgtattgttccaattttagtatatgtgctgctgaatcaagcacatctttttttttttttaatgtttttgttttattttgatttctattttgataagcttcccctttgcctctccttttaacactgtttgatgtcattacattgtcttctggtttgcactgttttggatatgagatctaaacttttttattattattatttttttaagaaatgggtcttgctatgttgcccaggctggtcttgaactcctgggctcaagcaatcctcctgcgtcagccacacaaagtgctgggattacaggcatgagccactgtgctcggcccctttttataacgtgtgttttctctttagctgctgcttttttgtttaattaattaattaatttatttatttgccctcccaggctggagtgcagtggtgcgatctcagctcactgcaagctctcgggttcacaccattctcctgcctcagcctcccgagtagctgggactacaggcacccaccaccacgcctggctaatttcttttttatttttagtagagtcggggtttcgccgtgttagccaggatggtcacaatctcctgacctcgtgatccacccacctcggcctcccaaagtgctgggattacaggcgtgagccactgcgcccagcctctttagcttcttttgttttcttcatcagtagtttttaacaagtttattacgatatactggaccttgttttatttatcctgcctatggtttgcttactttcttctaactctgaggttatgctttttatcattttgggaaactttttagccataattctcaatttttttcattgtgaattttttattttgtgaatgttacatcattgtatatctggtttttgttgttttcctttacaagtgtccaattgttttagtagtaagttttctcctttcccgggattctaagattctgttagtattatattctttacataatttattcttttctttaatctctatcagtttgtgttgtttctattgctgtcttcaagttcactgatctccagtgccttatttgctgttaagtactctccagtttttcatttcagatttcgtatttatcaattctcaatattccttttgttgttgttgttaagtcttctcttcctctcctcattatctttgtattttcttctaaattcctgatttatgcttgtagagtagtattttaaagttattttcttttctatctttgtgatttctatttctgttgctgtttctactgaatgattttttcccctgggtcacattttcctgcattttggcatatgtaggaatttattattggatgcaagacattgtgatgtcgcattattgtatgtctggtttttgttggtttcctttacaaatattcaattttattttggtaggcagttaagttacttatggatcagtttggattctcatattgtttttaaacttagctaaggctagtcttttttttttttttgagacggagttttgctcttgtcacccaggctggagtgcaatggcgctatctgggctcaccacaacctccgcctcccaggttcaagcgattcccctgcatcagcctcccgagtagctgggactacgggcttgcaccaccacacccgcctaattttgtatttttagtagagacggggtttctccatgttggtcaggctggtcttgaactcccgacctcaggtgatccgcctgtctcagcctcccaaagtgctgggattacaggcgtgagccactgcgccccaccagtgaaggctagtcttcctttcaggataattaagccctctaacagtggataacattaccctctgggcttgctgtttaatgtcccctattgttgaacaatgtctttctactttgcctaatggaatgagtatctgccatcatgtgtgagttgtgtgaattgctcaggttacagttttctggtagttccttgttcagccatatggaatttcacccttcacatgcacaacgtagtgtttagcagtatactaaaagagacacccatagttagatttctagagttataattctccataggtttttccattctgatactcatttccacaaattccagctatctcagtccctctgtactctgatatatcccttttcagctcatcagtttggccattctctgcttggtttctacttctgcaccacagtcattcttagaaaggcaaggtggaggctgggcgtgatggctcacgcctgtaatcnnnnnnnnnnnnnnnnnnnnnnnnnnnnnnnnnnnnnnnnnnnnnnnnnnnnnnnnnnnnnnnnnnnnnnnnnnnnnnnntcaggagttcaagaccatcctggacagcatggtgaaaccctgtctgtactaaaaatacaaaaaaataagctgggtgtggtggcacatgcctggaatcccagctactcaggaggctgaggtaggagaatctcttgaacccaggaggcggaggttgcagtgagccgagatcacaccactgcactccagcctgggagacagagcaagtctccgtctcaaaaaagaaaaaaaaaaaagaaaaggaaagaaaagaaaaagaaaggaaggaaggagggaaggtgggtgggagggaaggaaggaaaggaagaaaaggaaggaaaggaaaggcaaggtggggctgggcacagtggctcatgcctgtaatcccagcactttgggtgggcggattacctgatgttaggagtttgagaccagcctggccaacatggtgaaactaaaaaccgtctctactaaaaatacaaaaattatccagatgtggttacaggcgcctgtaatcccagctattcaggaggctgaggcaggagaatcgcttcaacccaggaagcagaagttgcagtgagatgagatcatgccactgcactccagcctgggcaacagagcgagactccatctcaataaacaaaaaaagataaaagaaaggcaaggtggttgtgtgactcaccgcatttttttcagatttctcagggataacagtgctgcattaactgttgtccagtatctgataataattgtcttttaaaattttctcatgccgggcacggtggctcatgcctataatcccagcacttgggaggccaaggcaggtggattacttgaggtcaagagttgaagaccagcctagccaacatggcaaaacccgtctctactaaaaatacaaaactggtggcgtgcccctgtaatatcagctactcgggaggctgaggcaggagaattgcttgaacccagaaagcggaggttgccttgagccaagattgtgcccctgcactccagcctgggtgacagagaaagattccgactcaaaaaataaaataaaataaaattttctctaagtatctagtagactaccatatttctattacttcttgtcaggagaagtctggtaccagttatttaaacatggccagataaggaagtccccatatctctttttttaattgctatggttttttttttttaagtagacaattatttgtaggaaaacttttttttcataataaaattatctttaaacttctctttctagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagagtaagtagtagtacctattagctaacatccctttttcttccacatttggaaaaatactttgactatcaaaaaacaatatagattcttttgtgtttcataagcgtgatgattgtgtttttgcactcatgtatgaggtacgcctccctcaaactttgtgtcaaggtcaatacattaccctttctgatgtggggggaaatcagtacaaaagtaatatgcacaaataccagtgttcactgtactactgtactgtcttatgttgtatgagactaattgtctttctgatggttatcttctctctgcctttctagattgagattctaatgatgcttttcttttctttttttgtttttttttttttttttgagacggagtctcgccctgtcacccaggctggagtgcagtggtgcgatcttggctcactgcaaactctgcctccggggttcacgccattctcctacctcagcctcccgagtagctgggagtacagggcccgccaccacgcccagctaattttgtgtatttttagtagagacggggtttcaccatgttagccaggatggtctagatctcctgacctcgtgatccacctgcctcggcctcccaaagtgctgggattacaggcgtgaaccaccgtgcctggccctaatgatgcttttcttattaacttaagcaataaatggctctgtgtaactaaaatgatattggtgacttcattttttatattggtgacttcatttttcactgattggacgctgtgttccatgagctttgtcagatgaataaaatatttgccttgcttttaagaactttgtattatcttggcagagtacaatttaataagcactctaattgagaatttttaaagcatcaaagggatagcaaattatcatcaattaagaaatattttctggttgagttaggatttagaggtgtggtagtagtttaccagatggagaaggatattccagtcagaacagcatgtaaaaaggatacaaagatttttcatatatcaaaacaacttgaaagtttagggcttctgaaatgtagtggccctgtggtaaataagcattatatgatgaggaacatataaccatggactttgagatatttagttaactttaagatatttggttttggatgggagtggtggctcacacctataatcccaacactttgggaggccagggcgggtggatcacctgaggttgggagtttgagaccagcctgaccaacatggagaaaccccgtttctactaaaaatacaaaattagccgagtgtggtggcacatgcctgtaatcccagctacttgggaggctgaggcaggagaatcgcttgaacctgggaggcggaggttgcagtgagccgagatcgagccattgactccagcctgggcagcaagagcgaaactccatctcaaaaaaaaaagaaatttttttaatgctattttgctataggaaataaaaaatgagtttgggggatggatgtgaaaggtataggtttgtttaagataactccagcagcagggtggaaaataaatggaatgaattactagtggcaaaaactctcacctcacagtttctgtcaaaaagtcatgaatatctgaatttagacaaagagaagaataagattgaaagaggaaaccttagattttagaggtacatctcgtttggtggtgttaaagtaattgacatgtaaaccataccactttattttgcatttaaaagatttttattgatttgtcactgaggtagatatcacaaaatttttatactctgaacgtgcttcttaggtcatgaaaacattttactaatgaagcttaagtttagctaattataataataaatcatctcaaataaccaagactttaaaaagataggcacttaactattttttttaatttaagagaagttgtgaagtatgtagttcaaagttcataatggtaccttcacaatgtcttcagggacctaggctcctttttctcccttctatctcagcactaattatgcattcctaagattccctcatgttccaagatagttactagagtccagccatttgatgtttgttacagacagaaaagaggaggaaaagcatgctccttctttgttttttgttttctggtttgtttgtttgttgcgatggagtttcactcttgttgcccaggctggagtgcaatggcacgatctcggctcactgcaacctctgccttctgggttcaagcgattctcctgcctcagcctcccaagtagctgggattacaggcacccaccaccgtgcccagctaattgtttgtaattttagtagagatgggctttcaccatgttggccagactggtcttgaattcctgacctcaggtgatccgccctcctctgcctcccagagtgctaggattacaggcgtgagccaccatgcctggcccatgctccttctttgtaagaaaatttcaaacccgcatttatataaattggctagaatttaaattgcatagccacactttagccataagacaggttgcggaaataatggtcattactctaggtgttaatagctgttaaggaaaaaaaaaatcaacattctgtcagtagaaatgagaaagtagaaatacactttgggacacatctaattcagtcataattttggaacagagtctgctaaatagagcagaaatataattatcaacttttctgctaaataaaattcaagttttatttcttgcttagggagaacctctcagactgtgtttttcctctgctgtcacatcacaataatcatcaacaaagaagtctgtaagagcaaactgctggtttaaaaaaaaccatttttttcaataaaattaaaaaaaaaaaaaacacacagaagacttctgtaaccaaaggtatgagggttttcccatacaccaagcaataggcagcagctgggtgtcctcaattcaattctgtcactgttttcctggatatagggtcagatcctataggttgggtgctcagttcccaagaccgccaccctccctttagaccagtcacaactctggctctctagaacttctgaccaaccagcttcaagttggggtttccacaatcccccctttgggtttgattaatttgctagaatggctcacaaaactcaaggaaacatgtacttccatttactggtttgttataaaggatattacagacgctatagatgaagacatatactggggaaggagcatagagctttcattccctccttgggcgcactaccctccaggaacctccacatgttcagctatccagaaactctctgaacctttctttttgagttttgttttttgtggttttgtttgtttttttgagatggggtttcgctcttgtcaaccaggctggagtgcaatggtatgatcttggctcactgcaggctctgcctcctaggttcaagtgattctcctgcctcagcctccagagtagctgggattacaggcacctgtcaccacacccagctaaatttttttttttttttttgagacggagtcgtgctctgttgcccaagctggggtgcagtggcaagatcttggctcactgcaacctccacctcctgggttcaagcagttctcctacctcagcctcctgagtagctgggactacaggcacacaccgccatgcccagccaattttttgtattttagtagagacggggtttcaccatgttgcccagtctggttgcgaaatcctgagctcaggcagtccgcccacctcagcctcccaaagtgctgggattacaggagtgagccacagcgcccggcctctttttgagtttttatggaagcttcataggcgtcaatgacagccatgtagaaatgtgattgaacaaaatgtagaggatgtaaacccagcatgtcctgtctagacttcttggcctctctgtgtcacattcctttctctagggtatggggcaggaccctctctggagtgagggttttcttggcccagaatcagattagagtcctgccttaggtaggtgaaaggaagacaggagaaggtcaaagagagattctatctcctgaggcccactcctgagacttaaagtgccccaacattataacagggactatgggagttaagagccaggaaccatggatgaaaacatatatatatatatatatatatatatatatatttatttatttatttatattcatatttatatttatatatatcataagaccacacttctgttttttacttttgtgctttttcttgattaaagatttaaaaatggaagattctgatcttttgatgtaatttgatttcacatcaaattatacaaccgtatcagtgatttgtaagtgtctctggtcatacaaaagatttgacctgaaaatggactgaaatatcactttatgtatgttagaactagctcttcctctcccaaaaataagtaggaagaaaatggtttattctttaagcatttttaagaacattgatcagtttagtacatgtatgcattcttgaaagatgtgaagccaggatattattgtgggctggctattttgttgttagcagtttcattaataaacttatgtttagagcagtttcagtttcacagcaaaattgagtggaaagtacagagttttcatatacaccctgttcttcatacacacaacctgcccactgttacaccacaccattgtgatacatgtgttatgatccatgtacctacattgatataccattattacccaaagtccgtagttactttagggttcactcttggtgaaatacattctatgggttttgacaaatgtatactgacatgtatctactattgtaatatcatacaatagaataaaaataaaggggccaggtgcgattgctcacgcctgtaatcccagcactttaggccgctggagctggaggattgcttgagcccaggagttcaagaccaacctgggcaacatagcaagaccttgtctctactaaaaatttaagaattcaggccagacgcagtggctcaggcctgtaatcctgtatatcattcttggtgatatacattctatgggtttcgacaaatgtatactgacatgtatctactgttgtaatatcatacaacagaataaaaataaaggccaggtgcgattgctcacgcctgtaatcccagcactttaggcggctggagctggaggattgcttgaggccactttggaaggcaaggcaggcagactacttgaggtcaggagttcaagaccagtcaggccaacatgacacaaccctgtctctgctaaaaatacaaaaattagctgggcgcagtggcaggcacctgtaatcccagctccttgggaggctgaggcagaagaatcctttgacctccggaggcagaggttgcagtgagccgagatcgcaccattgcactccagcctgggtgacagagcaaaactctgtctcagaaataaataagtaaataaaataaaaatccagcaggtgtggtggcgcacagctgtagtcccagctgcttgtgagactgaagtgagcagatcacttgagtccaggggtccgaggctgcagtgagttgtgttcatgacattacattccagcctaagtgacaaagcgttttttttgaaaccctgtctcagaaaaagaaagagaaaataatacgaacttttttttttttgagatggagttcaagcaattctcctgcctcagcctcccgagtagctgagattacaggtgcccaccaccacgcctggctaatttttgtatttttagcagagacggggtttcacatattggccaggctggtctcaaactcctgacctcaagtgatctgcccgccccagcttcccaaagtgctgggattacaggtctgagccaccacgcctggccaagatcgaccattttttaagaactcaggcttttgttgtcttttagaatgcccttcattttggatttctttgatcctatcttcatgattaaatttaggtttaaaaaaatcttggcagaggcctgggaaagatggcttatgcctgtaatctcaacattttgggaggctgaggctggaggatcacttgaggcctggagttcaagaccagcctgggcaacatagtgagatccagtctctacaaaaataaaaataaataaaacttaataaaatttaaaaatcatggcaggaatattgcatatgtgatactttatacttctttttgcatcccacttattgtcccagcattgatggtgccatttttgattacttagtgaaggtggtatccaccaagtcttttcattgcaaagatactacattttttcccattgtaattggtacataaaccatgggttgatatttaaggctatggcttgttctctatcagtcttttttaatctaacatttaatcatccattaatgttttttccctaagtttaataattacattgatggttgaaaaatgacaatttttgctgggtgtggttgctcatccctgtaatccgagaactgtaggaggcagatcacctgaggtcaggagttcaagaacaccctggccaacatggtgaaaccccatctctaccaaaaatgcaaaaattagccaggcctggtgacatgcaacctgtagtcccagctatttgggaggctgaggcaggagaatcgcttgaacccaggaagcagaggttgtagtgagctgagattgcgccactgaactccagcctgggcgacagagcaagactccgtctcaaaaaaaaagaaagaaaagaaaattttctaattccattatttcttgatttttagctgacattttctggtgaagatgagcttctctttttttttctccgtaaactctctgtttgttttgttttgttttgtttttttgaataccttatagactcatgaattttttttgtttgggtggttttgtttgtttttctccagagacagggtctccctatgttgcccaggcttgactctaactcctgggctcaagaagtccttctgcctcagcctcccaaagtgctaggaggcataagctatcatgcttggcataaaattgactatattataatctattagcattttataggaaactgctcaaaattccctgattttaccacaggagcccctttaaactggcccctgtttcctttatacatgtcttcagattacttatctttgagcacttccctgctttctgctgttcggagtagtgaggatttagttttttgttttggtttacttttctgctgttgtttatcagacttgttctttctttggcctgtatctggaatcaactatttccctcaaggagctttggtttcttttagtgaggattattatttagaagtcaaaatctgaatttttcatgtgctttttctactagggtatttgttactgctatgatgccatgcttctagcccctttcagtaccatggaatgaaaaaaatgtgcgtacacacaagtgtataaattttatattgctgttgaagaaattatcacaaatttagcagcttaaatatcatccatttattatctcacagattccagtttagtcttggcttagttggatcctctgttctgagtttcataagccagaatcaaggtaccatccgaggctggggctgtattccagactcacatggatgtaggtaaaactcatttctttgcagttgtgtaactcatggttggtggcttgcttcttcaagtcttcaacaaagacagtctgcttctttaagactctggactgagagcaatcctaagcctttattgagatattaagtgtacagtaatcagttttaaaacattgttattattccagaaagaaacccacatcactaggcaatcactccctaatttccccaccattaggcaactgtccatttagatatttaatgtgtggaatatatgtaatataaatacaattttttttttttaaccagtcctggatatttagtatcatacaatatgtgtttttttgtgactgagttttttcacttagcatattgttttcaggtttcatgcatgttgtagtatatataattcctgtcttttttgccaaataatattccattgtgcatatgtataccacattttatttatccattcatcagttaatgaacatttgggttgtttctgcttttggctatcacaagtaatgctgctatgaacatttgtgtacatccacgtttttattttttatagctgtatgatattagattatatagatacttcatagtctatctaaccagtctagtaaggaagggttgttctaatatttgctcctatagataatgcccagtgaataaatttatccacacattgtttgatattttggaggtatatcttaagggtaagttcctagaaattgaattactgggttaaatagtaattgtatatataatattgtaaatattgctaaattctgcttccatgggaattgtatccttttgtagtcctagaaatttatgagtctgtcttacttttccacagcccgtcctatgttgtcaaacgattatatgtttattaatctaataggtgaggaatttcaatttacttttttttttgagacggagtctcgctctgtctcccaggctggagtgcagtggcgcaatcttggctcactgcaacctctgcctcccgggttcaagcaattctcctgcccgaacctcccgagtagctgggaccacaggtgtgcaccaccacgcctggctaatttttgtattcttagtagagatggggtttcaccatgttggccaggctggttcaattccccttttttttgtaagtaatactgtcaagcatctttttatatctttgaaggccatttaattatctttttcttttaactgtcttttcatgtgtgtttccccattttctatcaggggaaattctatcctcgatttttaagagttctttatctattagatttgcctttgtccgtgatataaattgtagatatattttgtcaatttgttatttgacttttgtgcttattgaccgtgactattgttatgccagtaataatatattgttactgttcaaacactgtgttgattactatagcttttttatttatttattttttagaaacagggtctcactctaaggcccagcctggagtatagtggcacaaacagctcacttcagcctctttctcccaggctcaaaccatcctccttcctcagcctcccgagtagctggactataggcattcaccaccacacccagctattttttaaattttttgtaaagacaaggcctcattatgttgcccaggctgtctcgaactcttggcctcaagcaatcctcccctcttggcttcccaaagtgctaggattataggcgtgagccactgctcctggccaaataccggagttttgtaagaaagcctgaaatcagaaagtgtgattccttcaactttgttctttttcaagattgttttggctattcctggattccttgccatttctctgtgattttttaggatcagcttatctatttctgcaaaaaatgcaactggaatcttcacagactctagatcaatttgggaagttttgtcatctttttttttttttttttttttgagacagagtctcactctgtcgcccaggctggagtgcagtggcaccatcttagctcactgcaaccttcgccccctgggtttaagcaattctcttctgtcagcctccctagtagtttggattacaggcatgtgctaccatgcccatctactttttgtatttttagtagatccagggttttgccatgttggccaggctggtctcgaactccggacctcaagtgatccatccgcctcggcctcccaaaccgctgggattacagacgtgagctacagcacctggccaagttttgctgtcttaacagtatttggtcatcaccatatctgtgaatatgggatgtctttccatttattttgacttttttttttttttttttgacacagagaatcgctctctcacccagactggagtgcagtggcctgatcttggctcactgcaacctccacctcccaggttcaggtgattctcctgcctcagcctcccaaacagatggggctacaggcccacaccaccatgcccggctaattttttgtagttttgtagagacagggtttcatcatgttggtcaagctgatcttgaactcctgacctcaggtgattcactcacctaggcctcccaaattgctaagattacagggatgagtgaccatgcccgacctattttgatctttaaccaaaacttttaacagtgtttgttgttgttgttttgtttgtttgttttaatgagactgagtctcactctgtcgcctaggcttgagggcagcggcttcatctcggctcactgcaacttccccctcttgggttcaagtgattctcgtgcctcagcctcctgattagctaggaatatgggtgcatgccaacacacctggctaatttttatatttttgtagagacagggtttcaccatgttggccaggctggtctcgaactcctgacctcaagtgatctgcccccccctcagccccctaaagtgctgggattacaggcacgagtcactgcccctggcctcaaaacttttaacagtgttttatagtttttagtgtacaggtgctattcttcttttgttaatcttgttcccaagaatttttttttaatttactgctattgtaattgttgtaattggaattggattttttatttttatttttttatttttattctattattattattattttttagatggagtctcactctgtcaccaggctggcgtgcagtggtgcggtctcagcttactgcaacctctgtttcccaggttcaagcgattctcctgcctcagcctcccgagtagctgggaccacaggcacgcaccaccacactcagctgatttttgtgtttttagtagagaaagagtttcaccgtgttggccaggacggtctcgatctcttgacctcgtgatccgcctgcctcagcctcccaaagtgctgggatgacaggcatgccaccacgcccagccctccaattggatattttaaattaaatttttggattgtttattgctatgtatagaaatacaattgatttttttttcccaccagtttaccctgacagatgtgtttcatgtattgagtttgtctcctgtaacctaggtgttagtcctaagagtcttttagtggattccgtcatgtgtgtcttgactttgcttaagatcattcacatcgtcaccacatctagctaatttttttattttttgtagagacaatgaggtcttgccatgttgcctgagctggtcttgagctcctggcctcaagtgatcctcctgccttgtccttccaaagtgttgggattacaggggttagccactatatctggcctttatttttaaattgcttctggatttttttcttttttaaagacagagtctacctctcatccagactagagtacagtggcataataccagctcactacagtctccacctcctagactcaagcgttcatcttacctcagcctcctccagtagctgggactacaggtacatgccaccacactggactaatttttttattttttcagagacagggtctctctatgttgcccaggctggtcttgaactcttgagtcaagtccctctttggcctcccaaagtgctaggattgtaggtgtgagccaccgtgcccaggttgcttcctttttttttttttttttgagacggagtttcgttcttgttgcccaggctggagtgcaatggtgcgttcttggctcactgcaacctctgccttccaggttcaagcgattctcctgcctcagcctcccgagtagctgggattacaggcatggcatcaccatacctggctatttttttttttttttaatggtaggaacggcctttattggctgcagcaggaagtgaaagaggggatacagcttctgcagaatagatcgccgccctccaaaaaaagcttctgtatttcaagtcattagaaaagctctcccacacacaaattttaagcaagtaagaaatttacttttgttttcttctggtaattgcttggattcaatttttgcatctagttccctaatatatttggaattttttcaggtatattagtctgggctaatactgaagaagtaaaaagaaagttaatacttcttgcatacctattatgtgccagttactgtgctaatgagtttatatatgttatcttataaatttattcaagaaccttgtgagagaacaggtattattaatattattgaagaagctaaggcttagagaattagagaaacttaagtaatttgtctagagttttacagttagtcaatagcatagttaacatttgagttctggcaataattggctgcagagttgtttgtacttttccctactttacttagcttctacagtactgacatatcttttgtgggtttttttggttttttttgaaacaggagtttcactccattgcctaggctggtctgaaactcctgggatccttccacaatgatccttcagctgcaacctccaaaaggctgggattagaggcatttgcaccaccaccagctcttttttttttttgagatggagtttcgctcttgtcacccagactggagtgcaatggcacgatcttggctcactgtaacctctgcctcccaggttcaagcgattctcctgtctcagcctcccaagtagctgggattacaggcgtgcgctaccacacctggctaatttgtgtatttttttttttttagtagagacgggtttcaccatgttggccaggctggtcttgaactcctgaccttaggtgatccacccacctcagcttcccaaagtgctgggattacaggcaaccatacccggccttcaatgtctttttatgctggaaaaaaaaaaaaaaaaaagtataacttggctgggtgtggtggctcatacttgtaatcccagtacttcgggaggccaaggtaggaggattgcttgaggccaggagtttgagaccagcctagacatcatggtgaggaccccatctctacaaaaagtttttaaataattatccaggcatagtggcacacagacctgtagtcctagttactcagtagactgggatggtgggattgcttgagccttaggagttcaaggctgcattgaattatgattgcaccactgtacaacctgggtggcagaacaaggccctgtctttaaaaacaaaacaaagcagtaaaacatggataacttgtctggaccatttgattaattccttttttttatttaaaagattagctctagaataacatgtccattttttacattctgtactttttagcataaagtttatatagtaatctgaaatataattttacctttttatctaaaagtgccgtattccttgaggattttaagttgtgcagtaaaatggtctggattggagcaaggttagggaaaggtgacattatgaaaaaatgatgcctcccccttcttcaaattcatatccccagggcaaaagttgccatattgtttatgaaagaacattaagggagtctgttttcctgttgtctgtagatgatgttcagaagtattttaaccctgatatgatgtttgtttgtttgtttgtttgtttgtttgagacggagtctggcagtggcacaatcaccatgcccagctagtatgattttttttttttagacagtcttgctctgtcacccaggctggtgtgcagtggtgcaaccttggctcactgcaacctccacctcctgggttcaagcagttttcctgcttcagcctctcaagtagctgagataacaggcgcctgccaccacgcccagctaattttttgtatctttagtagaggcggggtttcaccatgttggccaggctggtctcaaactcctgacctcaggtgatccacctgccttggcctcccaaagtgctgggattacaggcatgagccactgttcccggaagccagtatgctctttttttttcttagagtctcactctgtcacccaggctggtgtgcaatagcacgatcttggctttctgtaacctccacctccggggttcaggcaattctcctacctcagcctcccaagtaggtgagattacaggtgcccaccaccactcccggctaattttttgtatttttagtagagacaagatatcaccatgttcgccaggttggtctccacctcttgacctgacctctggtgatccacccaccttggccttccagtgtgctgggattacaggcgtgagccaccgtgccctaccaatcttttttttttttttttttgagatggagtcttgctgtgtcacccaggctggagtccagtggcatgactttggctcgctgcaatctccgcctcccaggttcaggcaattctcctgcctcagcctcttgagtagctgggattacaggtgcccacgaccatgcctggctaattttttgtatttttagtagagaagggatttcaccatgttggccaggctggttttgaactcctgacctcaagtgatccgcctgccttggcctcccaaagtgctaggattacaggtgtgagccaccatgcccggccaccggcgatcttttttaacactttttttttttgagacagagagtctcactctgtcaccctggctggcgtgcagtggcacgatctcagctcactgcaacctccacctccctggttcaaatgattctcgtgcctcagcctcatgagcagctaggattagaggcgtacaccactacgccctactaatttttgtatttttagtaaagatggggtttcaccttcttggccaaggctggtctcaaactccttgcctcaagtgatctgcctgactcagcctcccaaagtgctgggattacaggcgtgagccaccacatcactggcatgatcttaatttatcttttgtctgggtctggaccgtctctccctgtaaataggtgattatgctgaagtatgtaaatttatgtttatctaaatttagtaaaattagcaaaataaatctgttccagaaagtagactgtactttggtggatagattgttttgagagaaatgttaacatctttaggaaggtaatttatgaaaacagtattttcagaaaagtttaactgccagtggaatatagaatagaattgtcatttgtggttatagaatttatcagatcctagcttcgtcagttactagttatatgaatttgggcaagttattgatttgggcaacccttgatcctcagtgtcctcagctttaaaatggcaatgataaatagtacctgttactcagttatcaatgtcagaatgctttccatacatgaagtaggcattcaaaatattatttaatgtcttactccacaatcactatattgtgaccttggacaaattactcctctaagactcttcctctttagaagtaatatgtcctcttttttttttttttgagacagtctcgctctatcacccaggctggattgcagtgatgcgatctcggctcactacaacctctgcctcctagattcaagcgattctccttctcagcctcccaggtagctgggactacatgcctggctaattttttataattttagtagagacggggtttcaccgtgttagccaggatggtctcaatctcctgacctcgtgatttgcccgcctcagcctcccaaactgttgggattacaggcgtgagccaccacgcccagcatatgtcctcattggggtcgttattccctacccagattcctttgaaatcttgttacttcctgcagaactgttgcataatatttaagtcccacccttatcttgtgtaacctatttttctagttatttgtccagtcatagtcctcaaatacttgttcctttagccacatctgatcattttccttacttcctccatcctacacttttctcctggggtttatcctagatgtctgctctgtgtagtatgaactaccttccctacttcacctttccttgtcaaaatcccatttatcttttcaaataagttttcttaattctttcctaattacaattacttttctttctccttttgtagaacttagtatctcctcctagtaagtagtgttatgagttttatcacattctgttttttttggggggtgggggttggggtgggacagcctcactttatcacccagactggagtgcggtggtgccatctcagctcactgcaacctctgtctcctgtgttcaagcagttctcatgcctcagcctcccaagtagctgaaattacaggtgccaccacgcctagctaatttttgtatttttagtagagataaggtttagccatgttagccagtctggtcttgaactcccgacctcaggtaatctgcccgcccctacttcccaaagtgcttggattacatgcttggattacatatgtgagccactgctcccggcctcaaagttttatcacattctgatagataatctagatatctacatacatacttgttgtcccaccaaattgtaaacttcttatggccagggccaccctttgttcaacttggatgccttgtagaacccagcagcattttctacatataattactaaaatatctatgacttaaaatctccttaaagagatttaaatgcatctgccctctcatgtggtaacaaatatgaggaaattattttggttcatcaatttcatatctacccaagatagacatttcaaaatggattaagtgccaaattttatcctgaaaagtttgtaggctgggcacaatggctcacaccggtaatcctagcactttgggaggccagggcaggcaagtcgcttgagcccaggagttgaagaccagcctgggcaacatggtgaaacaccgtgtctacaaaaataaataaataaataaaatgtcccatcccttcgtggtagcatgcacctgtagttccagctactcggagggcaaggaggctgaggcgagaggttcacttgagtctgggaggttgaggctgcagctgcagtgagctgagatctcgccactgcactctaccctgggagacagaatgagaccctgtctcaaaaaagcaaaaaaataaaaattcctatcacctagtgatgtcatagctttcctagcattttggcttttttgtacatttttttgtacaatgtacagtaatttcctaggctttcacattcattcaccacacactcactgactcacccagagcaacttccagtcctgcaaggtccattcatggtaagtactctatactataaagtgtaccactttttatcttttacaaccgtatttttactctatctttcttatgtttagaaatgtttagatacacaaatacttaccattgtgttacaactgcctgcaatattcattacagttacatgctaaacaggtttgtagcctaggacctataagctataccatctaggtttgtgtaagtatattctatgatgttcacacagcatttgtcagaatgtatcactatcaaatgacaaatgactttatatttctatccaaaacagtttctgtgagcaacatttattacatctattaagttatgtttgtgttctcctttgctgtttataaagtgcttttacatatatctgcgtttgagtgagctgtgctgtgtttaagtacatctatgttatagtcctagatgtatattaatagactcagatcataacagtctttataaatatattgtttttactggaacattgttttaaatccaagacagtttttctttccctgtcagtatgattttgatcctatttttcctctggttatttggtactaaataattttatacttgtttaaatattaatcataataaattatgagagtaaataaattaaaaatcatttaatattttcctaaagcacatgatgtttattacctgttttatgaattattaagataacctggccaggtgcccgtggctcacgcctgtaatcccaagactttgggagctgaggcaagtggatcacctgaggtcaggagttcaagaccagcctggccaatgtgataaaaccctgtctctactaaaaatacaaaaaatagccaggcatagtgtaatcccagtagttggcatctgtaatcccagctactcgggaggctgaggcacaagaattacttgaacctgggaggcagagttgcagtgaaccaagatcatgccactgcactccagcctgggcaacagagtgagactctgtctcaagaaaaaaataaataaatgaaggttgtcttcataatgatggcaatctttctttctttttttttttttttctgagacagagtttcgctcttgttgtctaggctgtagtacaatggcacaatctcggctcactgcaacctccgtctcccggagtcaagcgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcacttatcgaatcgactcgtcctatttcgttaaggaaaaaatatatcagctttgtcttattcactggaactttaggccaggcacagttgctcacgcctgtaatcccagcactttggctgaggcggatgcatcacctgaggtcaggagttcaagaccagcctgaccaacatggtgaaaccccatctctactaaaaatacaaaaattagccaggcgtggtgccgcatgcctgtaatcccagctacttgggaagctaaggcaggagaaccgcttaaacctgggaggtggaggttgcagtgagccaagatcacaccattgcactccggcctgggtgacaagagcgaaactccatctgaaaaaaacaaaaaaaagaattaattggaactttaagctaaaatatagtcataatatcttaaatgagactcttctaaggcccttttttctcattttccttttttgttttccttctttttttcccccttttatatatttatgaaatctcttgagatcgcattttaaactttaggaaacaaaccaataatgtgagtagaagacacaagcccagagagacatggtggaataaaagcaagagaataatatagaataatatagtgagtagatgttgagcaagaaactgaggttttgaagcttaaatctccttcccaactactaaaatcaaggcaagtcactcagtcttatagagcatctttcctcttacctacttcacagtattgatataaagtaaccaaatataaggcagtcattataatccgatctaaaatttgtgttccttctccaaaactgttggagaaaataaaagagcatctttcttttctttctttttttttaaaagtagagacagggtctcacttgttacccaggccagtctcaaattcctgggctcaggcagtccttccacctcagcttccaaaagtattgggattacaggcgtgaacccccacgcccagccaggagcctctttcttaaggacagtttcagaagtaaagatttttttttttaatttatcaatgtacttggtaccctctcctcataggatgatctgttatctgtatttgaccacaggaggaaatttctttgcctcttgactgtttcccattctttttttatcacagcccaaagagtcgattgatccaattaaagaaagagaagctggagtatactccaggagagcatgaatatggattatttccagcgcccattcatgttggtaagtaccgagtccacacaatgtattgctgagaagaaacagtatttcctgggtttgagggaaatgtctttttaatcttgttattatttctatttctccagtgggatcaagctctttctttaccattttacttaaacttactctgaagaattttatacactgtttgatagtcagggggtcacagtggcataaatcttgttcattggagccttaataaataacactgggccaggcatggtggctcatgcctataatcctagcactttgggaggctgaagcaggtggattgcttgagcccaggagttgatggcctgggcaacttggtgacaccctgtctctacaaaaaatatgaaaattagctggacgtggtggcacaggtctgtagtcccagccactctggaggctgaggtgagaggatcacccaagcctaggattttgaggctatggtgtagtcatgatccttccactgcactctagcctgagttgacagagagaaatcctgtctctaaaaaaaattaaataaataacactatgtctgtaccttttgtttccataggtatgtcatctaggaaaaaccaagtagtagccattcagtgtcaaatattttccacgttcaaaaatagatgatttatacacacatatgatcagagtaagaagccccactgcttttactgagtatttatctgcttgaaagtggagtgatatttattctactgttcattcttggcaaaaatgtcaagactttgtttagcatttggatagtagtaccttccaggaccctattattgagcttatcagataagtaaaaagtaccaagaagtcattctaagttcctcccatttttttctgtcccttatccagttcatctcaagttctgttgtgtttctatccctgaaatatatcctactcctctccaaatctcattgctatctctcaagtctgtgacagtagtatcttttcttcaggctgctgcaatagccatctaacagatctatttccagttgtgtttccatgtggcccagcctccattcagtaaaaacagaaattattttttaacttaacccagatcatacttaaaagctttgcatggcttaccatcagattaaaatgcaaacttcttgacttgaatgatctggttcctgattaccccatctctctccttttattcattcccatctcaaccttattcactatattgtgtcatactggccttctttcagtttttagaacatagcaagctttttcccactggagggtcattatacttgttattcccattgcctgaaaagctctttttcagtcttcccatggttggtttctgctcatcttttaaggatgatcttaatgttagtatcagcttcaatacgatttattttctttaaaataattttcctgatagtctcatcaaaagaggcttcgtctctctttgttctagataacatcactctctatatctataattacaatatttatttggctcctccattagattataatctccggcagtacaggatcattgtctttcttactctccctggatttcccagcacctggtacataatagaagtttatcaaatatttgccgtacaaatgaaagaaaaggagaaggctgggtgcggtggctcacacctgtaaccccagcagtttgggagacctaggcaggtggatcacgaggtcacgagattgagactatcctgactaacagtgaaaccctgtctctactaaaaatataaaaaattagctgggcatggtggcaggcacctgtagtcccagctacttgggaggctgaggcaggagaatggcgtgaacccaggaggcggagtgtgcagtgagccgagattgcaccactgcactccagcctggacgacagagtgagactcagtctcaaaaaaaaaaaaaagaaaagaaataaggataaaatattgaatgtaaatgtcaggttttcttcatatattcagtttgtttaaacaaaattgctttaaaggggttcattaaacacatagtatgaaaccaggaacaccttaattgtatacttgatgttgatcctatgtcttgtagtgttttcttcaactatgattctcttaactctcttgactgtggagctcttgtttatattctgattaactaatctccttttctccctgagagagttcagtaccagcagagttttttaatcagcagacataaacaagttcttcagtaaagattagtttgcttgaattattctgtattgggtggctggagacagatttaactacaacatgaagttacaaggtttaattctcagctacataaactttacgtgtgcttacttaatgaaggtaagagtaagttccttattctctaggattagtgccaaagctcttttgaaagagtcttttgtatttactagtgagatcatagcagcggaagcaggctctcagcaaatttaaaatctgctaatgataaataggctttgaaaataagaacaaggctggacgcggtggctcacacttgtaatcccagcactttgggaggctgaggtgggcggatcccttgaatccaggagttcaagatcaccccattgcactccggcatgggtgacaagagtgagactccatctcaaaaaaaaaaaaagacgaggaattctacttttggtattgaaagagtagattacatcaggctaaccctcccgggaataacaattatccacctgtaatcccagcactttgggaggccgaggcaggtggatcacctgaggtcaggagttcaagaccagcctggccaacatggtgaaaccccatctgcactaaaaatacaaaaattagctggacataatggtgtgtgcctgtagtcccagctcctcaagaggctgaggcacgagaatcacttgaacctgggaggcagaggttgcagagagccgagatcatgctactatactccagcctgggcaacagagcaagactctcaaaaaaataaataaataaataagaaaaaaatgcatcaactggacaaatttaaaacatagtaatcctaagtcactggagagcaaccaaaagcaggcacaaactgaagaaaaatcaataattagaagaggagaagcacactggttgcatttcccgcttgtatagctctttttatctgtggccaggtcccagttagcagtacaagtaagcacttagaaaccttgaatcttactgattatttaagggccatgtttcaggacagctacagcagcaggaaagtgagggataaaatgctaataggggaaactgcaaattttgcatataaactcaagccacttatctaggtaactgaccccctaaactatgtatatgcagccagaatccagtatagttagttgagactaaagatactaagtagggatttcagctgctgcctaccccacggaagagagtgttacagattttggttaacccacagtaactggttgctctaatgcaaagaaaaacttattttcttttatttctttcttatttttttatttttatttctatttttttgagatggaatctcattgtgttgttgaggctcaagtgcagtagtgcaatcttggctcactgcagcctctacctcctaggctcaagtgattctcccacttcagcctcccaagtagctgggaccacaggcatgcactaccacacttggctaattttttgtacttttgataaagatagggtttcaccatgttgctcaggctagtctcaaactcttgagttcaagcagtttgcccacctcagcctcccaaagtgctgggattacaggcatgagccactgtgcccggccgaaaccagttattttcataggataataacacaattgagaatctctgtaacgtattacttataatgtccataattcaatccaaaattactggacgttaataaacatgaaaatataattcatattaagagagaaggcagtcaacactgacaatttccaaggtcatccagatgctgaaaatagcagacaaggattttaaagtcattgttataactgtgttcaaggatgtaaaggaaaatatgcttataatgaacaagcagataaatcttaaaaatggaaacataaaaattttaaaatgaacaatagcaaatgaaagtcccagaactaaaacatatatgtctgattttaaaacacaaaatgtaggtttaataacagattgaagatggcagaagtgtcagttgaacttgaaagtatatgaatataaattgtcagccaggtgtgatggttcacacctgtaatgccagcactttgggaggctgaggcaggtggatcacctgaggtcaggagttcgagaccagcctggccaacatggcaaaaccccatctctgccaaaaatacaaaaattagccaggtgtggtggcatgcacttgtattcccagctactcaggaggctgaggcaggacaatcgcttgaacccaggaggcagaggttacagtgagcagagattgcgccactgtactccagcctgggcaacagagcaagactccgtctcaaaaaaaaaaaacacaggcaggtgtggtggctcacgcctataatcccagcactttgggaagccaaggcgggcagatcatgaggtcaggagatcgaaaccatcctggctaacacggtgaaaccacgtctctactaaaaatacaaaaaaataattagccaggcgtggtggcgggcgcacgtagtcccagctactcaggaggctgaggcaggagaatggtgtgaacccgggaggtggagcttgcagtgagccgagatcacgccactgcactccagcctgggtgacagagcgagactccgtctcaaaaaaaagaaagaaaaaaggggggggggggagaatgatattaactacagatatctttaataagataaggaaattcctttttagttctgagagctttctgcagaagtctttagaattaattttgttctatagttgttttttcttttaaagtctttgtcaagttttgtattaggcatacactagcttcattaaatgagttggaaaattattttcctcctctgttttctggaagactggtattacttctttctcaaacatataccagacttcactagggaagccatttagaactgaaattttttatgtgaataatatggtaaggtactcaatttatttaaaagatctagactattcagatgttcatcttgactcagttttgatacgttgtatttctaaaggaatttgtccattttatctaaattattaaagatactggcataacattatttataacattcccttattagtctcttaatgagtctaggacctatagtgagatcaactttttttattttggatactggtaagccaccacacctggcctaatatcattcttaatggtgaaatgttgaatgtttcctcctaagattgggaagaagatagagttgtccactctgactcagcgttacatggatgttctaggcagtgtattaagtcaagaagatgagtaagagtcatcataatgatcaggaaggaagaaatgaaactgtttctgtttatagatgacatgattgtttatataaaaaaaaaatccaaagagatccacaccaaaaaaaaaaaaaaaaagctactggtagtagtagcagcaaggttactggaaaatcatcagtattaaaaaatcaattgtattcttataaaacttaatatactctgaacatttgatgtggcagtcatgctccttggtattttctcaaataatttgaaaacatatctattgaaaagaaaaacctgcatatagatgtgtgttttgtttttgtttttgttttcttttgagatggagtctcgctctgttgcccaggctggagtgcagtggcgtgatcttggctctctgcattctcctcctcctgggttcaagcaattcttgcacctcagcctcctgagtatctgggactgcaggcatgcgccaccatgcccagctaatttttgtatttttagtagagacggggtttcaccatgttgcccaggctggtctcagactcctaaccttaagtgatccacccacctcgtccttccaaagtgctgggattacaggcatgagccaccgcgcctagcctcttttttaaagtcttaaataaacatatattcagataatataaatatatatctccaagtaaagggtttatttgggaataatatacaataattaggcttggcgtggtggctcacacctgtaatcccaacactttgggaggccgaggcaggcagatcacctgaggtcagaagttcgagaccagcctggccaacatggtctctactaaaaatagaaaaaaattagccaggagtgatagtggatgcctgtaatcccagttactcaggaggctgagacaggaggatcacttgaactcaggaggtggaggttgcaatgagccaggatcacaccattgcactccagcctgcgtgacagagcaagactctgtctcaaaaaaaaagaattagtccaggcatggtggctcatgcctgtaatcccagcactttgggaggccgaggagagaagatcgcttgaggccaggagtttgagaccaacttaggcaatgtagtgagaacctctctctataaagcaataacaacatttgctgggtgcggtggtacatgcctactcaggaggctgaggcaggaggatcacttgagcccaggagatcgaggctgcagtgagttatgattgcaccagcgcactccagcctgggtgatggatcaagtccctgttttctatgaaaaaaaaaaaaaaaaagaatcgcaattcaggacacatagaccagggtagtccctaagtgtgtctgaaaaacaaagagaaaggctggggttgtattgagcaaaagaggaaggttggaagaaggtcagccaggcccagtggctcaagcctataatcccagcactttgggaggctgaggctgaggctgttggattgcttgagctcaggaattcgagaccagcctggacaacataatgaaaacccatgtatacaaaaatttaaaaagaaaagaaaaatttagccaggtatggtgacatgcacctgtggtccagctacttaggagcctgaggcaggaggatcacctgagcctgggagcttgaggctgcaatgagctgagattgcaccagtgcactccagcctgaaagacagagtgagatcctgtctcaaaaacaaagaaagaaaagaaaaaggtcactggtacagttgtcattggtgagtggcagcagttactatataagacatagtcttaattatagttagagtgaattttctgttgaaatgcaaaatcagttcctggatcagggaccttagtgccctcccccatggcctcctgactccattttagttggatatggtatgaatgattccgttttgtctaatcaactttcacacctctctcaaacttacaccagcaaacacccactggggagtgtttgcttaagcaaaagttccttaagctgataaacaactttagcaaagtctcaggatacaaaatcaatgtacaaaaatcactagcattcctatacaccaataacagttaagccaagagccaaatcatgattgaactctcattcacaattgccacaaaaagaataaaatacctaggaatacagctaactagggaagcgaaggatctctataaggagaactacaaaccactgctcaaagaaatcagcgaagacacaaatggaaaaatattccatgcttatggattggaagaataaataccgttaaaatggccatattgcccaaagcaatttatagattcaatgctattcccattaaactaccattgaaattcttcatagagctagaaaaaaactattttaacattcatatggaaccaaaaaagaacctaaatagccaaggcaatcctacacacaaaaaaagaacaaagctgaaggcatcatgctacctgacttcaaactatactacagggctacagtaatcaaaacagcatggtactgatacaagagcagacacatagaccagtgaaacagaatagagaacccagaaataagactgcacacctacaactgcgtgatctttaacaaacctgacaaaaacaagcaattgggtaaggattccctattcagtaaatggtgctgggataactggttagccatatgcagaaggttgaaactggaccccttccttacagcatatacaaaaacaaaatatggattaaaaacttcaatgtaggccaggcgtggtggctcacgcctgtaatcccagcactttgggaggctgaggcacgtggatcacttgaggccagcagttcgagaccagcctgatcaacatggcaaaatcccatctctaacaaaaatgcaaaaattagctgggtgtggtggcacatgcctataatcccagctacttgagaggctgaggcatgagaatcacttgaaccctggaggtggaggttgcattgagctgagatcgctgcactccagcctgggcaacacagcaaaactctgtctcaaaaaaaaaaaaagacttaattgtaaaacccaaaactataaaaaccctgaaagacaatctaggcagtaccattcaggacataggcacaggcaaagacttcatgacgatgccaaaagcaattgtaacaaaagcaaaaatggacaaatagtatgaacttctgcgcagcaaaataaactatgaacagagtaaacaacctataaaatgggagaaaaattttgcaaactgcttctgacaaagatctaatatccagcatctataaggaacttaaatatacaagaaaaaaaaccattgagaagtgggcaaggcctggtgtggtggctcacgcctgtcatcccagcactttgggaaaccaaggcaggcagatcacttgagatcaggagtttgagaccagcctggccaacatggtgaaaccccgtctctactaaaaaaaaaaatagaaaaaattagctgggcatggtggcacgtgcctgtaatcccagctattcaggaggctgagacagaattgcttgaactccgggtggcagaggttgcaatgagctgagaacatgccactccactccagcctaggcaaaaaagtaagactccgtctcaaaacaacaataataataaaatttttttaaagactcttggccaggcgcagtggctcacatctgtaaacccagcactttgggagaccaaggcaggcagatcacctgaggtcaggagtttgagaccattggccaacatggtgaaaccctgtctctacttaaaatacaaaaaaattagttgggcacggtggtgggctcctgtaatcccagctacttgggaggctgaggcgggagaatcgcttgaactcaggaggcacaggttgcagtgagctgagattacaccactgcactccagcctgggtgacaagagtgagactccatctccaaaaaaaaaaaaaatgggcaagggacatgaacagacacttctcaaaagacatatacgtggccaacaatcatatgtctctccctccactgccatggtgtcagaggaggtctagccgagtcagacttttaccaacacctagcagtaacataactaccccaccacaatgtcagtggagaccccttgggaaattggaattctaaccattccctagcagtaatggggagcttccccatcccccaacactcaggtttcagtggaggcctagtaggcaacttggtcttttacttacagctggcagtaatgaggcagctttatcccttttctgctggagcagtttcagaaaaagccagctaaaatacaaatttcataaaatctagaaccttatactactacaaaagtgtttaactttgaatttaaaatcatatgttatttgccaagcatggtggctcatgccttgaaatcccagcactttgggaagacaatttatgtccacaccaagacattagaattatctggcagatttttaaagcagtcttgataaaaatgccttagtgagcaattgtgaacatgcttgaaacaaatcaagaaatagaagaagataatttttcatattttattttatttattattttaattttttgagacaggttcttgctctgttgcccagtctggagtgcagtggcacaatctctgcccaccgtagcctctacctcccaggttcaagtgatttctcctgcctcagcctcccgagtagctggagttacaggcatgtgccaccatacctggctaatttttgtatttttagtaaagacggggttttaccacgttggccagactggtctggaactcctgacctcaagtgatctgcccgcctcacctcccaaagtgctgggtttacaggcgtgagccactgcacctggccaataatttttttaaattagaatttttataactgactcagtaattgaaataaaaagttcagagcttttatgagagaaattgaaccagaaaaaaaaaatacattcagagatagacttaacagcagaatgaatgggacagaggaaataatctatgcactagaagatagaataatacatattactcagcgtatacaacaacatagaaaatagaattaaaaacagaaagactgaggagcttgtgagaatatgacaaaaaaagcaaatttgtgttatcggagtcatggaaggagggaaaaaaaagggcatagatgaaaagcaccttagtaaataacaactggaaacttaccaaatttggcaggagacagaaatctctgtattcaagaagattagcagactccgaacaggataaactcaaacaaatatatgccgagacacataatcacatttcagtacactaacaaaacaattttaggctgggcgagataggttgctcctgtaataccaaataccttgggaggctgattgcttgagctcagaagtttgagaccaccctgagcaacatggtgaaaccctgtctctacaaaaaatacaaaaaaaattagccaggcatggttggcaaatgcttgtcatcccaactactcaggagaacgaatctcagaaaaaataaaaaaaacaaaaaaaaccacaccaattttaaagcaatgacagagaaattacccttacctataaggataaaacaattcaaatgacagtagatttctcatctgaatctatggaggccaaatggaagtgatacagcatttttcacatcctaaaagcaaagaattgtcaactccgaatcttctaaccaatgaaaatatctgtcaggaattaagaagaaatgaaggcattcttagattaaggaaaactaagagagtttgttgccagcagatgtaccctatgagtaaagcaagttctgtgaacagaaaggaaacaattttaaaaaaaagacactttggaacattaggaaggaagaatacagtaagcaaaaacatggatatatacaataggctttccttctcttgagttttttctaagttacgtttaatcattgaagcaaaaagttttaacactgctgtattgttttagcaactttattaagatacaattcacagaccatccaatttactcttttaaaatagactatagtttttgatatattacattttttttaacttccagtaaaatatacataacacaatttgcattttgatcatttttaagtggacaattcagtgtcattaggtacattcgcattgttgtatgaccatgactgctatccatccccggaactttttcattatcccctactgtaactctgtacccattaaactgtaactctccattctctgttcccctcagcctctggtaatcactgtctatttctttgaaagtggggttgtataatacctgttcttttgtatctgccttaattcacttagcataatgtctttaaggttcatccatgttgtagtaccatcatgtgttgcttaacgatgaggatacattctgagaaatgcattgttaggcaatcttataattatgcaaacagaatatactaaccaggctgtatggtatagcctcttgctcctaagctacaaacctgtatatcatgttagtatactgaatacagtagtcagttgtgacacagtggtaagtatttacatatctaaatgtagaaaaggtacagtaaaaatacaatataaaggataaaaaatggcagcccactatgggacacttacctgaatggagcttacaggattgtaagttcctctctgtgggtcagtgattgagtggagagtgaatgtgaaggcctaggacatcactgttaaactactgtagattttataaacactgcacacttaggctacactaaatttttattttttgttcctcaatagttaagttaatcttagctttctgtagcttttttactttataaacttaattttttaacactttgactcataataacttagctttaaacatgaacacattgtacagctgtacaagaaaatattttctttatgtccttattttataagctttatttttaacattttttcttctttttaaacttttttagttaaaagcgaaaagagggccaggcatggcggcttacgcctgtaatcccaacactttgggaggccagggcaggcagatcgcttgagcccaggagtttgagaccagcctgggcaacatggcaagaccctgtctacaaaaaataaaaaatcagccaggcatggtggcacatgcctgtagtgccagcaacttggcaggtagaagtgagaggatcgctttagtctgggaggttgaggcagcagtgagccatgatcctgctattgtactccaggctgggtgacagagcgagacactgtcttgaaaaaaaaaaaagagctaagacacaaacccacattagcctaggcccactcaggggcaagatcatcaatatcactgttttctcgctgtatgtcttgttctactgaaaggtcttcaggggcagtaacactcatggagctgtcatctgatatggtaataatgtcttctggaatatctcctgaaggatctgcctaagactgttttttggtttggtttgggtttttgtttgttcgtttgtttgtttgtttgagacagagtcttgctctgtcgcccaggctggagtgcagtggcacaatctcagctcactgcaagctccatctcctgggttcacaccattctcctgcctcagcctcccgagtagctgggactacagatgcccgccaccacgcccagctaattttttgtatttttagtagagacagggtttcaccatgttagccaggatggtcttgatctcctgacctcatgatctgcccacctcggcctcccaaactgctgggattacaggcgtgagccaccacgcccagcctggtttggttttttgagacagagtctgtgtcgttgcctgctggagtgtaatggcacgatctgggctcactgcaacctccacctcccagttcaaacaattctcctgcctcagcctcctgagtagctgggactacaggtgtgcgccaccacacccagctaatttttgtatttttagcagagacaggctttcaccatgttggccaggctgttctcgaactcctgacctcaagtgatccacccacctcggcctcccaaagtgctgggattacaggtgtgggccagcactcctggcaaggctgtttttttgttttgttttgttttcctttttttttgagaccgtgtctcactctgttgcctaggctggagtgcagtacgtgatcttgacacactgcaacctccacctctacctctgcctcccaggttcaagcgattctcctatttcagcctcccaagtagctgggattacaggcgtgtgccaccacacccagctaatttttgtatttttagtagagttggggtttcaccatgttggccaggctggtcttgaactcctgacctcaagtgatctgcctgcctcagcctcccaaagtgttgttgggattacaggcatgaaccattgcgcccagccaaggttggtttttttgtttgtttgatttttgtttttttttgagacggagtctcgcactattgtccaggctggagtgcagtggtgcaatcttggctcactgcaacctctgcctcccaggttcaagcaattctcctgcctcagcctcctgagtagctgggattacaggcgcccaccaccacacccggctaattttttgtatttttaatacagggtttcactatgttggccagccttgtctctaatgcctgacctcgtgatctacctgcctcggcctcccaaagtgctgggattacaggcatgagccactgcacccagccaaggatgtcttttaataagcaggagtatactctaaaataatgatgaaaagtatagtatattaattataaaaccagcaacaaagacattttatcaagtattatgtattatacctaattatgtctgctatgcttgtattcaactggtagcgctataggtttatttgcaccagcatcaccacaaacacatgattaacactttgcactgcaaagttatgacagctaggaggaatttttcagctcccttattaccttctgggtccaccatcatatatgcagtccattgttgactaaaacattggcacatgactatatgtataagaatttcattcttttggccaggtgcggtggctcatgcctgtaatcccagcactttgggaggctgaagcaggtggaccaccttaggtcaggagttcaagaccagcctgaccaacatggagaaaccctgtctctactaaaaaaaaaaaaaaaaatacaaattagctgggtgtggtagcacatgcctgtaatcccagctactcaagaagctgaggcaggagaatcgcttaaacccaggaggcggaggttacagtgagccgagatcgcaccattgcactctagcctgggcagcaagagcgaaacctcatctcaaaaaaaaaaagaatttcattctttttaaggctgaataattttatataagacaaaaacaaaaaaatcaaacaaaaatactatttcaataggtaggaaaaaatgttaaaagatcataaatttgcctggaaaacttctcgagttatttaaacacaagaatttctcctttttgtaatcaaccttaggttatgtgtaataatgaagagcaggtgccagatgctgtacccttaataatttttaataataataaaatatttaataagcttcataatgacctgtgtgtttttggttgtagttttgctgtatttgttgttttatgtagactattatacttaaaatatatcttcggcatatatcgtgtggagtatagtgggaaagaagagctaaaattaaaaattggtgatggaaaaatccttaaagaattaaatctttatttttttagtcagtacatgttagttcttgtagctgtttgacacctttgtataagcaaatattagaaaaggtattgaaattaatagtgttttttgtttcaggaaagtatctaagacaaaagagaattgacttccagcttccttatgatatcctttggcagtggaaacacaatcaggtacagagagcctgttttaccaggtttcattcttaagtggtaaagggggaggggtggaaatgcaagtgtttttctctccccttgttatgttttcatcttaggaggttttcagaagtgtccctgtgaaggttaggactaagaaaaatgaatttgcatccatctttaatgtgacctatttgcctttactcttactgcaaaatagcagtaagttcctgctttcctaggcaaccttctgttgttattctggacttttattttggtagcaaagattttgttctgtaagaattctatttgatgcaggtctcaggagaatttagatgtactgccagcagcactaagaaatttcagactttatttttgttggctccttcttatcagtttgaaatttatttttcacatgcaaaagagattcttctatcaaaggaagcagggaaatgtttaacactcttgcacttttaaaaaatctttaaatatattggtaactaaaaacaggaagatgccgtgttttttctcttgcttcccaaattgaaaagtttcccgtagtgatttttgtattagcttatagcccccaggtctcatattgagaacaaccattgggaaatagaaatagtcatgcaattgaggtgaatagatttcttgagttctgccaaaatgccaccaaaggtttattttggaaagccaaaattgacattcccctctgcgttgtcttctccaatggcctctcttgaattctgagagtattaatatgttaggtatttgtctcagagtttttaacaatgaaggagagaatgctttgaacatactgactagaaaataatggtgggattattccaatatattaataaacagtctagctttgtgcaagttgctgtttgttttgtacagtcccttatggcaaaatgctggaagactgcctctcttctaatgcattctttttttttttctttctaatatcttcttgattataatgtgagagctccattttgcctgcctgccctctctcctttattcactaaattaattgccttaattaaaatttgaaatgttttcctataattctcaacctgaaaagccagggtactcatctttttaatttcatgtacccacccagacatctaagtaagtcctatgcatgttgttttcctttcttttgatagaagcaaatagaatcttaatttgtccaaatgaatagctttggtctccagtgtgattttcatttaagtctatccaacaacatgctgaagaaacatgtaattccacttgtataaactatttagtgcttcttctgttgaatcttattctctcaccttttatttcagagtaaaaagagatcacaccaagagtttccctcaaatgtatccaacccaaaatgtcttgtaaatatttccagatgagcagagcacatagaaaatttcctgtatttttagtgattgatgctgccgtctggcatttgaagttaaatgctatatcaagatttttcttcttttcttctagctatacaaaaagccagatgtcccactatataagaaaattcgttcaagtgagtaacttaggagctattttttctgcctctatacgttaatgttcttctgagcctagcacttgaaaaattatcctgtatgttcacaaactattctttgctttcttttcaagatgtctacgttgatgtcaaacccctttctggttacgaagctaccacctgtaactgtaagaagccagatgatgacaccaggaagggctgtgttgatgactgcctcaataggtactgtcatgctttgatttctctaaagcataggctttaaggtatacatacaacacttcctttggagggtacagttaaataggctctttgatttttttcaagaagttgcacaaagatatataaaccataatgggtgggcggaatacagaaacagaaaatgaatgagatttagagtcttgtgtgtgccttcgttggtttaaatccttttactttttttttgtttgttttttttgttttgttttgttttgttttttttttgagacggagtctccctctgtcgcccaggctggagtgcagtggcgcgatctcggctcactgcaagctccgcctcccgggttcacaccattctcctgcctcagcctccctggtagccagcactgcaggcacccaccaccacacccagctaattttttttgtatttttagtagagatgggatttcaccgtattagccaggatgatctcaatctgacctcgtgatccaccagcctcggcctcccaaagtgctgggattacaggcgtgagccaccgcgcccagccaatccttttactatttatgagacctgagaaaagttatttaatgcatctaataaaagtaataccttaccttctctatggagggtttgtggagattatatgagactgttgataaacaatgtttgtgaagttttggctttcttgttttggggtttttgttttgttttgttttgttttttttagagatagggtctcactgtgttgcccaggctggattcaaactcctgggctcaagtagtcctcctacctcaacctcctgagtagctggaactataggtatgtgatactgtgcccagctcataaaacattaagcacagtcctaggtaccttcctagctctcaatatatggttgccacaatgaggaagcagaataggacagtggcagtgagagtgaagaggaagggcataatatattttagaagaaaagtatgttgataaaccatcggcatataggggatatgctcttcatatggggatatattctctctctgaaaataaagtgtggaatctaactgaattggagataagaattatgaatttggctggcatggtggctcatgcctataatccaagcactttgggaggctgaggcaggcaggtcacctgaggtcgggagttcaagaccagcctgaccaacatggagaaaccccatctctactaaaaatacagaattagccgggcatggtggctcatgcctataatcccagctacgtgnnnnnnnnnnnnnnnnnnnngatccctttctaggtcgactcttaaagcttttctttttctgagatggagtctagctctgttacccaggctggagtgcagtggcgcgatcttggctcactgcaacctctgcctcccgggttcaagagattctcctgcctcagcctcccaagtagctgggattacaggtgccccccaccatgcctggctaatttttgtatttttttaatttatttttttgagacagagtcgcgctctgtcgccaggctggagtgcggtggcacgatctcagctcactgcaacctccacttcccaggttcaagtgattctcctacctcagcctcccgagtagctgggactacaggcatgagccaccacacctggccaagagagtatataattttaaacggcactgaaatttcaaaatagaaatgtctaatagacaaaggagtggatatagaatttgttgttttagtaacaatgcacatgtgcagcaaaataaaaaagaatcagtgaattttacatcagtatttcctgttctggatagttctcatggccaaaagtagcttctttgatctctagtcagctgtccatgtggtctgaagggaatcaatgttttagttcttcctgcttcagcatgccagttgggaaattctaccttacctgcatcactgtaaattcacaccttatcattttatgtacatacaggttcacatagtgttttgcatactgattttctttactcacaaatattttaaatgcacacttttattaaacagtgtggtccacaagctcagtatttttatttatttatgacacaggatatcactctgttgcccaggctggagtgcagtgtcgccatcacagctcactacaacttctaccttccggactcaagcaatcctcccatgttagcctcctgagtagctgagactaaagacgcgtgtcaccacgcctggctaatttatttattttatttatttttaaagtagagacgggatctcgatacttagccgaggccggtcctgaacccttaaatctcactatatgaaggacaacctagatctacgtttagtagctggctggggtgcgactgtctcatttttcttttttttttttgagacgaagtttcattctcgttgcccaggctggagtgcaatggcacaatctcagctcactgcagcctccacctcccgggttcaagcgattctcctgcctcatccttcatccttgcgagtagctgggatttacaggcacctgccactgcacccggctaataatttttgtatttttagtagagacagggttttgccatgttgaccacgctggtctcgaactcctgacctcaggtgatcctcttgcctcagcctcccaaagtgctgggattacaggtgtgagccactgcatccagcccaactctcgtttttcaagggcattatctggctaaagataatgacaaattgtactaaatcaaagacctcacattgtagtttacagcatctaatttcagattttggtaaatttagtttggtttccagacacaacaaatagaaacatgttttggttttatataatttaaggacttattctggttgtcaaaacaaatggggaatatatttcaatgccttgaactctagaaactacaaattttcagtaacctctgaacgattgttccctggaagaaatcttttaaaatttaaatctctcttatctgagcactcttttatttatacttcagggtttttttaaatccggatgcagtttatagtatgtgttattaggtattatgaaaatacttggtgccagccaagcacagtggctcacgtctgtaatcccaacactttgggaggctgaggtaggcagatcacttgaggtcaggagtttgagaccagcctgggcaacatggcaaaaccccacctctacaaaaaatacaaaagttagcaggcatagtggtgcatgcctgcagtcccagctacttgggaggctgaggtgggaggatcgcttgagcctggaggttgaggctacagtaagctgtgatcacgccactgtactccaggctgggtgacagagtgagaccctgtgtcaaaaaaagaaaagaagaaaatataggtgtggaatattatgaactagaggttacatttgaagccatgattatagatcagctctctagaaaaaggaatatggtagaggaaaaaaggatttctaccagaaaagacaggaattggtattggcaaggtgggaaatccagtatcataaaaaatgaggaaagccaaaaaaggaaggcatttcaagaggggtattcaataatattcatgtaccaaagaagtcagcaaacggaagagtaaaggtggttgaatttgatgttaaggcactgtcttctttacagctgaagctgattatcttaaattgaagaataatccagtcgatactttctctgctcctatttacatgatttgacactgtgtgccgtgtgccctttagaatcgtggtggtatttttgtttagagtaagtcagattactctgaaagtactttaaggtataaactgttatatattttctttacaaaacttttcacttttttttttcctttttttgagacagtctcgctctgtcacccaggctggagtgcagtggcaccatctcggctcactgcagcctctgcctcccaggttcaagcgattctcctacctccgcctcccaagtagctgggattacagttgccaccacgcctggctaatttttgtatttttaatagagacgaggtttcgccgtgttggccaggctgatctcgaactcctgacctcacgtgatcctcccgcctctgccccccaaagtgctgggattacaggcatgagccaccgtgcccggcctttaaaattattattataaatataacatgatattttgacgattattttcttgatcattccttgttttagtcatgcttaaggccaggcatgttggcttacgcctgtaatccagcattttggaaggccagggtgggcggatcacttgagtccaggagtttgtgaccagcctgggcaacatggaaaaaccccatctttactaaaaatacaaaacatcaactgggcatggtggcgtgtgcctatagtcccagctattctggaggctgaggtgagaaaatcacctgagcccaggaggtcgaggctgcagtgagccaagatcatgccactgcactccagcctgggcaaccagaatgagaccctgtatccaaaaaacaaaccaaaaaataatgcttaacagcctagatgagatttcaaaccatacaccaaaactaaacagctcccattaaaacagccaggtgcattggctcacaaaatgctgtaatccctagcattttgggaggccgatgagggaggatcccatgacccccaggaatttgagaccagcctaagcaacatagcagcaagacctcacctctacaaataattttttttttaagtagtcagatgcggtggtgcgcgcctgtgttcccagctacccaggaagctgaggtgggagaattgcttgagcccaggtggtcagagctgcagcgagccattattgtgccactgtacttcaacctgggtgacagagcgagaccctgtctccaaaaaaaaagtaaagaaagcagtgacaagatgtgtgtgacttcttttgtcttctatgttcagtttttttttgttttttttttgttttttttttagacagagcctcactcttttgcccaggctggagtacagtggtgcaatctcagctcacggcaacgtccgccggacaagttcaagcaattctcctgtctcagcctcccgagtagctgggactataggcacataccaccacgcccagctaatttttgtatttttagtagagatggggtttcgccaccttggtcaggctggtcttgaactcctgacctcacatgatcctcctgcctctgccccctaaagtgctgggattacaggcatgagccactgcacccatctagaatttttaacttgttaattccctaactactatgggttcagctagtcatatagcctggaaatgtcatttcaattaatgtaatataaaattcctgtaatacaacagcagcaaatatacctaatgtcactgaactgtactcttaaaaatggttaaggctgggtgtggtagttcatgcctgtaatcccacctactcaggaggccgaggcaggatggatcccttgagccaaggagttcgaggctacagtaggctgtgatcaggccactgcaccccagtctgggtgacagagggagacttccccctctttaattaaaaaaaaaaaaggccaggcacaatggctcacgcctgtaatcccagaactttgagaggctgaggtgggcggatcacttgaggccaggagttcgagaccagcctggccaacatggcaaaacctcgtctctactacaaatacgaaaattagctgggcgtagtggtgcatgtctgtaatcccagctacttgggaagctgaggcaggagaatcccttgaatccaggaggcagaggttgtagtgagctgaaatttagccactgcactccagcctgggtgacagagcgagactttgcctcaaaaaaataaaaataaattaaaaaaaaaaaaaactggctgggcacagtggctcatgccagtaatcccagcattttgggaggctgaggtgggtggatcatttggggtcaggagttcgaaaccagcctggccaacatggtgaaaccccatctctactaaaaatacaaaaattacccgggtgttgtggtatgcgcctgtaatcccagataaggcagtagaattgcttgaacccagaggacagaggttgcagtgagctgagatcatgccactgcactccagcctgggcaatggagtgagactccgtctcaaaaaaataaataagagtaaattagcggccgggtgcagtggttcacaagcttgtaatcctagcactttgggaggccgaggcaggcggatcacctgaggttgggagtttgagaccagcctggccaacatggtaaaaccctgtctctactgaaaatacaaaaaatagccgggtgtggtgacacacatctgtaatcccagctactcgggaggctgaggcaggagaatctcttgaacctgggaagcggagtttgcagtgagccgagattgtgccaatatactccagcctgggcaacagagccagattccatctcaaaaaaaaaaaaaaaaagtaaattaggtattctaccacaatttttttttaaatcagtaaatgggcatgagtgcttcaaaataagagtacagtgaaatcatcatcaaattactgattcttctttggatcacagttatttatttatttattttatttattttattagagacggagtctcactttttcccccaggctggagcgccatggagcaatctttgcttactgtgacctccaccttacaggttgaagggaactctatgcctcagcctatgagttggtgtgctttcaggtgcccaccccctccccaattaaactttattcttttttgattcgaccgggattatcccaatcggtcaatatagcaacaattttaatcctaagtaatgcattcgttttaccttccaagtgtacttgtttttcgccacaatattctctccaccttttttctcgtgttttttcccttatctatgtatatcacgttttctatttttgtccgatttatttttagactattttttcatatctttacaatnnnnnnnnnnnnnnnnnnnncaggtgcacaccaccacacccagctaatttttgtatttttagtagagacagggtttcaccatgttggccaggctagtcttgaactcctgacctcaggtaatccacccacctcagcctcccaaagtgctgggattacaggcatgagccaccttgcccagccttattcttggaatagataaatatgataatgtttacccaggatgctgagtggacagttagcttaatcatttacaagaagcattcaggatttgcagcccgacttggaaattctgaatattattaatttttgacatttattattttaatcttagtgattcgggtacttttattaaataaaaattgatttcatgtattcatttttaaatgtttgtaaaatttaaaaatggatgcatcaaggtatgtatcatgtaagttgatgtacagttattccttttttttctagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggtacggtggtaaatgatgatactctaataaaatgccaaggtataagattagaatggagaatggaagatgtgaaatttactttcagctactctttaattgtctttcaatcatttatcttctctttaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtaaggaagcaaaagaaggtgaagacaagaatccagcagaataagcattgagtgcagcaagggattgatctttccagtgtcagtcagcttacacaaagcagctcaggctgttccccattaccccagatcccacgggcagagtaagctgcttcgttttcaccctaacttctcactcccagacagatatttttgtttttatttgtgttctgtttttttgttttgcttttttggtttttttgtttggcatgcaagtagtttcaggatctatgtcctagaaaaatataataatgatgatgatgatagccagggtggtggtacacacctgtagtcccagctatttgagaggttgaggtgagaggatcacttgagcccaggagtttcaggccagtctgggcaacatagcaagaaaaaatcaaaaacaaaaaataatgataataggccgggtgtgttggctcatgcctgtaatcccagcactttgggaggccaaggtgggcggatcacgaggtcaagagtttgagaccagcctgaccaacatggtgaaacccatctctactaaacatacaaaaattagccactcatggtagcgtgcacctataatcccagctacttgggaggctgaggcaggagaattacttgaacccgggaggccgaggttgcagtgagctgagatcacaccagtgtactccaatctgggtgacagagcaagactccatctcaaaaaaataataataatacctaatatttattgagttcttactatgtgctaggcactgtgttacatggatcatctcatatcagttcattcagccactctactgcatgcttattaaatacctggtgcatttctcacaaagagaaataaaaaaagtgaatctggaggtcccttcccctcaaatagattagcatctaattgagaaggaaaaaagtcacacctaaaaaataattttaaaaagataatatgaggatagtatgaacaactttggggttttttgttaagtttttaaaaattaaagtgtaattcatatacagagaaatacatagacttttttttttttttgagacggagtctcgctctgttgcccaggctggagtgcagtggcgcgatctcagctcactgcaagctctgcctcctgggttcatgccactctcctgcctcagcctgcccagtagctgggactacaggcacctgccaccacgcccggctaatttcttttttgtatttttagtagagacggggtttcactgtgttagccaggatggtctcgatctcctgaccttgtgatccgcccgcctcggcctcccaaagtgctgggattacaggcgtgagccaccgcgcccgtctagaaatacatagatcttaagtgtacatttccattaattttttcaaatgtatacacccatataaccaacacccctatgaaaatatgacatactttgtcatttcagaaagttaccttttaagtcaatctcccaatcccccaaagcaagcactgatctgatttccattgccacagatgagttttacctattccagaacttcatgtgaatgtattcttttgtgtctggcgtcttttttgttaaaaacatgtttttgcagttcatccatgttgaatgcattagtggtttgttactttttaatgtggagtaatacttctttgtgtgaatttaccagtttgtttatcaattactgtgaacaactttatatttgaaaagttagatgaaatgaacaaatcctttgaaaaacattccagccgggcacagtggctcacgcctataatcccagcactttgggaggccgaggtgggtggatcacaaggtcaggagttcaagaccagcctggccaagacggtgaaaccccatctctaccaaaaatacaaaaattagccgggcgtggtggtaggcgcttgtaatcccagctgctcaggaggctgtggcagagaattgcttgaacccgcgaggcggaggttgcagtgagccaagatggtgccactacaccccagcctgggcaacagagtgagactcagtctcaaaaaaaaaaaagaagaaagaaaaagaaaaacatacctttccaaaactgacataagacaaaatagaaaatctgcacatgtacccccaaaattgaaaatgtaactaaaatatctaacaaaagaacctggagaaccagatgtcttcactgataattcttccacatacttaaagaacaaataggctgggtgcagtggctcacacctgcaatcccagcactttgggaggtagaggtgggaggattgcttgagcccaggagttcaagaccagcctaggcaagatggtgagacctgtctcaacaaaaatttaaagataaaatttaaatattagctgggtgtgatggtgctacttgggagactgaggtggtaggatcgcctgagcccagaagttcgaggctgtagtttcctgtgatcatgcaactgcactccagcctgggtgacagagaccctgtgtctatttaaaaaaatgaagacgaagaagaagaaataatggcagtaccacttataaactctttgcttctataaaactagcattaccttcttctaaaatctaaccaggaaaaaatataggccagtgtgttccatgaacatagacacaaaaatcctaaataaaatatcaacaaataaaatttaacaataaataaaaagcttaatacatcatgactatgtggggtttattccaggaataaaagattgtttggtttaacattcaaaaatcagtgtaaaccaatgtaattttatcacaataatggactaaagacaaaaaatcatatattgtctcaatagaagcagaaaaagcattaaacagtattcaacactcattgataattaaaactcagcaaactaggaataaaaaggaactaacaaatctgccaaaggaaatccatttttaaaaaatctttagctaccattatacataaataaggatatccgctgtcatatctacatttgaagagtctaaccaatacaataagaaaaggaaaaaagtataaagattagaaatgaaaaaaaatttaactaccattattcgcagatgacattattatacacatgggaaatttctacagacataagtgaatttagcaagattaatggaaagatggtcagtatataaaaattaatgtattgagtacattttaatatattagcaacaaccaagtagaaagtgaaatttaaaaaccattacaaggccaggtgcagtggcttacgcctataatcccagcactttgggaggccaaggcgagcggatcatgaggtcaggagtttgagaccagtctgaccaacatggtgaaaccctgtctctactaaaaatataaaaattagccgggcatggtggcatgcacctgtagtcccagctacttgggaggctgaggcaagagaatcacttgaacctgggaggcggaggttgtagtgaactgagattgcaccaatgcactccagcctgtgtgacagagcaagactccatctcaaaaaaaaaaaaaaaaaaaaaaccaaacccattacaggctagttgcaatggctcacgcctgtaatctcagcactttcagaggccaagatgcacagattgcctgaggtcaggagttcgagaccaccctagccaacatgatgactgaaaccctgtctctacttaaaatacaaaaattagctggttgtggtggcacacgcctatagtcccagctattggaggctggggcaggagaattgcttcaactccggaggcagagtttgcagtgagccgagatcgtgccactgcactccagcctgtgtgacacaccaagactccgtgtcaaaataaataaataaataaaaaccaatacaatttacaatagcttcataaaagactagtccctaagaataaatcttatgaaagtttgtaggacctctatactagaagctgtcagaagttgggaaaaaataaagatgacctaaattaatggaaaaatacacaatgttcaagggttgagtgttggcagttttttttaagtgaaaggaagtttattaagaaagtaaaggaataaaagaaaagaaaggctattccataaacagagcagccccgagggctgctggttgcccatctttatggttctttatagattatatgctaaacacgggttggattatgcatgagttttctgggaaagtggtggacaattcgcagacctaagggttcctccactttttagaccatatagagtaactttctgacgttgccatagtgtttgttaactgtcatggcactgatgggagtgtagtagtgaggacgcccagatgtcactctcgttgccatcttagttttgatgggttttggctagcgtctttactgcagcctgttttgtcagcaaggtctttatgacctgtattttgtgccaacctcctgtcttatcctgtaactaagaatgcctaacctattgggaatgcaacccagcagatctcagcctaattttacccaacctctatacaagatggagtcgctctggtttaaacgcttctgacattttccccctcccttttataagagaacccttaatccttaggggtaaacagggatgaagatccatctttagtaatttcttcaggttgaatagcggtgatgatattcctgcctattagggtctcttgtatccaaggtagagaagagatcagtcagaaagtgtcagtatggtaagggccattcatagttctgacaaaaggtgatatcacgggtcaggaaccctatacagggactttgtggaaaaggtatgaggccagttttcccaaggggcttttattggctctctaagccaagtttggttccttaatagaaagcactccattccaatcaaagccttggtaaaataaccagtttctccaattgtatcatctggtttccagattttggagaaatgaggtagagggaaacaaacatcctttaaattttgttcacaggagttttactcaattgttaagaactgtcaatatgccaggcatggtggctcatgcctgtaatcccagcactttgggaggctgaggcaggttgatcacctgaggtcaggagttcgagactagcctggccaaaatggtgaaaccccatctctactaaaaatacaaaaaaaaaaaaaaaaaaaaaatcagccgggcatagtggcatacacctgtagtcccagctactcaggaggctgaggcaggagaatcgcttgaacccaggaggtggaggttgcagtgagctgagattgtgccactgcactccagcctgagcgacaagagcaaaactccatctcaaaaaaaaacaaagctgtcagtaactcaaaagtttcagccaatcagtgttgcagtctatttcctttgggttgtgggtctcctaagtatcatcccttcgtgatcgccagaaagatgccagaaaggggttctgatccagactccaagggagggttcttggatctcgcacaagaaagaacacaagaaagaattcaaggtgagtccatagaataaagtgaaagcaagtttattaagaaagtaaaggaataaaagaatggctactccataggcgcagagcagcctttttttttttttttttttttaagacagagctggagtacagtggtatgatcttggctcactgcagcctcctcctcccaggttcaagccgttcacctgcctcagcctcctgagtagctgagactacaggcacacaccaccatgcctggttaatttttttgtattttttgtagagacagggttgtgccatgttgtccaggctggtcttgaactcctgggctcaataagtcagcccgcttcagccttccaaagtgttgggattgcaagtgtgagccaccatgccgggcctgacaagccagtttttaaaataggtaaaagaatgggtactttaaaaaagaatatcaaagtggtcaataaatatacaacagcgcttaatatgttagatacagttattaggggaaatattaaactaaattggaaaaccactacataccctccaaaatgtaaaaaattaaagactgacagtattggcaaaggtagagcagcataaatgctcttagatttgctggtagaagtgtaaattggtataaccactttcaaaaaatggcacaacctaccaaagctaaacataaccggtaaaccagcaactctaatcctaagtatgtccccagcggaaattagtgtttgtgctagacttgtgcaagaatgtcaactagaagatatctttttctccccttcttttggagacaaggtctcactctgtcaccagggttgaagtacagtgggacgatcttgactcactgcaacctcagcttcccaagtagctgggaccacaggtgcatgccaccctgcccggctaatttttgtattttttgatagggatggagttttgccatgttgcccaggctggtctcaaactcttgggctcaagcgatcctcattgctcagtctcccaaagtgctgggattacaggtatgagccacaacacccggccagaagatacctttttttggttttttgtttttgtttttttgagacagagtcttgctctgtcgcccaggctggaatgcagtggcaccattttggctcaccacaacttccgcctcctgggttcaagcgattctcgtgcctcagcctcctgagtagctgtaactaaaggcatgcgtccctacacccggctaatttttatatttttagtagagacagtgtttcgccatgttgtccaggctggtctcgaactcctggcctcaagtgatctgcccacctaggcctcccaaagtgctgggattacaggcatgaaggtaggtgacagatcaagactctgtctcaaaaaaaaagaaaagttacagtatatatcagcaaacttgttggctttgcacctataaaactattcacaaagatgggagcagtggcctgtggagcaggatgccaactcctggtatacatttaaaatgctttctgcagccaggctccgtgggtcatgcctgtaatcgcagcactttgggaggccgaggcaagcagatcatctgagctcaggagtttgagaccagcctgggcaacatggctaaaccctgtctttactaaaaatacaaaaattagctagtcgtggtggcgaggtgggaggatcacttcagcccaggaggcagaggttgcagggagctgagattgcgccactgtactccagcctatacaagagtgagatactgtttaaaaataaaaaattagccaggcgcggtggctcacgcctataatcccagcattttgggaggccaaggcaggcggatcacgagaggtcaggagtttgagaccagcctgaccaacgtggagaaatcccgtctgtactaaaaatacaaaattagccaggcgtggtggcatgtgcctgtaatcccagctacttgggaggctgaggcaggagaatcgcttgaacacaggaggcggaggttgcagtgagccaagttcccgccattacactccagcctgggcaacaagagcaaaactccatttcaaaaaataaataaataaataaaaatttttaaatgctttctgaattcaggatggaaaaatactaaaaattaaaaattttaggcaaggttacatgtaatagggcagtatctaagctaacccttaatgtgttccacattggtaaggagacaagaagaaaaaggctgagtcaaacagcctgggttttaatcccctgggtttgaatgccacttaattgctatataactaaacaaactctgaggcgtatatacttcatatataaaatagatatcataatgcctatcttacaggattggggttttttctataggattgttttgagaattgatgatataacttgttatcagtatggcatggtagttaagattttgaagccacaatgtcaatttgaaacttgattccctaagttatcagctgtgtaactttgggcaagtggctccctgtgtgcctcagttgccttatttgtagtatgagggttataataactaataatattacatatttttatataattgttaggaggatgaaataatataaaatgttataaaaagcattcagtaaatgttagctataatgataatgactatattctttttttttttttaatatattaagataaggtctcactatgttgcccaggcgagtcacaaactcctgaacacctaaaacaaagtcaagcacggtggctcatgcctgtaatctcagcactttgggaggccaaggcgggcggatcacgagctcaggagattgagaccgtactggccaacatgatgaaaccctgtctctactaaaaatatgaaaaagtagctgggcgtggtggcacgtgcctatattccagctactcaggaagctgaggtaggagaatctcttgaacccgggagttggaggttgcagtgagccgagattctgccactgcactccagcctggggacagagcaagactatgtctcaaaaacaataaacaaaaaaacacctaaaatcctaaatgatcattaccttacatataatagaacaagagaggcactcatgtgatagagattggtagaactggaagatttgtataggtaagccataaaaagtaattttaactcatttaataagtgaactaagccttttttttttttttttttttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatttttgtatttttagtagagacggggtttcactatgttggcctggctggtcttgaactcctgacctcatgatctgccctcctcggcctcccaaaatgctgggattacaggtgtgagccactgcatgtggcctcgcctggctaatttttatatttttagtagagacggttttgccctgttggccacgctggtctcaaactcccgacctcaggtgatccacctgcctcggactcccaaagtgctgggattacaggcgtgagctacggcgcctggtctggtcttgaactcttggcctcaggtgatcctcccacctcaacctcccaaagtgcggggaatacaggcaagccatattttaggactttgaataccaagcaggaaaagttgaagcctaattgacaacatagaacatgttttcaagaaaaattatttaggattcttactctggcagtattatacaggctgccaaggatagaaaagagattaaaagtggaggccaggcgtggtggctcatacctataattctagcacttgggaggccgaggcgggcagatcacctgaggtcaggagttcaagaccagcctggccaacatggtgaaaccccatctctactaaaaatacaaaaattagccaggcgtggtggcttacacctgtagtcccagctactcaggaggctgaggcaggagaatcgcttgaatccgggaagcggaggttgcggtgagccaagatcgcaccactgcactccagcctaggcaacagagggagactccgtctcaaaaaaaaaaaaaaatttccagcctttataactctgttttctctctttacaggtctgttaatggagtataccggattggactctatgctcttaaagacatgccagctgggactgaactcacttatgattataactttcattccttcaatgtggaaaaacaggtaagaataataaatcctagagggagattgaactttatcccttacaatgctgtaataacatgagctttctgtaaacatgattgacttggagccattaagaagtatgtgggaggctggacacagtggttcacacctttaatcccagcactttgtgaggctgatgtgggcagatcacttgagctcagaatttcaagaccagcctggccaacatgacaaaaccctgtctatcaaaaatacaaagattagctggatgtggtggcgcgcacctgtaatcccagtttattggaggctaaggcaggagaattgcttcaaccttggaggcggaggttgcgttacgttgagccgagattgcaccactgtgctccagcctgggcgacaaagcaagactgactctgtctcaaaaaaaaaaaaagtatatgggaggtcaggcgcaatggcttattcctgtaatcccagcactttgtgaggctgaggcaagcggattacttgtagtctgggagttcaagacccgcctgggtaacatggtgcaaccctgtctctaccaaaaaaatgcaaaaactagccaagtgtggtcgcatgtgcctgtggtcccagctacttgggaggctgaggtgggaagattgcttgagcccgggaggtggaggttgcagtgagccaggaccacgccaatgcactgcagcctgtggaacagagcaagaccctgtctcaaacacaaaaaaagaaaaagtctgggcatggtggctcgcgcctgtaatcccggcactttgggaggccaaggcaggcagatcacaaggtcgggagttcgagattagcctgaccaatatagtgaaaccctctctctactaaaaatacaaaaatcagctgggcatggtgttacatgcttgtagtcccagctactcaggaggctgaggcaggagaatcgcttgaacccaggaggtggaggttgcagagatcgcgccaatgcactccatcctgggcgacagagcgagacttcagctcaaaaaaagaaaaaagggagaaaagaagtacatgggagcctgggcacagtagtgcatacctacctacagtcccacatactcaagaggctgagacaggagtatcacttgagcccaggagttcaaggccaacctgggccacagaacgggaccccttctctaaaatgtttaaagttttttgttattaagacaggatctcgttctgtggcccacactagaatgcagtgatgtgatcatggctcactgcagccttaatctcctgggcttaagcaatcttcccaccataaccttctgagtagctgggaccgcaggcgtgtaccactgtgcgtcgctaatttttttttaaattttttgtagagatggggtctccctcttttgtcagggctggtcacagactcctggacttaagcgatcctcccacctcagcctcccacagtgctgggactacagacctgagccaccatgcccagccaaattttttaattaagtgcttgctttgacagcatatatactaaaattggaatgatacagagaagattagcatggcccctgtgcaaggatgacaaacagattactgaagcatttcatgtttttttttttttttattaatttttttttgaggtggagtctcactctgtctcccaggctagagtgcagtggcgtgatctcggcttgctgcaagctccgcctcccaggttcacgccattctcctgcctcagcctaccgagtagctgggactacaggtgcctgtcaccacacccagctaattttttgtattttttttagtagagactgggttttaccatgttagccaggatggtctcgatctgctgaccttgtgatccgcccgccttggcctcccaaagtgctggattacaggcatgagccaccatgcctggcctttttaaaatttttttttaaagaagtatataggagaggacagttttttactctgtactccacctgtctgagatacatagtgcccaattactttgaagaaagagattgccctgtgatttttggtctccactcagttaacttttctggggaagaagttttcctaaaatttaatccatcatttctattccagtggaaacccatttctatttatactctcaatcagttgttttcccctatatgcaaatttcttgatttatacttaatgtgtgtccaaatgctcaggaatcctcctttaagctagtaaatgagactgcaagctaaaaaaaaattattactcagctggtcacagtggctcacacctgtaatcccagcactttgggaggccaaggtgggagagttgctcgagccctggagttcgagaccagcctggtcaacatggcgaaaccctgtctctacacaaaatacaaaaattagcctggcatagtggcacgcacctgtaatgtcagctactggggaggctgagataggaggatcagttgagcccaggaggttgagactgcagtgagccatgatcatactattgtacttcagcctgagtgacaggaaagaccctgccttaaaaaaataaaaataaaaaaattattctctcccttcaaagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaagggtgaataattatctaatgactttccccaaaagctgttcatgagatgctttgaggcaattgctggaataagggaattaccagagggtggcatcttaagagtggttttaatattcttggagattatttctgactgatatttttttaaatctctaatctgatccatctctttttcagagaggccatctctctgaggaacccagtgaaaatatcaacaccccaactagattgaccccccaattacagatgaagccaatgtccaatcgtgaaaggtaaaaaggaaatatccttatccatgttctttgtaagttacatgattgcttatctgtgtaaaaaattatgaaacttctatattgttgatccactttcttttgtcttaagccaaagggttcaggggatctatgaacctggatggaagaaatacaatcttttttttttttttttttttttttttagtcttacccttttgtgtgtgtgtgtgtgtgtgtgtgtgtgtgtgtgtgtgtgtgtagagctgggatcttactctgtcacccaggctggaatacagaggcctggctcaactcctgggcttaagtgatccccctgcatcatcctcccaagtagctggggctgcaggcacatgccaccacacctggctaatttttttttttttaaattttttgtagagacaaggtctcactatgttgcccaggttggtcctaaactcctgggctcaagctatcctcctgccccgatctcccaaggcattgggattacagatacgagccagcacaccaaaccatcttatgttccctaatttctaaatgaaataacatttccacatatccctgtagacccatctactcaggaggctgaggcaggaaaattacttgagcccaggaattcaagaccatcttcggcaacatggaaagaccttggttttttgttgttttttttttttttttgagacggagtctcgctgtgtcgcccaggctggagtgcagtagtgcagtggtgcaatctcggctcactgcaagctccgcctcctgggttcacaccattctcctgcctcagcctcccgagtagctgggactacaggcacgtgccaccacgcctggctaattttttatactttttagtagagacagggtttcaccatgttagccaggatggtctcgatctcctgaccttgtgatccacctgcctcagcctccccaagtgctgggattacaggcgtgagcctccacacctggccaataatttaaattttttgaagtaatttaaaaataattgttcagagaatggttcccataggcttcatcagactgtcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagacatgtaatacatgcttatttaattaatgaataaaggaagattttttttccttccttgcaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctggtaaggcatttgaaacatttcttttttttgagacagagtttcactcttgttgcccagactggagtgcaatggcatgatctaggctcactgcaacctctgcctcctgggttcaagcaattatcctgcctcagcctcctgagtagctgggattacaggcgcccgccaccatgcccggctaatttttgtatttttagtagagagggggttttgccatgttggccaggctggtctcgaactcctgacctcctgccttggaatcaaggtgattcgcctgccttggcctcccaaagtgttgggattacaggcgtaagccaccacactcagccgaatttctattaatttattttagttgctttccagcagataatctatttaacaactccttttagtattgaccaaaaaagttatgatccaaatatgtacacatcagtcagtaataacctatccatcccagttcttcagctttcctctctttagggaatagaaagaaacctcctacagcctttcaaacatgacctgtagtctgaaatagtcattaggtatcagatagatagtgggccctctttgttacttcctaccttgaaaataacttgcagacagagtaaatagtgataccaaatccactggggaaattggggtgggggacgggtaattatcagtgggtggacaggtcattatcagtttgaagacctttttatctcacattcagattcagctggggacgggtcatttctcacattcagattcagtgggggacgggtcattatcagtttgaagacctttttttctcacattcagattagcactgtactcacaaaccatcagatttcctttctgtaaccttcaataacagcactcctgagttcagatattatccagaagagactgaaagcagaggaactagcatgtccaagcatcctttctaactgaaaacagagtgttcaaaagatcatgctcttttttttaatcctttccttcttcccctcaaaaggtagaagcaattctatgtgatgtgtgagggatatgctgaatgctaactagatagatttaaaaatttgcccataatcttacatcctgtcaatgatttgattggcataaattctttgaagttatatcctaactagtttacttcttctaataataacagatatcatttacagagtgcttacatgtcaggcactgagcaaaacacattaaaagcattatctcatttaacctgcattatttccttatgagggaagtactaccattgttctcattttatgtttgagaagctgacccatgggttaaataacttgcccaagatcacacaactaataagcagtgacaccagaattcagatgctgatagattcattttgaagcccagacttacaactgctatactgtattgcatttgagcactaagctaaggtccctcttgcagcattttgtctccagtaaattccagtgtttcctgatttttcattacagaagatagaaagaactctgtgcccactaatctacctaatcacttcaggggaaaatagagcaaatggcaggaatccattgggaaagagaaagacatgtagagctccttgtttcctgtaacttaattttcactttatttttccagatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaaggtgactataaccaccttcaaattcgttctttttttctttttctttttcttttttttttaaataaatagagatagggtcttgctatattgcccaggctagtctcagactcctgggctcaagtgatccttctgtctaggcctcccaaagtgctgggattacaggtatgagctactgctcgtgggcatttcttttctttttcatttctttttctgtctcctgattatctttgatattatagtggctttttgcagttttcttaacctaaggatataaagagaaaaatggggaccaaactgccctaagatgtaagatgtaaagttttgaattttgaggcacctattccatttacattcccaaaataaatcacactctctgcattctgtcttttttttttttttttttttttttgagatggaggtctcgctatgttgcccaggctggtcttgaactcctggcctcaagcgatccttctgcctcgacctcccaaagttctgggattataagcatgagccaccatgtctgtcttgcattctcaagtaggctcatctcaccgaacatgaaactgcagtaagtatgtctaccatgtcactgcattctgagcatgaaacacgggctcttttactctgctagtgaaattgccagaaattaagtatggtagcaaatgagaagtggcccctcaccgtaaattccattttcataatacagagtaactgttacaggaaaaatcaattacagaaaatattcacagtacagtactaaattattcaatatctggaatttaattggatccatacccaacagagtaatagtaattaatttatttatttatttattttattttacttttttttttttgagacaaagtctcactctgtcacgcaggctggagtgcagtggcatgatctcggctcactgcaacctccacctcctgggttccagcgattctcctgcctcagccttcttgagtagctgggactacaggcgcacaccaccacacctgcctaagttttgtattttttagtagagacagtgtttcaccatattggccaggctggtcttgaactcctgacctcgtgatccacctgcctcggcctcccaaagtgatgggattacaggcgtgagccagcatgcccggcctttatttttattgttttagacagggtctcagtctgtcgcccaggttggagttcagtggtgcaatcttggctcaccacatcctccgcctcaagggttcagatgattctcccacctcagcctcctgagtagctgggactccaggtgtgcgccactatgcccagctaaattttgtattttttggtagtgagacggggtttcaacatgttagccaagccgttttcgaactcctgacctcaagttctctgcccacctcagcctcccaaagtgctgggattacaggcgtgagccactgtgccccgccaaactaattttttttttttttttgagacggagtctccctctgtcgcccaggctggagtgcagtggcatgatcttggctcactgcaagctccgcctcctgggttcaagcaattctcctgcctcagcctcccaagtagctgggactgcaggcgtgtagcatcacagccagctaatttatttttgtgttttttagtagagacggggtttcaccatgttagccaggatggtcttgatctcttgacctcatgatctgcccgcctcggcctcccaaagtgctggaattacaggtgtgagccactgcgcctggcctttttttttttttttttggagacagggtctcactatgttaaccaggttggagtgcagtggcacaatctcagctcaccgcaaccgccacctcccaggctcaagcgaccctcccacctcagcctcctgagtagctgggactacaggcatgcaccaacatgcccagctacttttttgtattttttgtagagnnnnnnnnnnnnnnnnnnnncttgcctgctccagcatccacatgaaagtgaacctattgtggctggctcatgtgtcctgctgattctgaaacaatctggaggtttctcaaaaatgtttatttcacaagtttgtatccttccatcctgctcccccagcctcaaaatgcacagggacactcagtgcaggaagaggtaggggtgagcgtgggaggaattcctaaagtcaagttcttaacagatgtgggaaagcgagggtctgggagaaggattttggcctggatgattctgagatctgtaggtacagtgaaacctgccacagctcatggggccctgccaagctttctcacctgggtactggcttctcagagacctctggccaggcacacagccccaccaatggctgttccccctggattgattttccttctttataacgcatttaaagggcagtttcccgtatctgcctccattaaccatgcatgaacatatagcatcacggtagccttgatttgctgttggggtcctcactgctttgtggctttgcaccagggcctgtttgcaggctggggaatgattttgctcgcgattgaggctgggaggtcccaggactgtgcggctcttctctcattttcatctaacagaatgcttcatgggagagaagaggtatttatctttggaaattgagaatgaggggaaaggagacaaaattcaagaggaggaagtcactactatttgtgattctctggttgcccccaaaaggaaacatcatgatcaaaattcaatctctctgacccacttgggattacagctgggaagagagcttcgaaatcaaacttaatgaataaactggttgatgagtgacttttttttttttttttttttttgagacagagtctcgccctgtcgcccaggttggagttcactggcgcgatctcggctcactgcaagctctgccttccgggttcacgccattctcctgcctcagcctcctgagtagctgggactacaggtgcccgtcaccatgcccggctaattttttttgtatttttagtagagacggggtttcaccgtgttagccaggacggtctcgatctcctgacctcgtgatccgcccgcctcagcctcccaaagtgctaggattacaggcgtgagccaccgcgcccggtctttttttttttctttttctttttccttttttttttaggacggagtcctgttctgtcgcccaggctggagtgcagtggcacaatctctgttcactgcaacctccgcctcccggcttcaagcaactctcctgcctcagcctgccgagtagctgggactacaggtgcatgccaccacgcccggctaatttttttatttatagcagagatggagtttccccatgttagccaggatggtcttgatctcctgacctcatgatctgcccgccttgacctctcaaagtgctgggattacaggtgtgagccaccgcacccattcccagccaaacaaattactattaattaagggcagttaatgagaactagaaagcactttttggataagatattctttttgctattataagatttgttgagtagtaatttgccctaagcagattaccctcaataagttcccatctctcattcttcacaggaagttcttctcattacccaactaacattgtgctacctttcaagcagatgcaactatatctttcatatcctagacaatcttagaattgtcatttgatccctgcctttatctacatatctgaaaaagtggctttttcacaggccttaaaaagacttggatttttggccaggcgcagtggctcatgcctgtaatcccagcactttgggaggccgaggcaggtgaatcacctgagggtcaggagttcgagactatcctggccaacatggtgaaaccctgtctctattaaaaatacaaaaattggccggacacggtggctcacgcctgtaatcccagcactttgggaggctgaggcgggcagatcacgaggtcagatcgagaccagcctggctaacacggtgaaacctcgtctctactaaaaatacaaaaaattagccgggcatggtggcgggtacctgtagtcccagctactcgggaggctgaggcaggagaatggcatgaacccgggaggtggagcttgcagtgagcaaagatcacgccactgcactccagcctgggcaacagagcgaaactcttgtctcaaaaaaaaaaaaaaaaaaaaaagtagcttggcgtggtggtacacgcctgtagtcccagctgctcgggaggctgaggcaggagaatcgcttgaactcaggaggtggaggttgcagtgagctgagatcatgccattgcacaccagcctgggcgacaagagtgagactctgtctcaaaaaaaaaaaaaaaaaaaaaaaaagacttggatttttctctcacttttaatttgagggattctattcttccagttaggagatgcttgcctcccttgtatggtggaatctttctactaaacctcacattcttttgcagattcttcccggcaagcactggcagctccacttttgaaccttcccccaaagaaaaagtaggttcacatttgtgggaatcatctgagtttttaaaaagtgctaagtgtgccagattgacaccctggctttgtgttccaggaatgctgattattatgagaagatctctgatcccctagatcttatcaccatagagaagcagatcctcactggttactataagacagtggaagcttttgatgctgacatgctcaaagtctttcggaatgctgaggtatttttcactgacttcaaacagatttcacaagtttgttctgaaaagaattagtctagaagtttaagatttttaccctcctctatcagccatatttctggttggaaaagccagtcatttttgagtatccttggggtatgtgttacagtatactaaatattatagaaggctatctatgaagacattgataggactagaatggaaggttaaatcattcccccccaaaaaaataatttttgtaaaaaactaatttagtattaaacctttatgactgcgttatatagatattttaatacatttaactaatatctgtagtttctttcctcaagaaaataagtacatgtgaaatatacagaaatatgcataggtaaatgtttatatgtgtgtgtgtgtgtgtgtgtgtgtgtgtgtgtgtatatatatatatatattttttttttttttaaatgagacagaatcttgctctgtcacccaggctggagcgcaatagcgtgatctcagctcactgcaacctccacctcccgggttcaagcgattctcctgcctcagcctcctgagtagctgggattataggcgcctgccaccatgcctggctaattttgtatttttagtagagacagggtttcaccatgttggccaggctggtcttgaactcctgacctcaggtgatctgcctgccttggcctcccagagtgttgggattacaggcgtgagccacggctcctggccagtaatatatcttgaggatggaattgaggagtatcacagtgatagattatggaatagctgaagctcattggagagaaagtgggcttgaactgatttaaaggacaggatggactattgtatggtgcatagaagagaggaaattattcagtaattttgacatgccttggagaggtgtttggaagacaaaagatcctactagataaaggaataatagaagttgaaagacaaaatgagaaagaaaaatagacaagcgggagaagagttagagcaatcttaaattgtaacattcttcctactgaaacccagcttccacatagattcaacacctgtagatctgtcacagatatccacaagacaaaggtgtatgttgaacttctacagtacattatgcttgtgatatcaattcatatttcatgatctctgtgtatttgatctggggacaagaaggcccgtgacaggaattgaatgacagatcagttgagcaaatggaaaaataacatgcagattctaacttgaattcattttagttcagtttaagttgttaccaactatctggccatatatttgatactattgaaaatctgttaaccaaaatgggagggtaaagaaagtcatgctaccttgctacctctttaggtaaattgttaagccacattgagagaaccaaacatgatttctttatttgctttcttcagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaaggatgaaggtctcatgatccagtgtgacaagtgcatggtgagggtcaggaaatgaagcagaagcttggtcctgatgaacacggtgaccatattcaaagaagaagcccatgcctcttttggattggcttgaaagactgtttatgaactgtaacttagccttggtttctgttaggtttctgtgtttactatattgcctttctccttttatctttctttcactttatccttcccttctttttctttccttctctcctctcttcttgtttttttgttttgttttgtttataagataggatcttgctctgtcatccacactggagtgtggtggcacgatctcagctctctgcaacctctgcctcccaggctcaagcaatcctcccacctcagcctctcgagtagctgggattataggcatgtgccacgtgccaccatgcccggctaattttttgtactttttgtagagatggggtgtcaccatgttgcccaggctggtcttgaactcctgagctcaagtgatctgcccacctcggcctcccagagcgttgggattacaggcatgagccaccacgcctggctctttccttctttctgcccactttccactgtacacttctcacataatctggatcaaggaaaatgacagtatttcatatagtgctttgccttttgaatcattagtgataatacactctattaattgaatcctctgatagagtgaaatatgttaatacatgtagggctcctgatgaagaagtcaaagcctggatttgagccttagtgtccccactaatatatgtgaatgcataactttatgtgtaaagtggctgtaagtaacgcacaggattgttgggaggctaaagttagacaggagtaaataaaacattttgtagctgtattctgaaagcagaatagctgtagcatttacttaaattacttagtaatagttcagtagtctatttgttttcctattctctgtccatctccccattttatttgcccagatctatagattatgagtcaatcggtatacttttgcttagaacagtcattattttgttttcctcctattttaccatttatctctaatttatcattcacccagttatcccttagttcctcttttactttaccctgacctattgctaattttttattctgggctcccaggacactctcaataagtcatagcctccatgttccccaaactgtatgtttttctacaggtatggcagcactgtgattgtatgggagtgaactcagatgtggagcactacctttgtgagcagtgtgacccaaggcctgtggacagggtaagctgaacctctgataaaactctgatctataagtaggagaggtagcacatggtatctcacctgtcctgctcctgctttgcagaatttcctttaataggttgttcagcctctctgggccttggtttcttaaactttacattaagggtcataattctgttcttccctatttcaggagtatgaccaaagggaaaataaaatacttagaaatctgtggaaggaatggcactatataaaactaaggtttttggccgggcacggtcgctcatgcctgtaatcctagcacactgggaggctaaggcggatggattgcctgagctcaggagttcgagaccagcctgggcaacacggtgaaaccccatctctactaaaatacaaaaaaaattagccgggcatggaggcgtgcacctgaagtctcaggtacttgggtggctgaggcaagagaactgctagaacccgggaggcagatgttgcagtaagccaagatcatgccagtgcactccagcctgggcgacagagcaagaccccatctcttagaaaaaaaaaaaaaaaaaggccgggtgcagtggatcatgaggtcaggagtttgagaccagcctggccaagatggtgaaaccctgtctctactaaaaattcaaaacttagccaggcacagtggcaggtgcctgtaatcccagctactcaggagtctgaggcaggcaaatcacttgaacccaggaggcagaggttgcagtgagccaagatcgcatcactgcattctagcctgggcaacagagcaagacactgtctcaaaaaaaaaaaaaaaaaaaaagctgggcatggtggctcacacctataatcccagcactttgggaggccgaggcgggcagatcacaaggtcaagagataaagaccatcctcggccgggcgcagtggctcacggctgcaatcccagcattttgagaggctaaggcgggtggatcatggggttaggagttcaagaccagcctggccaatatggtgaaaccccatctctactaaaaactgcaaaaaaaattagccgggtgcagtggcaggcgcctgtaatcccatctacttgggagtctgaggcaggggaatcacttgaacctgggcggcagaggttgcaatgagccaagatcacgccactgcactctagcccgggtgacggagtgagactcagtctccaaaaaaaaaaaaaaaaaaaaaaaagaccatcctggctaacatggtgaaaccccgtctctactaaaaatacaaaaattagctgggcgtggtgttgcgtgcctgtagtcccagctactcgggaggctaaggcaggagaattcacttgaatctggaggcggaagttgcagtgggtcgagatcgcaccactgcaccccagcctgccaacagagcgagactccatttcaaaaaaaaacaaaactgaggtttttataaacactatcagatgtccatgaaaggaatagcttacaaaatccagaacttggtacccttaacgtcatttatgttagacagtggtttaagtgaaaagagcactggactcagaatcagcaaaggttagtgttaggctcacttcataggagagagggtaagtggcttgcctaagtcattaagtgggttctgtgcttggctctgctatctttatatgtgtgattttgggcaagtcatttttaaaaaaagaagagatttaggcagtatttcttaacaatgttgctgttgtcatgtttaggtgaatagttcttgttgtgagggatgcatttcagaatgtttggcttccttggaccctgggcattaaataccagtagcataccccaatcattgtaataattagtctcccttcacacattttcatatggcccctagattacgtagagcaactacacaattagtgcttcataaaacatagattgagatacttagcctatcagttttgtcctctaccttcacttttccaggtttaacagctctagttgctttcatcttttttgtatatctgtggtatattgaaatgactaaacagtaagttttgattgagaattctaggttgagaaataagtaggctgaatgtagtaattccagcccttatacattggctttctgctcctatcaggaggttcccatgatccctcggccccactatgcccaacctggctgtgtctacttcatctgtttgctccgagatgacttgctgcttcgtcagggtatgtatacaggagctaatcctacttgtcagaggtgacctttctgaatagtaggaagtctctgctgtctccatcatagtcattgtctccatacggcctcgaatagcaatagaatataagtttttatatctgtagtccttgtgcttacatgcatcacctctccaccaaataatactaatttgaaatgatagacatgttacaaagctaattttaagactgggaaaaacatataggaagctcaagaaatggaatgcctcccttatattattgtcatagtctagaattgattatcatcacttaacactgctgcttttagctctctgtatttatactgtttcagattatgagttctatgtagaccctgagtcagataaacagatgcctaacagaattcatacaagaattgttttatgtttcttctgtgttctgggtcttcctaggtgactgtgtgtatctgatgagggatagtcggcgcacccctgatggccacccggtccgtcagtcctatcgactgttatctcacattaaccgagataaacttgacatctttcgcattgagaagctttggaagaatgaaaagtacgtgctgaggtcctgtccttttcttccagccgtgctgtaccagtggagctgaatgttcactaggatcttgctaatcagctaaacctctcccttctcacttttccattgttttagagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaaggtaagtgatctgggctagttaaaaaatgacctcggccaagtgcagtggctcacgctggtaatcccagcggtgtgggaggccgaggcaggcagattgcttaagcccaggagtgtgagaccagcctggccaacgtggcaaaactctgcctctgtagctgggcatggcagtgtaggcctgtagtcccaactactgggaggattgctgagcctgggaggcagaggttgcagtgagccaagatcgcaccactgcactccaacctgtgcaacagaatgaaaccctgcctcaaaaaaaaaaaaaagacttcaatgacctcatgtctcctgttcattgcccaccccattcttgttgcctgtatatgattgcctgtatatgatgaaagattctccaaggctagctatgaaacttcagagagctctactatattttttcctttcttttacctagggcttagtactcaataaaagtttattcttttttattaaatttagttaattttgttaatactgtgtactaatttcaaattccagctctaccacattttatctatgttcctttgtggaatttacttaatctaagtatcagtttcccattgaaaataaggactatctattttaaagagttcttaaaagattatataaaataatctacaaaagcactcagcctagtttatggcttagagtaaaagctcaatatatgttatttgtcactattagcagagttcagttgcctagactgttctctcagaatcatagcaaaatagtctaaaagactacgtattccattccaaaactgacagactgcttgcagttctgtgtgatactgatgagtcctccttgtctcagttaaaaagtgttcatgtacaaatgtgcttccctcaaatttatgcctctgttcttttcttgtaactcctcgtaacctgctcagtttttccctcaaaatactccctcacacatccctgcagcactcagtttacatttctggtttatttccatccattctgctgtatatttactttatcctttgttgacactagtgtctgagaactctttgtccagcaactaccaaatgcttagttgtcctgcctctctacatagctaccatgtagggttttaagggtctagctgctctcccattggtgtgtatggggtctttgggcagctcagggggagaaatggctaaataggattccttaacactggttggacccatagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcggtgagtctccttcctttcttaacactacatgttaggacaatctggttcatgcatgaaattcactgagcgaaaatcttcacgtagttctctgcttcttcatccaaattccatcccaaactatggatatctctgtctctatttgggacatttgaacagcataagtacatttcctcacatagactgtatctcagaaaattgttgatatagtgttatacctttcctcttttctctttcgtctgtttaacctttgctggcgagccccattctgtagatttttgttttgttttgtctttcacacccataattttaagaagcaagaaccctgaaaaactcctttttttcctctctctcattgagaacacacccgtaaaagaagaaccttcacagaaaataattcagtgctttttctttttatgcctgcattaaaaatggaagacacgatcattatataaaatttgtgagccaggcgcggtggctcacgcctgtaatcccagcactttgggaggccaaggtgggcggatcatgaggtcaggagatcaagaccatcctggctaacacggtgaaaccccctctctactaaaaatacaacaaattagccaggtgtggtggcaggtgcctgtggtcccagctactcgggaggctgaggcaggagaatagcgtgaacccaggaggcagagcttgcagtgagccaagatcacgccactgcactccagcctgggtgacagagcgagactccgtctcaaaaaaaaaaaaaaattgtgaacattgaaaccccgtctctactaaaaatacaaaaattagccaggtgtggtggcgcgcacctgtaatcctagctactcaggagactgaggcaggagaatcgcttgaacctgggaggcagagattgcagtgagccaagatcgcgccattgcactccagcttgggtgacagagcgagactccatctcaaaacaaaacaacaacaacaacaaaacaaaatttgtggtggtggtgtttattgtataaacatcatggtggctcacgtgtgtaatctcagcaccttgggaggctgagacaggaggatcacttgagcccaggagtttgaggttacagtaagctgattgtgccactgcactccagcctgagtgacagagaccctgtctcaaaaaaaaaaaaaaaattaagtatagaagcataagaggaaaaaagttatatatatactccactatccagaaaataaccattattaacattttcattgtcaggctttttcctggtattttttctttcaaattgttgagaaccgtgtgccaattatacgttttgtcattcatcattccataaagattttgatcatccattcatctgtttgctctaataaaaccctggctgagctcctcatctttgagtcttcttttagtgggcctgtcaaaagtcatagctgtcaccctggaatccttagcaataatctaaccagggccaggcgcggtggctcacacctgtaatcccagaactttgggaggctgaggcgggtggatcacaaagtcaggagattgagaccagcctggtcgacatggtgaaaccccatctctactaaaaatacaaaaattagccgggcatggtggcatgcacctgtaatcccagttactcaggaggctgaggcagaagaatcgcttgaacccagaggcagagattgcagtgagccaagatcgcaccactgtactccagcctggcaacaggacaagactctcaaaaaataaaaagaaagaaaaataagctaaccagaaaacaaagcaatatgttcctattttccctattttttttttttaattttccagaccgtcttttgtattctctgcccaccaccaggtctttcctcgcatctagacttatttggttttgcttgctcaatcaatagcttactgactagctttgaaaccccagccttaactacagtcatgtgcaacatgtttcagtcaacattggactgcatatacaacggtgatcccgtaagattataatggagctgaagaattccttcctatcatctagtgatgtcatagctgtcgtaacatactgcaatgtaataccttttctatgtttagatacacaatacttaccatggtattacaactgcctacagtattcagtacagtattgtgctgtatatataggcttgtagcctaggagcaataggctatactaaatagcctaggtgtatagtaggctatactatctaggtttgcgtaaggatgctttatgatgtttacataacaatcaaatcacgtgatgacatatttctcagaacatatccccgtatgaccccaagcgacatatgactgtatttaaaaggtgaaatgggatagagaaaattgtgcacttatccctcccattgtcatcctgggagcacaaaatgctgataatcattgtggcctgcatattcatagaagtactaaatttctcatcttaaaacaaagtcacccaacttgtctactgccctactgtgttccttatcctgactggccccagagaagagctagctctcccagcttctacaatatgcttacctcttccttttcttctctgcagcctcattacgtcccagacaactacaagaggaatggaggacggtaagtcccatggggggatatgaggatcctaagggattgactaagagcttgaatggatcaagaaaacaaacaactacccactcagctccacttctaggactgggtattctctgcagagtagcccagtgtagtgccagcactatggaagaactaaatttcagtagatgtggtcccattatggagccttaattggagcaacagagagatgtgcagggagtagagacagagatttggaacagaactccagactcagaaaagtttcttttagatgtctgtaagctttccccattacctcaaggtatatcagctcttggtacctctatcaaggaacagatgtagccagtacagttttcactgagctatgaactatgggttcatagtttttatttttgcttattttgtacgtgaggattattcctgaagaaagatgacagaaggctttttcttcagtctcctcatctgttgaatgggggcataacaactgctttacctacaccaatagcttaccataagggagaaaatattagactattgatatgaaaaagggaagcacgaaaatttaaaactccatttaaatatttattattgtagttggattattggcatcacaaggttgtgccgtgcttctctagtcatgaagcagtcatttagaaccagctaagcaattttattagcccttgtatattttatggattcctataccatttgtgaatattcctaagagaaataataaaagttgaattttacaaataaatttctggtaaaggtagtgttttattcaaataatataaagtgaaaacgagagtcaagtttcttacctcaagctaaggctctaactgctggactccaggatctcaagccatcttgaggcctcctacccttcatccccttttcctcctcaagtgtcttacactaaattcagatatccttctggcagatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatggtaagaagaatcaggttcatatctagggtttaagataaatgcgaaatgagagggaatggaaaaaaattgtaattactggttcagcatccaaagtattctaagaaaatggtatagttcttttataggcttgcttttagttgtatcttggtagtgaaactggaaggtgagatgatctcctctaaagaaccacctttttcacgtagggttggaggatgggctaaattgcttataggtcagaaaaggaatcattgagttcgtgtgctctccttagagctcaaatctggaataaggagtaggagattggtattttgatgagcctccttggttctgttttcagccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17203 - DNA, 16287 bp, Human
tatttggaagaaatctaatagatcctctttaaagcaaggagtcaatgaataaatgaagcaaaggaagtctgattgctaagctctttatacaaagcctggctgtgagtcgtttggtctaacaaacaatagcctcagtaaatgctgttaagtgaggaggaagaggagaagggggctgaggagaaggcaggaattccaagctagagtaggtccctgagacagtccagcctagtaaacctccgaatggagaaaaaaaatgcccaaagagaaaggatctccgcaaggtcacacagccagtgaatggatgagcaaggactagaacccatcacctgaactcccaaccaggcgtcttttcattgctgcattaagcctagaaaactacagcatagggcactgaggccatatcggccacgtacgctctttgactgcctcagtttcccccactgcgcccgtgctgagtagccctggcaaggtttggatgcttggctagttcggccccctccccagtcatcagggcacagcagagggcgccggcgccacccctcaccagcacggccaggctgtccaggtccactgacggcagcccccagccccctgaccagcagaacagctccatgggcgccgccatcttgcccaccctctgtcccggaaacacttccttgtgtgcttctgccctcccctgcctgggcccgccccccgccaccgcccctccgatcgttgcggtcagggggcctggggagatccccggggaggcgaggcttcttctggcccgactggcagctgaactgcgggggactgggccgcgggcctcgggggagggcggccgccggcccatccagaggtggcccacgtagcgggacagcgctgtcggcccggcgcgcctcggagagtcacggcgcctcgtccaagtggagccccgaacccctgaaggcgcggcaggctctggagagcggggtcttgtgcgcctgggccaggtctgggggctcttgccaaactgcacgtggcctgtactgctccagggccccttggggctcgtccccgagcggggactgcgggggggtcccccgagcagcatgttttccacagcgcgttatgtttggagcgggccctgcgccgcctgtcgccatggaaacaaaacaggggcggtggcggcggccggagcggaggccgggctggggcttgggtgggggaggggaagagaggctcgcaggctgtcgcttaggtgacgggaactcaggcgcccctctgcttcatccgggtcacggcccgtccgctagtacccacagtgttccacagtctggtccttggctcctcgcctgtacccctggtcttctgcgcctgtccctggtgtccctttcctcttttttggtttcttcactctgacctcactgaccactgctttagattctcccttcagttcccgtcagacgcttccagactcccaagctttcctacgaatgagggaaaatggagaaacaggcacttgtcaggggaccccccaccctaataaagagcacttgctccgccagaacagcaaaattcatgccatgtgggcatccctgggcactatagcaagctagttgcggccactcccttggcatcctttcctgccagctgtggaataatgcccactgtctagcactgcccctgccaggggttcttgccttccacaatcgtggcttccagaaaacagtggcattcggtagcgctgtgtgccgagacccccaacaatgatgactgcggagagggaggcacctgggggaggatcattagggagaggtagaaagcagggaggcctccaggattctttcccagtgcccctggttcccagagctgatgatgcctccagggtgattggcagctctttgtttcagccccccctcacccgcctgctggccccccctccaattctgtccctccgccccccggctcctgctctctccgcctagccttttcccctcccagctgcctgcctgccaggggtagtgagccggctgagaggcatggagacgcaggaacttcggggggccctggctcttctcctcctttgctttttcacatctgccagtcaggatctgcagggtaagcctgtctccatcctcttagaccgctctctgcttcttccccatttgccctcagcccaagtagcagagaacatgtgggcaaggggagaggggaagagtccagaaattgagccagaggaaaacttaagactgcctagagttggtgaaattatggcctggtggagaggagtgggcaccggagagtagtgggggagctggaacaggacagggtcaggcatgaggccagggcagaggactcaggaactggatgctcaggctgcctggctggggtggttcctgagcatctgtaggcaccctagggtctgggagagcagcctgaaggtgggcgtactgtaggtccctgggcttcgtccccctgggctcctggctgcccaaggacagggcgggggtggggaccaagaagcctgggctctcccggaggtctggtggtgggatgggccgatggatgtgggagaggtagctggagcagatgacacaggcatagattctttactggctggagggaaaaccacagattggccaggacacaggaggcagaggagctgggtcctacattcccgtgggagatagcccagatggtgggagggttagagtcctcagtgggcagctgttcttatccagagcgagtgtgctgcgcccctaggatgggaggaggggaactagggtgtggaacgagccaaacccaggagtggaaagagaagctgccttccatttctacgttgtggacaccaggtgccactcctgtgggggatcagcacagcatctcctttgcgccacctggtgggggcatctcaaatttgtggggtgctgtttctgtgtttccaagtgagtctcaaacctgcaggttcctggaaggtagtaataggcaataatggggaaaggaaggcacagtgcctctgtcctctgagagcaacaagggttgaggtttttttttgttttcgttttgtctttttgagatggagtttcactcttgttgcccaggctggagtgcaatggcgcgatctcggctcactgcaacctccacctctcaggttcaagcgagtctcctgcctcagcctcctgagtagctgggattacaggtgcccgccaccacgcccggctaggtggtttttttttcttttttgttgttgtttttgtatttttagtagacacggggtttcaccgtgttggccaggctggtctcgaactcctgaccttaggcgatccacctgcctcaacctcccaaggtgttgggattacaggtgcgagccaccatgcccagccaagggttgaattttgaggtgactaacgctgcctggtggtgggggtagggggtgatgtgggctcgggggagggcataccttagcatttgatcccattctctaaccttgataacccctgcctgaccagtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaaggtgactggtgggcatctcctttcttgcaatggtgacctccttaagcactctccctcatccctacttcccaagtgcttcctcattctccttggcctccactagggaccaaggtcccatcaggctgtgcccagacatcaggggcacctggtatggggtgcttataaggtgctttaggagcccatgtaccaaacaatagggtgaggcttgagtcctgatatttatagggatgggaggttgtacttggggatgcctggaaggagggtgaggcatgtctctgtgcctcagcggtgatacagaaaggtctttcagatccctggaacaggtcagtggccacaaaaccagctgtcaccctaggagaggatacagtcatctgataccaatgaagactaagaaagtatttgtctctaaaccaattatttttttaaatggagtcttgctttgtcacctaggctggagtgcagtggtacaatctcagctcactgcaacctctgcctcctgggttcaagcaattctcctatctcagcctcctgagtagctgggactacaggtgcccaccaccatgcctggctaacttttgtatttttagtagaaacagggtttcgccatgttgaccaggctgttctcgaacttctgacctcaagtgatctgcccaccttggccttctaaagtgctgggattacaggtgtgagccaccgtgcctggcctctaaagcaatttcaaaaacatttattgtgtacctattaaatacaaggtgttgagagccacatagtagaattagggataggggccctagagatgtggtatctagcagagttgatccaaggctcagctgggaggcagggggtgggggatagcgcccatactgatctcccctcctgggcagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcaggtgagccgggaggagcctctgagttctgtggaaatagagtttgcaccagctggggaaggggttggtagaccttcccaccttactctgctgctatccccccagggctttgtggaatctatgaaaattattctgggtgggtccatggcccgggtaggagccctgagtgagtgtccattccaaggggacgagtccatccacagtgcaggtaacacagagacttgtttgctgacattggaccacggatcctgtggcctttggtgactcctgtcttcttgatctccctctcccttaaaacccattcctttggctcacctgttcctagggtttctaaccctgttattccaaatctttcacctgactccacaatctccaatacacccatccgagaaaaaaagtgatctaagagaagaattggttaattgcttggccttggctgaccaagagatactggtctcgagtattttttttttttttggtgatggagtcttgtcctgttgcccaggccggagtgcagtggtgcaatctgggtcactgcagtctccactgagttcaagtgattctcctgcctcagcctcccaagcagctgggattacaggcgccctccaccatgcctagctaattttgcatttttagtagagatgggatttcaccacgttggccaggctggtctcaaacacctaatctcaagtgatgcacccacctcggcctctcaaagtgctgggattacaggcgtaagccaccgcgcccggcctggtctcgagtcttttatagttctcactggcagctgtcaccagcaatttctctgagtgttgcccatctgcctggtctctctgacagggatgttcagaagctctcacctaaataaaagacccacctttcccagatatttgagggagagctcttgaagaagggaatgggatggcgggtgtggtggctcacacctgtaatcccagcactttgggaggctgaggtgggctgatccctcaaggtccggagttcaagaccagcctggccaacactgtgaaacctcctctctactaaaaaatacaaaaaattagctgggcatggtggtgggcacctgtagtcccagctacttgggaggcggaggcaggagagttgcttgaacccaggaggtggaggttgtggtgagcagagatcacgccactgcattccagcctgggaaacagagcaagactccgactcaaaaaaaaaaaaaatggggatatactggggccctggccctgctttgggtccatcccttctgccactaccatgcctaggaaccaggaggatttgggttctaacttcctgtgaagcaactcccttagagggccttttgccccatagaaggagctggcactgcttgtctgccagctctgccctcccagcatccagcaccccatctttattctggggctccagccctgtccctgtcctcaccttccttcctccttctcaccaaccaggcctctcttcacttcacctcacccctctgactatgttttcttctcctctccagtgaccaatgcactgcactccattctaggtgagtaggccacactgaagcggaagcggggagcggggaggaggccccaggctctggcagctgcctgaaactaagtcctcttcagtcaggaatgtagtaggtttaaaggcaggggtgggcagccgtggcaggtactggcttattgcccatggagggcccaggactggtgctccagtactgaacccctcacaccctgggtcccgacaggggagcagaccaaggcgctggtcacccaactcaccctcttcaaccagatcctggtggagctgcgggatgatatacgagaccaggtttgggtgggctggcgaagggtggcactgattctggggtagggtggcagatgtcaagtgctgactcctccccatccttctccaggtgaaggaaatgtccctgatccgaaacaccattatggagtgtcaggtgtgcggtgagtgggagagcaggggaggctccacatgaccgtgccacgttccccacccaatggctttggctttcccttctggtggcttaaatagtgaccaccgggtagctctgactgtgtccacccctcaggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgaggtgagggaggtcagagcccagaagggtacagaaaactggggtgaggatgtcaggaggcacccaagagggtgggataaatgctggtccggaggagaggaatctggagtttaggagaggtcagaggcaagagaaatgcaagatgggagagacagaaggcctggggcaaagactgaaggccatacagggaaggagctggggaaactgcaggggaggcttgagatggtgaccagtggcatggggagggagagagggaaccccgagggaagtggggtggggaccaggagcacaaggcagttgtgtggggagagctgcacaaaggggagacctggagcaatggttcctggatcacaggcagggacctgagtttcccagagggcggcctgacctctgccttctcatctggtccccagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtcagactgggtagtgtgtgtggacaagggatcttggccttgtagaggccaggggcttctgggttggacatgggacccttgtgatgaatgggacatggatggctttgcatcggctttgggtctgggcttaatgttgatgttcacagataaggccataccagtgtcctctgctgtatctgaggagacccaccataggtctggttccacccaaagtctgccccttcaggtctgcaatgacatcgatgaatgcaacgatggcaacaatggtggctgtgacccaaactccatctgcaccaacactgtggtgagctgaatatcctgagtgtattctggggtggtgggaatggtaaaaccccaacccccgccccttcttaccttcaaatttcctgctgcctttcctcctccccagggcactacacagattaggtgttcacatggacttggtttggaatactggtttgcctcttgctagctctttagcaggttatttaacttttctgagcctcagcttcctcatctgaaaactgaggctgttatccaccctgaaaggttgtcatgataacctaaaggagatactgatatgcctggcataactgagtgcccagcccacactccgcaggtggagcagtgctggtcctgggtgcctggtgggctcaccctccttcctaagatgctgcctctccactcttagggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccaggtgagctaggcttcaggcgtggaaggaaaagggagggtctggggaaaggagtagggctatgtttagggcctgggttgggggtcttcataggagagaggtgggcctgggcccaggaactgtttggtggggagaataggacctgaagcagggaaaatatagggaggaggggagccagaccaaactgctagctcctaccctttgtgttgccctagtgtaacgtgggctgggctgggaatgggaacgtgtgtgggactgacacagacatcgatggctacccagaccaagcactgccctgcatggacaacaacaaacactgcaaacaggtgcagggagcaggcgggcaagggggcgtagtggggagcccaagctgggtcaggccagaactcatccatcctcttcccctgaactttaggacaactgccttttgacacccaactctgggcaggaagatgctgataatgatggtgtgggggaccagtgtgatgatgatgctgatggggatgggatcaagaatgttgaggtgactcccagactgccctgccccttgaagctcctctcccctcctcctgtcctctctgtgcctcacttacctcatctggcagctctctagtaagggccaaatactccaaatcagggaggcaaaaacctcgtgcccaggacaaggaggctgggtgggtgggactgtactgagcagtttgtccatcacaagggtgtgatcttagaaaaggatacagagacaaggtaggtgcaagatgacaagtgatttaggggagacctgacccttcccctcccacccctctgcccaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggtgcaggcctggggctgaaggggtggctgggggacctgtgagaatttggatcaggtggggatgaagcagggaagctaggaagtctctgtgaaatagggaggcaggcttgtggacgttggcctgggtgaggagagattacctgcagcagatgtcaataggaatgtgaggtagggcgtagtgttaggcagagtgtggactagagggtgagacaagaaacaggcagatttcctggccagttgtcctctgggtggggagacaaagttcgggactttcaccaacctagaagagagaatatggcatgttctagtaacaaccttgtgctacccatgtcttctaggcatccccaatggattggacaattgccctaaagtccccaacccactacagacagacagggatgaggacggggtgggagatgcttgcgacagctgccctgaaatgagcaatcctacccaggtacagggagatggtaaggacaggggagggatgagggtactgatggatgaagccccagccctttggatggaaagtggtcagatcaccctcttcagagttatcaagaggagatggtgagaacaggtccctctctctcagacagatgcagacagcgacctggtgggggatgtctgtgatactaatgaagacaggtaaggtcttggtcaagagacgcaaggtctttcttttttttgtctttctgagacggagtcttgctctgtcacctaggctggagtacagtggcacgatcttggctcactgcaacctccgtctcccagggtcaagtgattctcatgcctcaacctccctgagtggctaggattacaggcatgtgctaccaagcccagctaattcttgtattttcagtagagacagggtttcaccatgttggacaggctggtctcgaactccttacctcaggtgatccgccagcctctgcctcccaaagtgctgtgattacaggtgtgagccactgtgccagcgaaatgcaaggtcttataggggatattttactttcctctagtatatcctttttttttttttttgagacggagtcttgctctgtcgcccaggctggagtacagtggcatgatctcggctcactgcaagctccacctcccgagttcacgccattcttctgcctcagcctcccaagtagctgggactacaggcgcctgccaccacgcccggctaattttttgtgtttttagtagagacggggtttcactgtgttaaccaggatggtctcgatctcctgatctcgtgatttgcctgcctcagcctcccaaagtgctgggattacaggcgtgagccactgtgcccggcctcctttttttttttgagatggagtcttgctctgtcactcaagctggagtgcagtgatatcggctcactgcaacctccacctccagggttcaagcgattttcctgcctcagcctcccgagtagctgggattacaggcgcgtgctaccaagctcagctaatttttgtgtttttagtagagacagggtttcatcgtgttggccaggctggtctcgaactcctgacctcaggtgatctgcccgccttggcctcccaaagtactgggaatacaggcatgagccactgtgcccaggccatagtatattctaaattccttctatgatttagccttaattctctattgctattcagcaggaatttattcttacagtcatccctccattcctactgccagaccttcacctcacctggctgactgccaggggtctgattgtatggagagcaggctccagagactcccaggcagaagcgaagggaaggacaaggagtacctttaaatcctttatttggtacctgttcttctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggtaagcctgcggacccagagcacgttagactggtgttgcctttgcccaggtggaggcagcaagccctgttgggaagtgaggaagggcaaggtggggaaagatgtcaggaatgcaggcccaacagatggtattgttgcctaatggcagtggccagggccttcctgagcacccagcctcactctgcccaggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccaggtaactcggggcagtgggctgggcaggtgctatcagacagggctactgggacggggggcctgggagggatagcacacctgcatcacagctttttctttactatacaaccccagggcatggaaatcgttcagaccatgaacagtgaccctggcttggcagttggtatgtaagggatatgcagttcaatcacttccaaatggaggaatcctataggggcagagggtaggggaggaaacagacagggagaatgggcaaagtggcgagagagaaggcagtggcacaagctggccacatacatagcaggcatcccttcccaactttaccccatgatgggccgccagtagctttgctgcccctgacctttatcccacccccaccccaggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggtccccagctgctcagattccgcaacccagggccctttcccaaagctctcctctgcagccccagggcctcccccactgcttgactgggaaccctcttacccagacatctggcttggaggccggctctctggggccccagggcattttcatgaccgccttgaatccctttcccacctgcacttaccgacctgttgtctcccctcactccagttctgcagttgacccactgtctttgccaatgtctcctaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcggtaaggagaggggctgagcccacctgtgggactcaggccgggcctgtccttcctctttagctgggattcaccagtgacctctccatgggtgggaactgcagccacttctctccatcacccttctcaccacggacacaagcacctatgagtgatgttggtgaagtcactcctccatgacccattttcccgtctgtaaaatgagggcattgggttagatgccctttacagttctccagaagcctccaaacccaggccaatctgtgaaggggcacatcacatctggtcccttagttggtatgacctggaacctgtcttatcaacgtggatagggatcatctgacctggaaggcatcatcatttacagaagagaaaatcaaggccctgacttcacaggcctcggttcaacactttgtccacaactttgcatttctctccaacaagtagccctagttggtggagatgaacaggaagggaggggaaatgggtctgcttagaggctggactttccatggccaagagcccagagtccaggaacctgggttggttcccctttaaggtgcctggggctgtggggtgccaggacaggggataaaagggggtggactagagcctgggaagcgggtgacttcaccccccagcccattgtgcttattgtcatggcaacccaatcctcgcttggaatgcggctggtgctttgagatgcaaaaggagctggacaaagagctaggggccccaggcctgagaaaagcaccccccttccctctccttcctgcctccctttccctccctcccttctctctcaggcctggtgagctcaaggggggctggggaaaagcaaggccccaggcatggtggcacagtgcccactggcaccctagcaccaatggatactcctatcctggaatcctggacagggtgaagctctatgagggaccccagcttgtggcggattctggggtgatcattgacacatccatgcgaggggggcgtcttggtgtattctgcttctcccaagaaaacataatttggtccaatctccagtatcgatgcaatggtgaggtggctgattgagatcaacctaatccttcatgccttgtgggagagccacatcctctgaccttacttatttccccttcttcagacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaagccagtgcaactgcttattttagggattttccgggatagggtggggaagtggaaggaatcggcgagtagaagagaaagcctgggagggtggaagttagggatctaggggaagtttggctgatttggggatgcgggtgggggaggtgctggatggagttaagtgaaggatagggtgcctgagggaggatgcccgaagtcctcccagacccacttactcacggtggcagcggcgacactccagtctatcaaagatccgccgggatggagagccaggagggcgggggctgccccgctaggggtagcggggaggccggggggccgggggggccggaggccgggacgagtgcaatattggcgggggaaaaaacaacactgcaccgcgtcccgtccctcccgcccgcccggggcccgggatcccgctccccaccgcctgaagccggcccgacccgggaacccggggcgcgctggggagttgggttcaccttggaggccagagagacttggcgcccggaaggcaaagggaatggcaagggggaggggggagggagaacgggagtttgcggagtcccagaaggccgctttccgacgcccgggcgttgcgcgcgcttgctctttaagtactcagactgcgcggcgcggagccgtcgccatggtgacgcgtgtcccagcaaccgaactgaatggctgttgcttggcaatgccgggagttgaggtttggggccgcccacctagctactcgtgttttctccggcctgcgagttggggggctccccgcctccccggcccgcgctcccgggcgcgctgacgtcagatgtccccaccccgcccagcgcctgccccagggtctcgccgcacacaaagctgcgcctcgggcgccgcgcggcgcgcgggcgagagcggtggtctctcgcctgctgatctgatgcgctccaatcccgtgcctcgccgaagtgtttttaaagtgttctttccaacctgtgtctttggggctgagaactgttttctgaatacaggcggaactgcttccgtcggcctagagcgcagcctgcgactgcgggacccaagttccacgtgctgccgcggcctgggatagcttcctcccctcgtgcactgctgccgcacacacctcttggctgtcgcgcattacgcacctcacgtgtgcttttgccccccgctacgtgcctacctgtccccaataccactctgctccccaaaggatagttctgtgtccgtaaatcccattctgtcaccccacctactctctgccccccccttttttgttttgagacggagtcttgctctgtcgcccaggctggagtgcaatggcgcgatctcggctcactgcaacctccgcctcccgggttcaagcgattctcctgcctcagcctcctgagtagctggggttacagcgcccgccaccacgctcggctaatttttgtagtttttagtagagacgaggtttcaccatcttggccaggctggtcttgaacccctgaccttgtgatccactcgcctcggccttccaaagtgttgggattacgggcgtgagccaccgtgccacgcccgatctgcctcttaagtacataacggcccacacagaacgtgtccaactcccccgcccacgttccaacgtcctctcccacatacctcggtgccccttccacatacctcaggaccccacccgcttagctccatttcctccagacgccaccaccacgcgtcccggagtgccccctcctaaagctcccagccgtccaccatgctgtgcgttcctccctccctggccacggcagtgacccttctctcccgggccctgcttccctctcgcgggctctcgctgcctcacttaggcagcgctgcccttactcctctccgcccggtccgagcggcccctcagcttgcgcggcccagccccgcaaggctcccggtgaccactagagggcgggaggagctcctggccagtggtggagagtggcaaggaaggaccctagggttcatcg

SEQ ID NO: 17204 - DNA, 9790 bp, Human
agctcctctgcctcctgtgtcctggccaatctgtggttttccctccagccagtaaagaatctatgcctgtgtcatctgctccagctacctctcccacatccatcggcccatcccaccaccagacctccgggagagcccaggcttcttggtccccacccccgccctgtccttgggcagccaggagcccagggggacgaagcccagggacctacagtacgcccaccttcaggctgctctcccagaccctagggtgcctacagatgctcaggaaccaccccagccaggcagcctgagcatccagttcctgagtcctctgccctggcctcatgcctgaccctgtcctgttccagctcccccactactctccggtgcccactcctctccaccaggccataatttcaccaactctaggcagtcttaagttttcctctggctcaatttctggactcttcccctctccccttgcccacatgttctctgctacttgggctgagggcaaatggggaagaagcagagagcggtctaagaggatggagacaggcttaccctgcagatcctgactggcagatgtgaaaaagcaaaggaggagaagagccagggccccccgaagttcctgcgtctccatgcctctcagccggctcactacccctggcaggcaggcagctgggaggggaaaaggctaggcggagagagcaggagccggggggcggagggacagaattggagggggggccagcaggcgggtgagggggggctgaaacaaagagctgccaatcaccctggaggcatcatcagctctgggaaccaggggcactgggaaagaatcctggaggcctccctgctttctacctctccctaatgatcctcccccaggtgcctccctctccgcagtcatcattgttgggggtctcggcacacagcgctaccgaatgccactgttttctggaagccacgattgtggaaggcaagaacccctggcaggggcagtgctagacagtgggcattattccacagctggcaggaaaggatgccaagggagtggccgcaactagcttgctatagtgcccagggatgcccacatggcatgaattttgctgttctggcggagcaagtgctctttattagggtggggggtcccctgacaagtgcctgtttctccattttccctcattcgtaggaaagcttgggagtctggaagcgtctgacgggaactgaagggagaatctaaagcagtggtcagtgaggtcagagtgaagaaaccaaaaaagaggaaagggacaccagggacaggcgcagaagaccaggggtacaggcgaggagccaaggaccagactgtggaacactgtgggtactagcggacgggccgtgacccggatgaagcagaggggcgcctgagttcccgtcacctaagcgacagcctgcgagcctctcttcccctcccccacccaagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctggtgaggggtggcgccggcgccctctgctgtgccctgatgactggggagggggccgaactagccaagcatccaaaccttgccagggctactcagcacgggcgcagtgggggaaactgaggcagtcaaagagcgtacgtggccgatatggcctcagtgccctatgctgtagttttctaggcttaatgcagcaatgaaaagacgcctggttgggagttcaggtgatgggttctagtccttgctcatccattcactggctgtgtgaccttgcggagatcctttctctttgggcattttttttctccattcggaggtttactaggctggactgtctcagggacctactctagcttggaattcctgccttctcctcagcccccttctcctcttcctcctcacttaacagcatttactgaggctattgtttgttagaccaaacgactcacagccaggctttgtataaagagcttagcaatcagacttcctttgcttcatttattcattgactccttgctttaaagaggatctattagatttcttccaaatattaaacattgccaggcaaagatgaataaaatttggttcctcccttcgagtttacagaaaggcagataggtaagcaaataaatataataaaatattcacatataagttaaagtaggaacagaccacagatactgccaaagagaagggcattatcagtgcttccaagaagagggatactggttaggaaaagcttctgaggatagatgttcaccaggtagatggcaagagaggagatagaggaaaggattttcctggctgtcctgtaatcacagacatgtccggaatctctctgagccctgtgttgtccatttgtaaaatagaaatggtagtgactcccccttttttttcgagactaagatactaagtatagggaatggcacataaggtattcaataaatgttatttctcttcttgataccactgtgggggacatggctctgcctctctgacttctgcttccttccctgcagacctatgccagatttactggtgctccactgaaggtacacaagatcagcaacccctggcagagcccttcaggtacccagtatcccttgggggtaaggaagggtgtgtacaaggggagaagcaagaaataggcaggaatgtgttgcaactatgtatgactaggcagctaagggtctggttggtatacttccctctcaatatcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggtgggactggagagagatttctaagggccacttcctgttttcagggactaggttgggctagatatggggctcaggatggacaaggcttagagccaggttggagaagatgaaagagcattactagaggagtggggaggcctaggctatgctctttactctgccattgactatgtgatctcgggcaggccatgtaacctctcagggctgtgcactcccttatttgtaaaactagagggctgggccagcatgttttccaagggttcttctagcattgacggtcaggttccaagagggaacagtgtcagaagtaggacactcttcctcatttctaacttcccaaaggttgaggacctggggaattaattgagaggcctggaaagagaggatccagataaaagccaaagttcctggcagagccgaggccactgccctgattgcttaggtgtgaacagagcttttccagtttccaaagtattctaaattatttcctaacacaggggcattcagagaaagagattcttacccccattccacaggggagaaactgaggcttagggagatttaaggatcatgctgaagaggttatctggggacaaagcttactcaggatgtggagggggatgctgaggaacagggactggagcctgggaaggtagggcaggctgagacctgggggtatgggtggaatgtgtatgtggtaatggtgtctgagcgatggaatgaagtgaaagaaatagccaagagctgggcactgagggaacaagctggggggccctgggcgtgggttccctggatccagggagtgtgaggatggctttctctggttcctgaggcatggaccgagtcctagcctgcatctgagctccgttgtgctagctttgtggtgtctgggtcggggaagttactgttagaaagttgccgtcagcgggcgttgttccagctttccatggaaattctgggagctgctcctagtttgcggcggagccttccttccttccctgcattgggcgctggaccttcacggccaggaggctccaaggcccaggcttttcgccaacagcaacaggctactggctgggcccaggcaagggggccttggcaggaaaagttccttgctgtacctccactgcactcagaggccagtgaggggggtaccatacaggactccttcctccctggtgaagtgcccttgcagctccctagtgtccacgccatggatatttcctccacagaagtacaatgctgattatgatctgtcagctcggcaaggggcagacaccctggccttcatgtctctcctggaggagaagttgctcccggtgctggtgagtgtgcccagacctcccagcatccatggccagccggggagggttcgggaacacacagacccacacacaggctcaggaaagcatgggggtcagaagcccaccttgaatcagacaggtgcactggctcagacctacctgtttcttcctgcctacccaatccaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggaggtagctctgagaccgggggctattgtatgagatgagccccaaggatgctggccaggaatgggagtgcttaggtggggaggtggcactgttcccacagctgcaagcctacctgtgtcgcccctacagctgtaccgagaggctcgggagtgtctgaccctgctctctcagcgcctgggctctcaaaagttcttctttggagatgcgtgagtctgactccaagagggtaatgggtggcttggaagaagatacaggttcagatggagcagctggagctggggctggggctggggctggctcaggctctggataggaggtccctgggatagaaactggccctagtgacagtgtgactgtgtgggggccagagccttctcagaggtacaaaagggtagggtgggagggcagccaggcacaggaggggcctgaagagctgtggggcactgaatgtgccctttatgcagccctgggatagagccctattcagggccaggctggcgccacctggggatctctccccataccaggtctagaactgtgtgtcctgtccttccctggtggccgcctgctgcccagagcccacctcccaaggctgactcttcctccagctccatctttaccccttctaccccagtggttctcctccatcccacccttctctctctgctccagccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggaggtaaggggcagatgggaggggcagccctggggagagtgggcagggatccaagaactagttctcctaacacaccttccttccttgaccctcagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctcaaacattttctcctttaagagctgccatttttcctggctggtgccataggaatcatctgggtgcctgggcacacccgctgctgctttaaggcttccgccctgatgctgacactgctgctccacgggcccagttctgcatctccaggaaagacaaacagtctccagttttgggcccagctttcctagtctcttcttttccttaccctcagccctgatcttgtgtttgtacggacagtgagctcaccctaggcctggacccaggcccagtttccaaagcaagcagcacacagcgcatgttcacataagcatgggggctggggggacactggggcttactgatctttttctaggggcctccagcccctggcaccacctagaggggaaagtgagtcacccaaaccattgcccctgggcttacgtcgctgtaagctcacactggccctgttgtgccctctttagtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctcaccggtttaggacgaccacaacaggagagccatcgggatgcatcagtgccactgcgtccgggtcgttcttctgactggcaaccagccccactctctgggagccctcaggaatgaacttgctgaatgtgggaacagatggtcagagtccctcggggtacctcccatgaaaccctcatctaagaagtcacccacccacggacccaccccataactcctgcagaggctctgccctggctctctaggcctggagccatgctgctgggcactgaccctgcttttctgcatcgcagtccagcctcaggcattggggttttctgttgctacctagtcacttcctgcctccatggtgcaaaaggggatgggtgtgcctcttccgaggttccaccctgaacaccttcctgctccctcgtggtgtagagtgatgtaagccatccgatgtaggagatgataggcctggtatggaatgggggtgcccgccctccactcacctgaagtggccaaggtggtagaacatgggctgtttgtaaaacgtgtgcttggtgatgtctacaatgatgggttccagtcggtccagccgaccacatggtacaggaggttctagggtaaggacaaaggcaaggagacaaaggcgcaacactgggggtccccagagagtgtaggtaagggtcacgtgtgggagaggcagctgtgggtaggtcagccctgtgaggggcacattccttagtagctaaggagttgggggtgtgaagatccaggcatctcaaggggagctgagaagtctgaggcagctgcaagtgcctcagtagttgcaaaaggggcaatgaggtgtgcagacctgtgaaggaaaggcaagacagggaatcatggttccccagagttgcccaaaagggcaggctacctggggaaagctggacaggaagggcttctatcagtctttggtgagactactaatgggtctgaggtctcctttgcaggaagggagactggggtggcttactgtgatgatgctgtggctgtactgcatccctcgatcccaggagcctagccgcacactctgctcccagaacttggaacccacacaggcctctgaggcaaagagcatggtgttggggaacaggtggtgtgtctcccttagggtggctttggctggagccagaaagtccaggtaccaatgtacagcaataccatgaacatacttagctgcttctgggtctgtcagtacctgcaaaggaagaacaagtcaccctggaccctgcccacaggcttctggaacttctagttcctcttgtaggaatcctgaattaggtggtgggaagaatgcaactacagaggttttgggagggattttttgtttttgtttttgagacagggtctccctctgtcacacaggctggagtacagtggcacaatcatagctcactgcagcctgaaattctaggctcaactaaacctcccgccttagcctccagaatacttgggactataggcgtgccaccaccacacccggctaacttttctatttttttttttgtagagttagggtttcaccatgtttcccaggctcatcttgaactccttaggttcaagtgatccacccaccttgggttcccaaagtgctggaattatagccatgagctaccacccccagcctagagaggtttcaagtcccaactgtgggatccatggcaccctggaggtcccggggaatggtgctctaggatccatagttgggtagaaaaatccctctaagtttgggagccaatcatttggatgctggatttgaaggtcactggagcaccatggaggtccaggccttaccacctttgcccagtggggcagcagcaagcgttggtcatccagcatgagtaggcggacattgtggtgagtaccgttggcaagggtaggacctaggtcacgggcaatgaagtctcgctgatgttcaggggtgaagcccaggcactggaaggggtatccactcaacagcccagcagaaggctcattttcagctgtcactgcccagaactgtaacttgtgctcagcataggcatccaggaacctggcaagagaaaggtcatgaatgatccagccaagaaagtgggccagaccgagagaacaggaagcctgatggagtgggcaagactgacagatccaagtttgaaaggcccagaaggtagaaaggtgagctgaggacaggcagatctggaagtggaaccaggttgagggttgggacacagatcagcatggccaaaggggaggccagtcctgatcccacatccttgctgatcccttacttcacaatgtatctggcccaggtctggtggtagatgtctctgggctgtcccttgagtggccccttcccattccccgctcccctggtcttgagccaagtgggtgatgtccaggggctggcaaggagtgaaacgggacgctgggccaactgcagggctcggtgaatcaggggtatctagagacaaag

SEQ ID NO: 17205 - DNA, 15108 bp, Human; identical to SEQ ID NO: 11786

SEQ ID NO: 17206 - DNA, 30773 bp, Human; identical to SEQ ID NO: 12332

SEQ ID NO: 17207 - DNA, 83708 bp, Human
gccaagtgagaacagagactattcagagcttgctatagcaataggggcagcgaccacacttgagtttggcagagactcaaaagcaatcgggaagaggggaggctttatagtggaggaaaaaagggatgcttctgatgtgttctgatttagggatgttggcaggggaagctggaagttgtctaacttgaagcaggaaacttaacaggattggtttgggaagaatatttggctttctctggctgatactggtgtctgaggacagagaggttaaaatagaaaagttggcagccttcttgagaaaattctgaccattttgagctgattgctgtagaggttatggtttggcttatgtgagttagagtgttattatcatatgcggtttagccattgtccatatgtataagtctctcactcattaataagggagccagcagaatcataaaacggatttctaccagttctgaaaaatgatatttatataatcgttggggaaaggaatgctgaaataaaactgctcagttgatacaaaaccggttaatttttctcagaaaaatgcaaccttaacctttggaattttatctatctatctatctatctatctatctatctatctatctatctatatacacactgaattccctgcccctttttcccctaacacctcatcagtttcctaccaattgatgtttgatttcatccttttgtaaatcttctgggccctaatcaattgttattcaaacaaagttacatttcctgtgggtgtcagatgatcaagtaggcttattacaaaattctctagaatgaaactaataaaagtcacaaaatattatcttttgacttttttccaagttttgaataaaattttaggtattttctcacttaattttcaccacagtccaatgcaagtaactcattgtagtagtacaatgattatccccatttccccgatgagaaaactgagccacagtttcagtaacttgaagagtaaccagtaattcaacgacagccacagaatggctgagcactggctgtactgccgctttaggttataagagtgagggaaggcctgccacgctgcaggtttcgggcaatgaaattattttttccactgctttatttccacccatttatctggcttctaaatccaaaatccttttctaagacagttcacaggggtggagggaagaggctgggctgtgctccacatcaggctgcctttgctagctgtgctgtcttgagcaagtcatttattaattagcttcctggccctctgttcttcgcttgtaaaagagctggaaccgcgttctcggtgtgcaggtgctggtgtgtggcgctggggtaaactcacaaaataaccgttgaggccgggcgcggtggctcacgcctgtaatcccagcactttgggaagacgaggcgggcaaatcgcttgaattcaggagttcgagaccagcctgggcaacattgtgagaccctattaatacaaacaacaacaacaataataaccaaaaatagtccgtcgtggtggcactcgcctgtgatcccagctactccggaggctgaggtgggagaatggcttgagcccaggagcggaggttgcagtgagccgagatcgcgccactgccctccagcctgggtgaccgagtgagatcacgtctctaataagaaaaagacaaaaaacacaaagtaaccattgaaagatagcgtcgtcggctgggttcaccacatcccagcgcacgccggagcaggctgtagcagttttaataaagtgtctataaagaaagctgccttccatcttcagtggcgccgcctcccacttcagtccccttctcggccccaccccagcccttccctcgttgtcatggaggccccaggacgccagagcgggatagttccgctcccgcggcaccagaggcggggcacgcaatgacgcatgcgctcgcttggctgccctggcgccgcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcaggtaggggctgcggccgccgggtgtggggcgcagagccccggcttgctgttccctgggacgcaggcgcgccgccgcctcccgggaggctgagcgtgacctccacctcacgggaagctgggaccgccgttctcgaagcgaaacacccagcacgcgaaccgttccccggagcattgtctttaggccagaggttcattgagcaaacttttgggttggaaagagggaaaattcgcggtctgccgcctgactgtgcctcttccaagcctccaagttcacgggcgcggtagccaagcgaaccgtgtgtggagtttgagcagccgcggggtccagccagctcaagactgtgatttaaaatgatgctcatacgcggactgctttctaggctaccttttggagatttggtttgtgatgatccctaaactttaacgatagtagttgatttctgcagtctaaacaacgctgcggcccccttttcgcccacctccccacttccgtcatttaagggcgaagcagcctgcttttcatagccgggtcctgaggtgccagggacactaacgaggctgggtaaaagtgaaagagaggggaagtagtaaggttgaaagaggtcgaatggtggcaagaatcgtgggcttggaggcagatttcagtttaatttttgggttttccgtgtctgcccacggaggaaccagccaactccttgagttgtggttttgtttaattgtaaaatggacatggtgatgtagcctgtttactccataggggggtccagagatctaaaacttagtacacatattgggtagtctttgaaaaaggaggaaaagttaggcggagcacgtgatggtgaaagacagacattgcgaagctttctgctctagatgcctttgaacgttcccgaacctcacaggtggcctttgttttaaaggcctttaccagcgttccaggtctggtgtaaggagcccttgagttaggagtcaggaggtttggttcctggccctggctcttccatctgtgcgaccttaaccagacagcttcacttcagatttcacgtattaaaataggaataacactaatacctgtttgctcctagagttgcgagggtcaaatactgtaagcatttagtttgttgtaaactgtacggctttatttactttttttttttttttttttttctgagacggagtctcgcactgtcgcccgggctggagtgcagtggcgcgatcttggcttactgcaagctccacgtccctggttcaagcgattctcctgcctcagcctcccaagtagttgggattacaggcacccgcaacgacaccctgcacattttttaaatttttaatggagacggagtttcaccatgttggccagactcgtctagaactcctgacctcgtgatccgccctcctcggcctcccaaagtgctgggattacaggcgtgagccgctgcgcccggcctatttaaatcttttagagtaatttttttaaagtccagattgaggtcctgcctttgcaacgtgaaataagacacaaatgtttcctgttctagaaatttactttttgctcccaccttctcacttgacaattctcctttcttcttcttggccccacgctttccctcctcccaaggctgtctcctactttcctcagcccggtaaatcattcccttctttcagatccaactcaaaatagtaatactgaaataacacgtttttatgactttactgtttaaaaaataacatacacattttctcattcttacaattgggctggatgtggacagctttcatagcgtcctcatttcacttatgaaattgaatgtagaggccttgtgggttgcctagccaggtggctttaggaattgaaactgaggccgggtgcggtgactcacgcctgtaatctaagcactttgggaggctgaggtgggcggatcacttgaggtcaggagttcaagatcagcttggccaacatggtgaatgaaccccgtctctactcaaaatacagacattggcggggcgtggtgctgcgcgcctgtagtcccagctactcgggaggctgagccaggagaatcgcttgagcccaggaggcggaggttgcattgagccgagattgcaccactgcactctgccagcctgggcggcagagcgagactctgtctcaaaaaaaaagaaaaaaaaattgaaactgagagaaggcaggtttttgattcaccgtccagtgattgttcacgccttaattgaaattcagtctgattatttcttatcaatgcttatatttaaaatttttagctcaatgcttccattttctcaaatctaagcagcatgtagacaaggatttatcttccgtaacctttcaaagcttagagcacagtgcctcacaaacaagatatttaataaaggcttgtgaaaccagtaataatgggaccagagcaatttaaagatgatgttccatgtgttgttcatttaacaaatatttattgagctatctgtgcttaaaagctttcaaagtatgagtctttttcctcccagctgacactagtcttaacagtgtcaaattcatttatatagtcagcttgaggtcttcatagaccctctgtagggttctagcagagttcagaagagaggtgtgtttagaattcttgttggttgacctgtagcttccctggttgtagtgaaattgctttgagttgtaattttagaactagacaaacaacaaccacaacatagaagttgcctcaaaccacctccctccaaattggaaattttctgtagactttttttttttttttgagacagagttttgctgtatcccccaggctggagggcagtggcgggatctcagcttactgcaacctctgctggactcaaacagttctcgtgtctcagcgttctgagtagcccggactacacgtatgtgtcactatgactggctaatttcgtagagatagggtttcactatgttgcccaggctggtctctcagcctcccaaagtgctgggattacagacatgagccactgtgcccggctctctgtagacatttctaacaaatagtataataattcagcctcttcatcacttaataattgagagttcaccagttgtaaaaatatgccattttatgtataagcagttctgatggttctctttttttgcagtgagcctaaatccaccttcttctaatttctgccctgtagtcctcatgtttctacagcagtgttgtccaatagaaatataatgggagtgggaagtgtgagccacacgtgtaattaaaaatattctaggctgggtgcagtggctcatgtttgtaatcctagtgctttgggagactgaggtaggaggattgcttgaggccaggagttcaagaccagcctgggcaacatagcaagaccttgtctctaaaaagtttttaaaaaaattaactgtgtgtggtggcgtgtacctgtagtactagctagtcaggaggctgaggtgggaggattgcttgagcccaggagttcaaggctacattgagctatgatcacaccactgtactccagcctgggcaacacagtgagacactgtctcttaatttttttttaatagccatattttaaaagaaaaattggtgaaattaattttaacattttatttaacccagtatattcaaaatagtatcacttcaacatgtaattaatgtaaaatatctcgttagtaattaaatagtttttttctttatactaaatctttgaaatcttgtgggtttttacacttgaaagtccatctcaattttaactagccacatttcacatgtttaataggcacatgtggctagtggctaatatattggacagcacagttctggaactttagggaataattctgtttcttttctttctttctttttttttttttttttgaacaagggtcttggtctgtcacccaggctagagtgcagtggcattatcacagctcactgcagccttgaccttccaggctgaagtgatcctcccacttccgcctcccgagtagctgggactgtaagcacacatcaccatgcctgcctgattttttgtatttttgtagacaggaggtattaccatgttgtccaggctggtctccaactcctgggctcaggcagtctgcccacctcggcttcccaaagtgcttcagccactatgcctggcctctttttttcctataatggctagtacagtgcttggcgtgtaataagcgctaatgaaatatttcttgagtacttgaataagtgaataaatgcaagtgctagagaactaataataaaaggtaattttgtttgggaagtaacttgttgagatctgtggatttggagtgcaggtttgagtgacttgaatttgtattaaagacacttattttttctttgtagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctggttagtaaaattgtttaggactgtttggtttttattcagattattcaggaggaaaccgtttagttatggctagttcatttttcagttcagcactcatgttgataggcactttgttgaatataaaggatgggacaagagaatttaagctcttaggatgttaatagtcttgtgctgtagttaaaatttaggttattacctctttaaaaaaactttatttaggtttaatttacataccatacagttcattcattttaagtttacagttcaaagatgtttggtaaatttacagaattttgcagctgttattacagtccaattttagaacatttccatcacccccagcagatctgatgtgcccatttgcagtgacttttcccatccctgccccggaaaaccaataatctgctttctggctctgtatatttgccttttctggatatttcctataaatgaaattgtacagtaagtggtcttttgtgtgttgtttttttcacttggcatatttttgagttccatccatgtagtatgcatcagtacttcattccatttttattggtaaagcgtattccatagtatggatatatgtaccacagtttgtttatccattcaccaataaacggttatttggattattttcactttttggctgttttgaatagtgttggtatgaatattcatgtacaagtctttgtgtagacatatctttttatctcttttggatagagacctagaagtagatttctgggtcatatgtcaaatttatatttaacttgttaagaaactgctaaaatagctgtaccattttatatttcctccagcaatgtatcagggttctagttttttctcatccttgctaacgcttgaaattctgtttttttttttttaatcatagctatttctatagttgtgaagttctatcattgtggctttaatacgcatttccttaatgagtaatgatgttgaacattgtttcatgtgcttattgaccatgtgtattccttggtgaaatgtctattcaatttttttttgcccataaaaaaaactgaggtatatttcctctctctattgatttaataattcttcatatattctggctaccattctttgatctggtatacatttgcaaatattttctccaagcaagtgcttgtcattttatcttcttaatagtgtctttgtatgtacaaaagtttttaattttgatgaagtccaccttaccagtttttttcttttatcatttgtattcttggtgtcatatctaagaaatctttgcctgacacaggtcatgaaaatttttttctgtgttttcctctaagagttttgtagttttagctcctgcatttaggtttgtagtatatttgagttgatttttgtgtatggattagcataagagtcaaaatttatctttttgcgtgttcttatgaagttgtcccagcatcattttttgaaatgatgatctttcccctgttgaattatattgcgcccttgttgaatattagtagaccataaatcaaagagtttatttctggagtcttagtttggttccattgacttctgtgtttatctttatgccagtatcatttctcttgagtgctgtagcattgtaattaaggtttgagactgagaaatgtaagtccatcaacttagttcttttttatttcaagaattgttttagtttttctgtataaattttagggtcaatctatcaacatttgcaaaaaagcctgctgggatttccatagggattgaattgaatctataaatcaatttggggaagaactgccatcttaacaatattagatcttccagtcaatgaatagatggctttttacaaattttttgtagagacaggatcttgctctgttgcccaggctggtctcaaactcctggcctcaagcaatcttcctacctcagcctcccagagtgttgggattataggtgtgagtcattacacccagcggttattttattctgattcaatctcacttatgaatgaaattgttttctttgatttttttttttaaattgttcattgctagtatatagaaacaagagttttttttaatacattgatcttgtattctgtaacctgactgaacttgttttttatttctcgtagttttttgtgtggtttccctaggattttctatgtcaagattatgtcatctgtgaataagaacagttttctttctttctttccggtgtgaactttttaatttttatttatcttgcctgtctggactggctgtacattgaatagtaaaagtagctacctttgccttgttcctgatcttaggggcaaagcattcggtttttcactcttacgcatgatattactgcaggtttttgtacatgccctttccagttgaagaagttcctttctatttctagtttgttgagaggtggttttttttttttttgagacggagtcttgctctgttgcccaggctggagtgcagtggcgcaatctcagctcagtgcaagctccacctcccgggttcatgccgttctcctgcctcagcctccctagtagctgggactacaggcacccatcgccatggctggctaatttttttgtctttttagtagagatggggttacactgttagccaggatggtctcgatctcctgaccttgtgatccacccgccttggcctcccaaagtgctgggattacaggcgtgagccaccgcacccagccttttgtttgttttctttcgagactgcgtcttactctgttgcccaggctggagtacgggcatgatcatggctcactgctggcgtgatcatggctcactgcagcctcgaaactccccagctcaagcaagcctcagtctcccgggtagctgagactacaagcacatgcccaccacatttggctaattaaaacttttttttttttttttttggtagagatggggttttactttgttgcccaggtgggtctcaaactccccgcttcaagggatccatcccccttagcctcccaaagtgctgggattataggcataagctactgcatctgactgagagtttttagtcataaatgggtactggatgttgtctgatgctttttatgtatctaatgagatgagcatgttctcactctttagtctattaatatgatatattaacattaattgatatttagatgttcaaacaaccttgcatttattcctgaaataaatcctacttggttatggtgtataatcatttttatttgttgtggtactcaatttgctggtatttcggtcaggatttttgcatctctattcctgagggacttgatgtgtatgtagtttcgtttttctctggtgcctctcagggtaattctggcctccttaaacgatttgtgaagtgctcccttttcacctattttctgaaagagtttgtgaaactttgttattttttaaaatgtttgatagaattcactggtgaagccatttgggcttcagctttcctttgtggaaagctctttgtaagaattttttcttttcagtttactcagattttctatttctttttgagttacttttggtactttgtggctttttagaagtttattcattcatcatttacattgtctgaggtttttcaaagtactcccttataatccttttgatatctataaagtcagtagtgatatcccctctcattttttttgagacggagtcttgctctgtctctcaggccccccagagtagccgggattacaggtgtgtgccaccacgctcagctaatttttgtatttttagtagagacagggttttgccatgttggccaggctagtcttgagctcctgacctcaggtgatctgcctgcctcagcttcccaaagtgctgggattacaggcctgagccacctcacccagtgtcctctttcatttctgattttaggaatttgtcttttctcccttttttcttgatgagtctagctaaaggttcatcaattttgttgatttttttcaaagaaccaacctttggtttcattggcttttctgttttggtttttgtttgtttgtttgtttgtttttatttccacatcagtatttattatttccttccttctgcttgctttgggtttagtttactcttacattattatcttttaaacaatgtcagtggaacttaattcacagctgaaattatttagctacttcaaattgtagcaataataatttttattgatgttaattttttacacatcctacaagctgttttataactgatttggaagcaaagcttttttaaaaatcaaagtaggcctgtcattcttataatatatattaggtttatatgtcgttccaatgaaatgtacatagaattaactcatcataaacaaaaatgtaaaaactgttttaaacattaacatagccactctcaggcttaagccacttgagcctttgacctgctcaagaatgtctttgcattttgtagtttaggctacaggtattgggtagcgaatttcatcttccccacaaacaggtcccattcgacagcaggaagagcccttgtagggttttacttctctttggttggccagggttttccctaacagtcagggtaggataaactgtgttgtggtaacaatcccaaaaatctcagtttcttaaaacaacagaagcttgtttctccttcatactacatgtttatcatggattggtagaagtcttagctagttatagtcactcaaggacccaggctggcagagcagctggaagctcaaatgtttgtgagttctgtgctagcaggaaaactaactctggaagagcttgcactagcagttaagtgctgtggcctgaaggtgacacatgtcacatcctctcacagctcattggccagagttagtcacaagtcactcattggccaaagttatgttcccagccatagggggctctgaagtgaatgctttccttaatgaagagagctggaaatattgggtgtaacaactaaaggctaccatgccactctagttcaggccacggtcattggattgctaggttagctgttgaccaggtctcctggtttagctgctttagtgttcattcttcatacagctgtgatttttctcattagatcatgttgctttcagctcaagctgattgttactgtttttcagataaagtccatgttttactgcagcctgcgtgcctgcctcatctggcctctaattatctcttaggtgtggtatcatactgttctccttgtactctgtcctagtgatactgacttgtagctcctccaacatgctttattctctcttgcctcttggcttttattcgtattatttcttcttcctggaatattctttcttacctcctaccctcttttggttctgtcctgttcttttaagtttcagcttaaaagtcatattattctcattcttcagtgtgaattcactgtataacctttgagttcccatatcactactctttttgacagagcttccaatgtgctccattgtagtgacgtggttccttgtttgccactctgccctcagtatctggcctaattgctgacatgtagtaagcactcagtaaatatttgttggatgactaaataattacaggatagggtgggggagaaagttggtaatgtacactattaaaaaatctgattattaaaggacttgtatacttaccatctattgccaagaatccaacgtttgtgaaaatgtatatggttttaacagtgctcagttcctggtttccaaagtattttatatatccaagcttcacaaatccttttaaagttggttatattatttgtgtttgtttctaatgtgagaataaatataaaaaatactttgtggaagagttatttcagaccggcagttaagattcttttgtttgtttgagacggagtttcactcttgttgttcaggctggagtgcgatggcatgatctcagctcactgcaacctctgcctcccaggttcaagtgattctgcctcagcctcccaagtagctgggattacaggggccccattcccatgtctggctaatttttttgtatttttagtagagatggggtttcaccatgtcaaccaggctggtctcgaactcctgacctcaggtgatccacctgcctcggccttgcaaactgctaggattgcaggcgtgagccaccgcgcccagccgatattctttaaattgaaaagaacagatttcctctcttcaccacacagttatttattgcacacaaaaaattccatcagtaatagagatttaaaaaaagtcttttataatacctagtgcttttttttgtccccacagccctcttaatataccagctattctaattctccatatttgttttcaaaccttactcatgtgtatatttataatatcaataattgtattaaaacttttatatggtgaatttattttttacttttaaatacttgtctatcttgccagacttttcggttgctttttttttttttttttttttttttttgagacggagtcttgctctgtcacccaggctagagtgcattggcatcatctcggctcactgcaacctctgcctcctgggttcaagcagttctcctgcctcagcctcccgagtagctgggattataggtgcccaccaccatgcccggctaacttttgtatttttagtatagacggggtttcaccatcttggccaggctcgtcttgagctcctgaccttgtgatccatccgccttggcctcccaaagtgctgggatgacaggcatgagccactgtgcctggccttcagttgctttttaataattcattaagttgatgtgccacatttagttaaagtcttagttattttcaattttttgttattttgagtaatgccattgtaaaaaatctttgtaccttgagcttgtacatttgaactaagtgcttaggatacatttccaggagtggcatttctgacttaggggtagtgtggtggttaagagcatgcttttgtttgctcatgggtgatagcaaaatagtgttagggtcacaaaatatctatatagcccttggaattccaagaaataaaactgccatatttcaacaggtgttgagtggccctatcttttgaccttttttggggggatggggggaggggcagtctttctgccttggttatcttagcctttgagagtataaataagagaggtaaaatgaaagaacaaactcaggaaatgaaggggtgtagtagtaagttttagtttgaaaatagactaggcctttcctatatcatgcatttctaactaaacagtaagtcagttttgtgagaattttgtgcaaatatacttgtggcatttttgattattttgagactttttcatactaatcctacataaaactcaagtcattatatatttatataagttgttttcagtaaattagaaaatactactttttaataaataggaactttatatatataagtggaagtattttacttcagacttagaaacatgttttaaatagcctttttgttaccaacacactattttttgtctacatgaattggttagttataaaatcattttagcatcattagccttgcttgtcttttccagcttatcttttgctgcttaatattgaactctaggaatcttttatccagtttttgaagtgtcagtattaaacagattagtaaattcacattcatgaagttttactgtatatttaatgaaatggctatacacacaaacagtgcatgtttaacttttttttccccttctactagaaatgttttaaccattcagtcagaatttgttttgtagcaacagttggcctcagaatatattttttttctcagaagaggttgagctgctttcagagattttgttcatcttctatagagtgttagaccacttcagtttcacgttttctgatgttgtccatcatacttctaagagggttgggttcacttttcaagtctttcacggttttgttttttacacagcagcagcagtcaagcacttcataaaggaaagccagcaccactaaagataccactgtaaatataaataaaagcaggatgacaaagcaggcagtgttccagttgtcatggaaagggtaaattttttgaacttgaaaaccaaggtactgataaacagaggtagtggtttcattccagtggctggaagccattcttagagattccacttgctcttttgaatctataaaaaaggtagaaaatgaatttatgtagcaaactacagatctgttaattcaaatctcagtactaagatttcttagtaaatttgtataggcaacatgaatcttccttaattaatgcctaaatggtagttttgaatttttttgtatatctgggccaacgtccttagtcaaccataccctgttttttaacatatattatttgctagatgaatatgtatatttaagattcaggccaggcatggtggctcacgcctgtaatcccaacactttgggagagtgatgtgggcagatcacttgagcccaggagttcaagaccagcctggtcaacatggcgaaacccgtctctacaaaacatacaaaaattagccaggcatggtggtgtgtgcctatagtcccagctgcttgggaggctaagccgggaagattgcttgagccagggaggcgcaggttgtggtgagctaagatcgtgccactgcattctagcctggacaatgggaatgaaaccgtttctcaaaaaaaaaaaaaaaattcatataccgaaattaactgctaatggaaggggaaaaggcagctgaattggtttaaaacttgattaaagcagtggtcagtgagctgttatctacaaaaaaccttggcgttttaaggttatgttcttcaaactgcccctggaaaagcttttatcattagccttgtggattcttcttacctttttggttcagtgtatttctgtctcctgtttccccttctttaaacttcgatgacaggtgatctgaatcagaaatagtggctgagtgaaaaatagtagagaaagaaaaccaaataatgccaattttcagaatgaggataataaaattttaggttagagtgatctgtgaagagaccctaatcttggggttataaatgatagtcttaagtgtttcgtatacctgagtgacccatagacataaatatttaaaaaaacagacaaattcagccctcccaaaggtatcagttattattccatttcacaaaagaagctggtgagttcaagtttcagtattcttgaattaagtttagctcttgttgacctggtacttgttagctcttaaatggggactgttagaatcaaagatttgtcagtatggaactatagtaatgaggaactaaattagtttttactgtcttgatctctaacaaatattttaacatttagttttaaaaattataagataacctgtgcactaagaacattttggaaataagagaaaaaatgtagttctacttcattaatttatcggttgtcattctgtatgcttttcctttactacatagttgtaaacaggattttatttttataacaaatgtttattgattacctaatgtgtaccaaatatttttgtaaattctggagataccttttgtgtgagagtgtttcatttaacgaaaactacaaagtagtatgaaccccatgtacttttttttttttctttcttactagccttgcagatgcagggcctcaaaaattgggttaagacttagaattattactctctgaagaaatctttagtaaaaggtgagagatttgtatgatctgaagagaaaccagagtatcccatgtactgtcttttttttttttttttttaggcagagtcttgctctgttgcccaggctggagtgcaatgaatgatgcaatctcagctcactgcaacctccgcctcctgggttcaagtgattctcctgcctcagcctcctgagtagctgggattacaggcatgtgccaccacacctggctaatttttgtatttttagtagaaacgggttttaccatgttggtcaggctggtctcaaactcctgaccttgtgatccaccttccttggcctcctgaagtgctgggattacaggcgtgagccactgcgcctggcctcccatgtacttataatgcaacttcattcatcaactcttggcccatctctacctgtacctgtttgcttccaccccattggttgttttaaagcaaattcaaggcatcgttcacctagaaatatttcaatatatatctcccaatggtgaggactctatttttaaacataaccacaatattattttcacaccccaaactcaaagccataacaatataattccttaaatttttttgttttcttaataaaatctttggggttgataaaattatgttttctaaggtttttgttttcttaggtttgcttggtaagtcacttcacctctctggatggacttgcctccttttttcctgcattttgaaggaaaatgcacattgcactccagcgtgggcaacaagagtgaaactcccatttccaaaaaagagatatctcatctacttttgaggtataagtgaactgcttaaaatattttcaggtccccttacctcaaaaataaatagaaagaggcagtcaggaaggcagacagatacataactaaattcagttatttgaggtttaacttgtatccattaatgagctattcttctggttaaattaatatagtttattcacacaattgaatcataggtaactgagttttaggaaagatatttaggatatgttcttaagtgaaaagaacaaggtgtaggatagtgtatataggaagagggaaaatatatactcttatttgcttgtgtatctgcagagaaatcttagaaagacctacaagaaattaatcacaatgatggtgtggatggggatccatcgggaggagagtgaggcacagggatatgtttgaggcttcttaacctgtaccttgtgttcttttgttttttcaacaatttaaatatattatttatttgaaaccaaagtaaatcatctattttaaaaagagaaataaaaagcactattccttattcttggctctcttaaaagtctattgttagccaacaatatggattagtatggagtaaccattcttttattcctgcttatggagtagtatggagtaaccattcttttattcctttccttttttttttttttttggcttttctcctttaattcaaaaagataaaatccctttgtgctttcaaaatgtaacacatctagttaaatcagctgtcaatattgacttatttaatgcactgtaatacaaaacgttagcctaataaaacttctaaagtgctgctgagtattcctttgctttcttaataaacttactttcacttaaaagagcctgttgtttatgtatctatttaatacatttattgagtattctggattccaaaaaattcaaattgggattaggaaacactgtcatttttgttagactgtatactttattcacacataaaaatgcttttaataattatgcttggctgggtgctgtggcctatgccttcacccccacactttgggaggctgaggcaggaggatcacttgagcacaggagtttgtttttggtttgagacagagtctcgttctgtcacccaggctggatggcagtggcacaatcttgactcactgcaacctctgcatcctggttcaagtgattctcctgcctcagcctcccgaatagttgggattacaggtatgtacagtcacacccagctaatttttgtctttttagtagagatggggtttcaccatgttggccagggtggtcttgaacccctgacgtcaggtaatccacccaccttggcttcccaaaagtgctgggattacgggcatgagccaccgcgcctggccaagcccaggagtttgagaccagcctgggcaatgtggggaggccctgtctctacaaaaataaaaattagctgggcatgatagcctgcgcctgtagtctcggctacttgggaggctcaggtggggggatagcttgagcctaggaggttgaggttgcagtgagctgtgatttctccattgcactcccgcctgggtgatagagtgagaccctgtctcaaaaaaaccaaaccaaaacaaattacgcttttaataatgactataggtaacaccataggccacctccaaaggcacttacatgctttgctggaagtgtctaagcagtttaagaaagtgtataggtcaggtttatgttgtaaatgatgatgatttgtcttgtgagtgtattgataaccgagcggctcaaaacattcattgtttgttagcttctgggcatatctgaaaaaagtaaactctctaatatggagtcattttccaccttaaatttagtgtggcatgttctttcaaagtgtggtagagctctagtaacttttgatgtttaatttagggtaaaggctaaatcttactttcatggattaggcataattaagcatgcagaaagaaatataccattaggcctgtaatcctagcactctgggaggctgaggcaggcagatcacctgaggtcataagttcaagactggcctgaccaacatggcgaaactccgtctctgctaaaaacacaaaaattagccagttgtggtggcgggtgtgtgtaatcccagtttctcaggaagccaaggcaggagaatctcatgaacctgggcggcagaggttgcagtgagccaagattgcgccactgcactctagcctgggcgatagagtgagactccgtccccccgccaaaaaatagaaatacatcattaggattttctcctatcctgcgacttagttttgaaattaaaatgtaagtttatattaagcaaatgctgtaaacattctttatgaaaagcaagagaaaatggtgtatataaaaaaaggtaaaacaatctttttctggacttccctacccatgccttaaaatttgattacaggaatggggagctttaaagtaaatcacataatttttttttagcatatgtgttttagttttgttttatgttaattttggtatgtttactcccatttgatatgtttactcccattttgatatgtttactcccatttgatatgtttactcccaaaggccccagtgcagtgttaatggggatgggacttggaactgttctggaacctttgggttgccagatgagaataaagttatgcttttgctgtatttatggtaaaagcctttgaattgaattctcaggtgcttttaagcatatcactttgaaatgtgatcagttaatcctaatagcctgtaaatatagagcaactcacttaatttaagctctggaacttaggccatgtctccagtcagtttggtgaaacagcaatgagcctccatctgtgctaacaatagacatattccaagcaaaatgcaggctgatgatagagtgttaaaacaatgtgggtggtaggggtttctgttgacagtttacctgaaatttgatttgtaagttaactgttttatttgacaaagttatttttattttatctgagacttttgtttggtgcttctgtactttctgtagcaagcacaaatggtttctagataattaaccccactgtgctgaacctggacagatctagtatcttattacagcaacctttgggttttgcaggggatactttgctcaggctagctgaatgccgactaagaaaaggaatagaaattatgaagaaaaaaaaaacaaaaaccctttaaagattaaataaacttaccagcaaggtaaaaggacagaagctggctctttaggtccgatatagtatatagatggagttctaacatctagtaaataactaaattttcatgcttgaatagtataaaattagaaatttggtcagcagttaatattaatttttaatagacatgaatgattgctctgagccacgaagataatcttgttacctagaaaggtacttactctcctttcttaaccagttcttcttaggacatatttttattttaaaatgcagtttatcaaaaggacttactttgtatttattttgaggatcagtttaagaatgacttcaacattatatttaaatggtgtgataaattgatatcaaaaatgaaaggctatttaagaaggtttttgtttaatagcatgactttatattacgagagagaaatttcacagtgaagaaatactttaattaaatgttaaggaagtctgaagctgtataaattatctgttcagtgtagtataatgcagcccatatagtgataccttttatgatcttttatataaaaattaaaattgtgataatttcttggcattctctgcatctacattcaaagcaaaataaaaataattttgaactattttctcatattctaaaaaatataacaaactttcttataagtaactattttttagcagccaatatcatttgcacatagaatcagaaagctttagtctggaattcgcttttgatctgggtttttctttaagaaaaatcctttgttaagacagaccaaactgcagaaatgaaatcgctcagagaaaatgaaattagcaagtaaccagttaaaataaaaagctatggtttactctgaggtctggatatagatcaggttcatgtaaaatgtaatgaattttccattaaggcacagatggtaagggtgcttatcaaatagcacaaggcagtcttcatattttcataataaaatcctaccaagcggtgaaacgaatacattgctttttcttgatatttagtaggagcaaagctttctggttgatttttcagggtaaaatattttcctattgcatcataaggacatgtaccactaaataaaaaagatcatataaacctacctcttgtctgagaggatgctgctgaagcgatggtatcgtctgtttgtaatgcagtctagtgcacagccaagatggagctgtgcttctattggttgaaccacaatggagctgacagtttcctctatgttcatttgcattaagtcttgccacccttaagagtaaatcattcataaacttgaatagagctgtctggggtatcaactgtcatcccttctcctttatttttttgttcttaagctaaattcctatataggaatttgtgagttactaacaaattgatgattctttagtgtttcattataaaatttcagatccttcagtgaatacttcagtgctagggctggaagataatgtcgggaaaggtagtaacctaggaaacaaacagtccaggtttgccagcctgatatttccttcaggaagtgtgcataaaatcttataaatttttcttgttcttccttttctttcattacttgttccgtatataatttttgcactctggaagtgattatttccatgtggtggtttgatttaggaggaattatgaaggaaaataattggcttttagctctgcaagttggaagagggctcatttaggtaaatacactacctgcattcaaaaaatagtctctaaaatgtaaatggcaaagtgatctccaggttggctctttagagacagagtatttttagttactgtgtattatttagagttatggtctaagcacaacagaatgaaggtttttaattatgggagtggctgttaacaacagcagcagaccaggtacatgctatgtagacttcttttttaaaattatagatgaaggctgggagcggtggcccatgcctgtaatcccagcactttgagaggctgagttgggtggatcacagggtcaggagttcaagaccagcctggccaagatggtgaaaccccatctctactaaagtacaaaaattagccaggcacggtggcagtctcctgtaatcccagctattcaggaggttgaggcaggagaattgcttgaacccgaatggcagaggttgcagtgagttgagatcacaccactgctctccagcctgggcgacagagtgagactccatctcaaataaaataaaataaaattataaaattatagatgaattggtacattagtttctggggccataaaggaatgcatagaaatatctgtattatagtcattcattcaacaaatatttattgagtgtttactaagcttgacattgagttagtagtagatgccagagacataagcatcatgtctcataagcacaactgtttgtgattcataattggccatttgtgtggtgtttgtccttaacacattgtcatctcttttttcatagtcttcccagttgtttatacagttgcgtggggtaagcttaatattattttacttaaacaagcattaaatgtgcagtcacagatttctgtactttgacaaaatggccagtttcagatggaataatctgtgtaaaggctgtttattacagggtttacactggatttgaatctatactctgctgcttactaccctcaattttattatatttaaaaggggacagtaatacttcttaagttggattttttgggagggattacgtatgaatatttaccatagtgtttagcagataataaatattggttacttttattacagatgtgctgaacaccttgggagaatgaactacgtaggtaatatttcataattgaaacagtgaatggaaaagcacctataaggcattctttttttttttttttttaattttgagacggagtctcactctgttgccaggctggagtgcagtggcactatctcggctcactgcaacctccaactctctcgttcaagtgattctcccaagtagctgagactacaggcacgtgccattatgcccagctaatttttgtatttttggtagagacggggtttcaccatgttggccaggatggtctcgatttcctgacctcatgatctgcccacctgggcttcccaactgtaaggcattcttaatgttattgttacttttggaaacatggtagacttcagtgtgccaattaattaagattgtaacaaagttagttttaaaggaaaattgcatatgaagtttcattttagtctcaaaaaaggatactcaataaagacttcactaatctcaaaggagtatggtattgccatctagaagctgttcttttggatctctgacagttgttacatttgacttgtggttgttctaatgcaatcttttgtttaaattattattaccaacctggtgccagagattggttctcctctccccttttacttaacctctctctttgtggatcagccacatgggaactttataatatctgatctcatgccttgctaatagaatgtgtacttctaaaatgtttttctagtatttatgatggattttttactgttcctggttatgactaatggaatgcatttgtgatgcagtggtgacattagggtttctgcttgtaagaatgcaacaaaatgatagatattttgaaacaaatgatcttttgtacagggttttccacaccagatagagaaggagaggggggtgtttctcaaagtgggtgggtagtgctgtgatgctttttaaagtaagcatccatgttcatgcagtggcagtgcctgtggctttttattcctaatttatctgtaaagtttactttaaaataattgtgatatcttttttctattagtttccattaattcctatttttttggtcttaaattggtaagcagaaattgatgtaaaaagtggtatattgaacttttcttccctcagaagtaatccactccttgtgttagctttatggatgggattgaggtttgtattgtttccttgtttaataaagtgtacttctgattatggagcgagtctaatcagagttaagataagaatgagataaaggagaaaggggcctggtgcagtagctcacacctgtaaccccagcactttgggaggctgagatgggtgaatctcttgagtccaggagtttgagaccagcctgggcaacatggcgaaaccccatctctacaaaaaataaaaaaattagccaggcatggtggtgtgcacctgtagtcccagcctctcagaaggctgaggtgggagaatcacctgagcctgggaagttgagggtgtagtgagctgtgattgtgccattgaacttcagcctgggcaatgggaatgcgaccctgtctcaaaaaatataataaaaaataatgtgataaagatatttataaaagaattgtggtttggtgttttaagttatttatactttgtttctacccttagtgagaaaattggtactttaatgtatatactcaaagattgtgtatttttcaccagaatattacagggtagaatatactagatgaaaaactcaagaaatatgttaccagcattaaaattattttagctgctcaagagtcataatcacacataatatgacgatgttattttgaacttcatttgcagatcatagcaatggatcatttaacttgaaagctttgtcaggaagctctggatataagtttggtgttcttgctaagattgtgaattacatgaaggtaagtacttttctcagatagcaaaagtcctatttaactttttggcaaaagaaggagattagggttttcagaagttaaatttctgtatacatcaaaatttatcaaaattgtgcattttcagtatgtgcagtttattgtatgccaattatacctcaagccttttacattgtattaatttggcattgtggcgagttaccaaagcatatttaatctgcattaactcaagggtacagtttaagctcaccatttcacttaataagagtgtgcctaggcagtaggtatatcacctcttaatgaatacaggctggcaaaaccaatgggaggatgtgattgatttttcaggttattacttccattgatgtgagaagtaaaaagtacatagttcaggcagatgatggtgatggcttctctgcatcttggaggagaaaattagacatttactgagagtcttagaaaaacattgactcacaaaagaattagaatttaatgtttgatggaaggtttagtattttttgaatacaaagttttgatcatataagattttggctttactttgaatctttttttttcccttttctttttttttgagacagtcttgctccgttacccaggctggagtgcagtggcacgatcgtagctcactgcagccttgaactcctgtggtcaagtgatcctcctgcctcagcctcccaagtagctgggactacaggcatgcaccaccatgcctggctaattttcttatttttagaagagacgaagtctcactgtgttgtccaggctggtctcgaactcctaagctcatgtgattttcccacctcggtctcccaaagtgtttggctttcaggcatgagccactatgcctgaccaagactttgaatcttaactaaatttattaaagcgggatttcatttttagctaagatggctaagtaatttcaaatttgctcccttcttttgccaaactcttattcacgattagttactagttgcatctcttgaaaaagacagtactatatttgttattttaatttcatccatctattggttaaaatataaatcagatttttaactgtgctaaggcttttcttttgtaatttaatagacttagtgtctagctgagtctaaattctgtggtttgtatttgggttatagtataaatatgttagtatataactccccattattaaataatgtattttgacacgtaagtattcactgttgattcatttcatccatttattcccccacatggtaagcagttatgaaaatctattggctgtttagggcactaatggtgggaatacccagaaaaaaatgccaccctcagggctgtcactctgttgagggacactgacatttaagtgtcatgtttttgctactctgttaatatggtcttcacttccctatgtggcttacttataactttgtctgtcttagaacagtgaacttcagaatttttacttgtgctccctacagtttgaaaaactgtgtacccctttgtacatatttaagttgataactacactctgttagcaaagtttaaatagtggcactattcaagcaaaaatttaaatgatgaccagaaatacagaatttctggcatattgtagtatttcaataaaatatatcacttttaaatttatctaatggaatctaaatgtcattatttaaaagtataaaaacaaactcccttaatgattgggaattttaattattttttctttgaatatttgtgtcccatctgttactccctttgaattttatccaaatgttatgtatttttatctttcaaatcatttattgatcatctatcaaacttttctgccacaataatatgtaaataaattgaaatataaatcaaaatttaaaatgtttttcctatgaccgtaaagctctaagtgttaaaaataacttacggtttgagttatttttacaattattggtgcacagttgattagaataacatacatagattaaaattttgattaaattcactttgtatcagaaatttattcttaaatgaatgcagctgtctcctctcttccttcattagttcttgtgtttggcaaatctgttcgtgttttgagattttgtagaatttaagtgcttagacataaatgttcaaatatataagttaattctaatggaaattttgtgatatcagaatcttccaagttatatgtcaaaaatcactagtgattttatcatcaagcatccattagttaatgcttctgttaggtcctccttcagttttattgaaagcaaaagaatggaaaccacccaacttgccaaaggatttgttacctagtgcttaaccatttattttcttagcttctaggaagcatatcaaaaaggcttatcaaatgtcttatatcagttcccctccctcccttcataggtactttctttaaaatctgatatattcagaagcagttgagaaaatagaaatactgttaattttaatatagctttgtgaatttttattataattgttttatgtgtttaaaatatatttttgtgaaaacttttagtatgaaggtttagcttattcaatttttagaaaatatctcctagttaacaaagccagtctccattgtcaaaccaactagccataacaaacttgctttgaatcataaaattttcctctattttaaatttcaaataaatagattaccagatattttggataatatgaaaaccactgaggaataaattatggaatgcatactaaaagatactgctaaggtatttgagctgaaaattatatgactgaaaaagaattacagtaatttgtcaatttttgtaataatttaaacatttctgcgctgcttgtcatgttagattaaaaattaaatcagttaaaatatgaagcaagggatatgataaaagttgtgttattcctttatttatttatttgtttttgagacagggtcttaactctgtcacctaggctagagtgcattggcaccatcctggctcactgcagcctcgatctcctagcctcaagtgatcctcccacctcaacctcccaagtaactgggactacaggcacgtgccaccatgcctggctaatttttgtattttttttgtagagacagggtctctcagtgttgcccagcttggtcttgaactcctgggctcaggggatccctcaagtgatccgcctgcctcagcctcctgaagtgctgggattacaggcgtgagccactagacctggcctgttactcctttttaaatgtgtgttcctgcatcttctgatctctgatctcagctattaggtataaataaaagggaatgaatcagaagtaaccttacatttttatttgggtaattaatgaaagagatacctactgcttcaaactactcagtatgacagctagcatatcttattttttgtcagtagaaggtagaaatattaaactgttgaaaaactataatgagaattgactaattagaataaaactttaatgatacgatttgacaaaatagattttaactaccatattgagtaatgcacactcaatctaaagtaatttctatacagcttttatatagcacaatttgaatgacttggcagtcctagaaagtatttcttttatatttaaaggaatcagcctccctaattgatattgttccagctctctaaatatgctttttcttcaagctaataaatattcagggaatgagttttgagaattacttacatttaaattctcggcccagcacagtggctcacacctgtattctcagcgctttgggaggctgaggcaggtggatcacttgagtttgagaccagcctggccaacatggtgaaaccccgtctctactaaaaatacaaaaagaaattaaccaggtgtgttggcacatgcctgtaaccgcagctactttagaggctgagaatcacatgagcctgggaggtggaagttgcaatgagccaagattgcaccactgtactccagcctgggcgacacattgagaccttgtcgctaataaaaaaataagaattcttgaaaaaaatatttctttttatcttttttttaaccagtgttctctgtgcattacttttatcatactgtcccctaagagcaatgcgttcttggacaatactgaatggaggtgggggtgtagggggaatggttgttagaggaaactttaaacaattgctcacagattatgatatattagaatgttccagcaggggccaaaatattttaaactctttgaaaaatatgtgactggaaaagacaagaagcccagtaatggatagtttacggcacctcagttaccattcacgaatgcttccctgaaaccatttttttggcgtgtctgtttgtttgggtccctggagtttattattccttcaggctctgcatcacaaattctgaatggaggcgagattactttttcatggcggggggaggtggaaggtaaagagaagggcttattttgaaagggaagaagtacatttggaaggtatctgtaaacagattcttggaaagtctcccactgtcttttgtgtacctttagaaagaaagcaaaagaaaggcaacagaaatgctccttatagttgattcatttaatagggaaactgtttaattgcttaataagaatgatttagaaactgtggaaaaagttccaggggaggcattagataggtacagtgagatttatagcagatagtcataactttggacaaagtactaaatagaaagatgaaaggcagatacaggaacttcagagtcataatactgagaacatgcagtggaggggacaaactgcccacctcatctcaccagctcctgagatggttactatcataccatagctcagtaatttacgttggaacagtaactgagacatcaaaaaagattaaattatgttcagtgacctggttaagatgaaagaggaactttatggtttattttaggaggatttttacagaaatggttaatgtaaaacaaattttattgcttaaaggagtaagttttaaaagcactccaagttatctcgaaaatccccttaggatgcctctttcttcatatgagacagcactttaattctcagatgacaaattaagtgtgtactttatttttgataaaatgatttttctcttgatttcagcattattccttatgtctcggttatgtaaaacactatgttgaaaaatctgggttaatttggcttattctagcttagtgtttctccagtgtcattctccagccagcagtatcagcatcacctgggaacttgttagaaatgcaaattcttgggcccctttccagacctattgaatttgaaactctgggagtatagctcaacagtcttttttttttttttttttttgagatggaatcttgctctgtcacccaggctggagtgcagtggtgcgatcttggctcattgcaagctctacctcctgggttcacgccattctcctgccttagcctcccgaggagctgggactacaggcgcctgccaccacgcctggctaatttttttgtatttttttagtagagacggggtttcaccgtgttagccaggatggtctggatctcctgaccttgtgatctgcccgtctcagcctcccaaagtgctgggattacaggcgtgagcaacagtctgtttttaaaaaagcccttcaagtgattgtgatacatgctgaagtttgagaatcactggcctaacttctgtctgaattacttctgacaattatttttgaatttagaaactctggagtccatagacattaaatgactggctcatagacacagttctggtccatagtaggactgggtcaagaatatggatctatttccagttttaaataaaagtatttaaattatatgacaatatctctactaaatacaggtataaaaattttttaaaatatatgaaccaatttaatctgttcaaatataagatatgaatatatatgtccatagatctgataatacattgtgatggagtaaagtttaggaatgtatgagtggttaatatttgaaaattaattagtgtaagttatattaacagaataaagaaaaatcatgatctcttagtggatatagaaaaagttgctggtaaaattttttttttttttttttgagacggagtctcactctcttgcccaggctggagtgcagtggcgctgtctcagcttaccgtaacctccgcctcccaggttcaagcgattctcctgcctcagcctcctaagtagctgggattacaggcgtgtgccaccacacccggctaattttttgtatttttagtagagatgaggtttcaccgtgttagccaggatgggcttgatctcctaacttcgtgatctgcctgcctcggcctctcaaaatgctgggattacaggcgtgagccaacatgcccagcctctggtaaaatttaataccaatttattataaaaacttgcagcaaattagtagaggcaaagttcctcaatgcaatagagcagcctttctcaatcttcttactctggaggaacccttgaaataattttcaggtctcagagaacccatgcaaagaattgctatacctccgagttcacatttattaacctaatcagtaagttgtggacatgataagttaataataattgtcagtgctcttttgacaggagaatatttttgtctttgcatttatttcgcccagcttattagcctgctctttgtgtgtgtggttgctccctactccccaggaaggatctccactcttgtgcaagtcagtagtataggcagaggaaacctcagtttttttcttttttaaaattttctacttgatttcttttctcacctgatcaaagtaggcaacttacttgttctcagttgggcagaagcttgggataagaaaggaaccttcacccaggttcacatttgtgttgaaagagggagaaagtactgtttaattttgtgttttagttcttccaggtggttttcgagaatgcttcagagttgctggtatccttcctcactttcaagcccaaacagcattacaagatttcttttgccacatgatttttccagagattcagttttcctttgaaatccaatgtcttgtcacttgaagtcaaaacatttttttctaaacttgttcaactggttcatattattttaaaaagtctgccaagaggctagctcctgcagtcactcttcatcttcaaagcactcagtaaaggatggcctactattttcttgaaagtactttgtaattcagctttcagcttcagtgttctgttgagaatacctcctctgctaagccactggatttctgtatgtagcaagagatttaggtgctcaagtatactggtctatgtttaataaagcaaatcatttttaaacatcattcaagactttttttaaatagtgatgaggtcttgctgtgttgccaggctggtcttaaactcctggcctcaagcaatcctcctgtgttggtctcccaaagtgctgggattataggtgtgcgccactgcatctggcccattcaagacatcttaaatttcatttccgaggatttttgctgctagtacctctctgaaaaaagcgatgtcctgagtttttttttttttttttttttttgcaagagaggtaaaaccttgccgtgagccagtcactaatggggaacatcactgtggatgccaacacagtttctctaagatggacttcttgtttccagatatgaagacaccacattgaaaatgtcatgccctttgtttatggtagtttttttgcagcacaaaaatttttcttgaaattcagcattgtttaaaaaaatttacaagacatatatagtgaaatatgttggtttgtcagcctggataaacaagctgtttgtcagtttattaaacctcttagcatcatgtgacatgtcatcaatttgtcaacttacactgtttgagagtggagccttttcagtttctcatgctgtgcattttacttactgtcatttaacatgctggcatgattaggttcccatcagtggtgtgattctatccactataccccctttttagacaataaattctgctactaataacgtgctttatgagctttttcactgaatgtgatttaaaaacaaaaagatgaagagctttactctgagattccagtaagtaccttgacttgtccagtagctgtgatttctatttcagtgatttttcacttttgctggagtcataaattgtttgccacagatgctgcacaatggaataggactctttggattactaacctagtgaagttcattgataagtagttttcactgtagtggtaggctgttctctctctcttgctgcactggtgcagtaaaatgacccagaagattatagttctttattacttgccttattagaattgttcctgggcctaggtttggaattctcttctcttgtaaattgtatcttcagaaatcatcacgctgcactgtcagacatgtttataagacatagatgctaatatgttataaaactaaagggaatagtaactgagaaagttgcaaaaaatatgaaaacttcacaatacattttacttcttttttcttttttgagacagagtcttgctctgtcatcaggatggagtgcaatggcgtgatctcggctcactgcaacctccacctctcgggttcaagcgattctcctgcttcagcctcccaagtagctgggactacaggcgtgtgccaccacgcccggctaaattttgtatttttagtagagatggggtttcaccatgttggccaggatggtctcgatctcttgaccttgtgatctgcccacgttggcctcccaaagtggtgggattacaggtgtgagccactactcccagctacattttacttttattgctacataatccatgttttgcaacatttcagagtggtaagaagcagttgactcttggtgtgtaaaaattacttgtttagaatgaatgttttccttagattttctgttataccagtagagtttgtttggtcctataagtcagtggcactgtgtgaaggaaggttggaggatgtaatttgggaagggagctgctgacattgtcagcctactatgcttttgtttgtgccatatagagcttaccaattatcagtggcctaactgcccctattgcatcaaaaacggatagtggcaggctgggcacggtggctcacgcctgtaatcctagcactttgggaggctgaggcgggcgggtgacttgaggtcaggagtttgagaccagcctggccaacatggcaaaaccccgtctctaataaaaatacaaaaattacctgggtgtgatggcgcatggctgtagtcccagctactcaggaggctgaggcacaggaatcgtctgaaccctggaggtggaggttgcagtgagccgagatcgtgccactgtactcctgcctgggtgtcccttaaaacaaaaaacaaaaaacaacagacagtgccctcagcaaagtgaacatagccctacttgcacactgccacatggtgctaaaagattccttatgaaaccattgatttggctgttcggtcgttgcctgttactgtgagcaccagcatcacctggtgtgagaaatttagaaaatgtttattttttaaaatcacgatttcttgtggaaccttagagttttgtggaatgctggttgagaaacccagtggtaagagggtaactgtgaaaacctagatttcaccctgggatgcaaggctggttcaacatacgcaagtcaataaacgtaatccagcatataaacagaaccaaagacaaaaaccacatgattatctcagtagatgcagaaaaggcctttgacaaaattcaacagcgcttcatactaaaaaaaaaccctcaataaattaggtattgatgggacgtatctaaaaataataagagctatttatgacaaacccacagccagtatcatactgaatgggcaaaaactggaagcattccctttgaaaactggcacaagacagggatgccctctctcaccactcctattcaacatagtgttggaagttctggccagggcaatcaggcaggagaaagaaataaagggtattcatttaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaagcattcttacacaccagtaacagacaaacagccaaatcatgagtgaactcccattcacaattgcttcaaagagaataaaatacctagaaatccaacttacaagggatgtgaaggacctcttcaaggagaactacaaaccactgctcaatgaaataaaagaggatacaaacaaatggaagaacattccatgctcatggctaggaagaatcaatatcatgaaaatggccatactgcccaaggtaatttatagattcaatgccatccccatcaagctaccaatgactttcttcacagaattggaaaaaactactttcaagttcatatggaaccaaaaaagagcccgcattgtgaagtcagtcctaagccaaaagaacaaagctggaggcatcatgctacctgacttcaaactatactacaaggctacagtaaccaaaacagcatggtactggtaccaaaacagagatacagaccaatggaacagaacagagccctcggaaataataccacacatctacaactatctgatcttcgacaaacctgacaaaaacaagcaatgaggaaaggattccctgttcaacaaatggtgctgggaatactggctagccatatgtagaaagctgaaactggatcccttccttacaccgtatacaaaaattaattcaagatggattaaagacttaaatgttagaccaaaaaccataaaaaccctagaagaaaacctaggcaatactattcaggacataggcatgggcaaggacttcatgtctaaaacaccaaaagcaatggcaacgaaagccaaaatagacaaatgggatctaattaaactaaagggcttctgcacagcaaaagaaactaccatctgagtgaacaggcaacctacagaatgggagaaaatttttccaatctactcatctgacaaagggctgatatccagaatttacaaagaactcaaacaaattttcaagaaaaaaaaaccccatcaaaaagtgggcaaaggatacgaacagatacatctcaaaagaagacatttatgcagccaacagacacatgaaaaaatgctcatcatcactggccatcagagaaatgcaaatcaaaaccacaatgagataccatctcacaccagttagaatgatgatcattaaaaagtcaggaaacaacaggtgctggagaggatgtggagaaataggaacacttttacactgttggtgggactgtaaactagttcaaccattgtagaagtcagtgtggcgattcctcagggatctagaactagaaataccatttgacccagccatcccattactgggtatataccgaaaggattataaatcatgctgctgtaaagagacatgcacgcatatgtttattgcagcactcaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacgaaaaaccaaacactgcatgttctcactcataggtgggaattgaacagtgagaacacttgtgttgcgggaagtcagggaccccaaatggagggaccgactgaaaccatggcagaagaacgtggattgtgaagatttcatggacatttattagttccccaatttaatacttttataatttcttatgcctttctttactccagtctctaaacataaattgtgaagatttcatggacacttatcacttccccagtcaatacccttgtgatttcctatgcctgtctttactttaatctcttaatcctgtcagctgaggaggatgtatgtcgcttcaggaccctgtgataattgcgttaactgcacaaattgtagagcatgtgtgtttgaacaatatgaaatctgggcaccttgaaaaaagaacagggtaacagcaatgttcagggaataagagagataaccttaaactctgaccaccggtgagccgggtggaacagagccatatttcttttctttcaaaagcaaatgggagaaatatcgctgaattctttttctcagcaaggagcatccctgagaaagcaaatacgtgcctgggggtaggtctgtagacggcccccctggctgtggccatcttctatggtcgagctgtagggatgaaataagccccagtctcccatagtgctcccaggcttattaggacgaggaaattcccgcccaataaattttggtcataccggttgctctcaaaaccctgtctcctgataagatgttaccaatgacaatggtgcctgaaacttcattagcaattttaatttcaccctggtcctgtggtcctgtgatctcgccctgcctccatttgccttgtgatactctattaccttgtgaagcacatgatctctgtgacccacaccctatttgtacactccctccccttttgaaagtccctagtaaaaacttgctggttttgcagcttgtggggcatcacggaacctactgacatgtgatgtctcccctggacgcccagctttaaaatttctctcttttgtactctgtccctttatttttcaaactggccaacacttagggaaaatagaaaagaacctacatgactattggggcaggttccctaatacccttggacacaggaaggggaacatcacacaccggggcctgttgtgggtggggggaggggggagggatagcattaggagatatacctaatgtaaaggacgagttagtgggtacagcacaccaacatggcacatgtatacatatgtaacaaacctgcaggttgtgcacatgtaccctagaactttaaagtataataaaaaaaaatatatatatataagaaccccctagatttaacatcatacttaacgatgagatagcaaatgtgttttctttaggtcaggaaaaagacaaggataccaaattgtcacaccttttgttctgtattgtactggaagttcttcctggtgcagtaaggcacgaaggaagtagtaacataaaaattggaaaggaagaagtaaaaccacagatgatgtgattaagtatgtagaaaagctagaagaatctgggaactactggaattaataggtatattcagtaaggttaccaaataaagctgaatctacaaaaatcaatttctacaaatttgcaataaaaaaataagaaagtgaaacaaagtacgaaaggcagcacaccaaaagtcatccaataattaggaagaaatttaacaaagatgttttctttgctgaaaactaaatcaagtctctagttgtagggcattatgtatgtactctctgtaagcactctttcatttttctttttaattcctgatctatgaggaagggattttcagtttctcttgatcttttattgttcatcactcattttgatccagtagcttccccttagcaacttgatagttggatttttggcttctgtgtttacaaagctcagtgaaaatggttaggctttcatgcattgattattacttctgtcattgatttttttctgattccaataattccatttatttttgatttaaaaacaatagtacaaggctagtaatttttaaatttttcttgaggtgtattcttattttccaggttaggttggccttttggtaattttgtacttgattgtaatggggaaaaaaacttttaatgtaaaggaaacaaaggaaaatagatcaaatttaataatgataatggagaatatggaaaaatattttgaaagggttgtattggctctccttagacaagtaacctccattattccttctagtttaggctatgtgcttccagatccatatatccaaaagtctactgcactgctctcctctgtttttttcttagctacctcatttttttttttttccaagatgtaatatcactctgtttcccaggctggagtgcagtagcgcagtcttggctcattgcaacctccgtctgctgggctcaagcgattctcctgcctcagcctcttcagcagctggaattataggcatgtgccaccatgcctggctaattttttttttttttgtggagtcgaggtttcatcatgttggccaggctggccttgaactacttactgaactcaggtgattcacccacgtcagcctccccaagtgctgggattgcagacgtgagccaccgtgcccagctcggctaactcttattaaaattttcttagcttactgtttgtacatgtgctagtgtattactctatcaatacattgtatatgttataagcttacacaaaaataagaaatgaaaaagatagagataaaaggtaaaatacactattttaaaataatttttttaacagtataagaagctctttttctgactgaaagcagtatgattgaatgagtgctgtgtcaaacatcttcatttaaccttttcttacaaagtgatgaaggtctcgttttaggtttagtttgtttggaaccttggttttaattgatgtcatagcaataaagacccttagcaaagatttatagatctcaaaggaatgaatgtgtgtatgtatacgtgtgtgtgtgtgtttgtgtgtgtgtgtgtgtgtgtgtttgtgtttgtgtgtgtgtataagtttcctgttgctgctgtaaattaccacaactttagtggcttaaaacaacagaaattggttatcttccagttttggaagtcggaggttcaaaaggcagacttgctgggctaaagtcagagtataggcaggtttggttccttctggagacataaaggggagcatctctttactctgtcagtttctacaggccacctgcattccctgactcatagtccttcctccatcctcttctgttgtcacatctcttgctattcactcggactctcctgcctccctctttcccttttaagggacacctggaaatctgcaataatgtctcctatctctggatccttggtttaatcatgccaatgaagtcccttttgtcatgcaaggtaacacagccacaggttgatttggatgtgcatgtttttggagggagggtatgcattattcactcagcggctataaatcattgttagaaaattgtgacactgatttattttaatcccgacaatttggctagtaaactcccattttaaaaaatatgtcagtttggccaggcgcagtggctcacacctgtaatcccagcactataggaggctgaggtggccagatcacgaggtcaggagttcgagaccagcctgaccaacatggtgaaaccccgtctctactaaaaatacaaaaattagccaggtgttgtggtgcacgcgtatagtcccagctacttgggaagctgaagcaggagaattgcttgaacctgggaggtggcggttgcggtgagccgagatcatgccattgcactccagcgtgggcaccaagagcgaaactccgtctcaaaaaaaaaaaaaaagtcagtttatgcaaaatatatcaaaatggattataatttttaaattactgacaattttgattttaaactcatagaagggttttgtctggaagactttttaaaaataaagattataaaacagcactcaaagtactgtaaaactattgaagtagactgggcacggtggctcatgcctgtaatcccaacacttcgggaggctgaggcaggtggatcatgaagtcaggagatcgagaccatcctggacaacatggtgaaacctcgtctttactaaaaatacaaaaattagcatggtgtggtggcacatgcctgtagtctcagctactcggaggctgaggcaggaggatcacttgaacccgggaggtggaggttgcagtgacccaagattgcaccactgcactctagcccggtgacaaggcgagactacatctcaaagaagataatagtgaaggttagaaaatagtttatcaaaattttaagatatgcagatatgacagtttttattcttataccttttaaactcagaaatcacataatgatggaaatatttcccagtcttttcaaaatgctctttccatggcatgaatttatttcaaaaagcagctacttttacacatcattaaatgccagctttactttgaaggaatagatggcttattttaattattttaaaaataattgttagcaaactgtaaatagctgctataatcatagaatattgagcagatttgaaacattttgcctttttgtaaggagaaatttgtaattcatttcttacagctttgtgaaaccattgtacaatgtctacctttgaaaggtctttaaaaaaaaattctccacaatccatcttataacaggccagtctcactgtgttgcagaatcctgaaagtgaaggaatgagcgaggccatgcatgctgggccctttgtcatgtgagattcccaggcccgcctcaggattcctacatgcatgtcacgattggaaacgtggatgtcctgacatgaagcgaaggagccactttactactagtgatgaaggagccactttactaatagtatttgtcagtccacatattcactattagtaaagcgtaactcccccccgccccccgagacagagtgttgctctgttgcccaggctggagtgcaatagtgcaacctcggctcaccgcaacctctgcctcctcagttgaagcgattctccttcctcagcctcctgagtagctgggattacgggcatgtgccaccatgttcggctaattttttgtatttttaatagagacagatttcactatgttggtcaggctggtcttgaactcctggcctcaagatccacctgcctcggcctcccaaagtgctgggattacaggcatgagccactgtgcccagcctaagtaaagcataacttttaaatggaaattaaagacaattttaataaatgttctaaagaatcatcacgaggtacccacttttgtgtccctggggtgtgtacaccccacgtaggagaccactgctgtactatagctgcccggcgtttccccgtattctagttaatcatgtcgtcattcaaggtctgtccagttttctctttcatttcttctgattgaagatgccttcctgacagatagttgtttacctagctttttttttttttttgagacaagatctggttctgtcacccaggctggatggagtgcagtggcatgaccacagctcacttgcagcatctgcctcctgggctcaagcagtcgttacagcctgccaaggaactgggactataggcgtgtgccaccatacctgattaatttttgtatatatgcaattttttggtagagtcagagttttgccatgttgtccaggctggcctcaatctcctgggttcaagcaacctgcccactttgaccttccaatttgctgggattcaggtgtgagccactatgcccggccatatctaacttttgtagcttgtatgtttagcttctcccctctattgggagctcttctgctctaaaggcagaagtagtttgcattttattgtgtgtctcattgcagtactctcagcacatagtagttaccactaaatatttgaatgaataagtgaatgaattaacagcaaacgctcaatgaatggttcttttgtgtggtgtgttaagcttatgtctctatctgctgtctgtaccttctagtttggcgaagtggctatttagttttccagggcctgactgaagcccaatgaggttcagtaacctgctcaatgtgagggaacttggagcttgggtttttttttcttttgaagagttatttttgttttggataaataacatatctctttgtacaaaaagtaaagttgtataataaggtacaatgaaggagtcttgttctcacctgtcatcctactcattttctcccctcttgtgctttctacaggtaacctcttttattagtttcttgtgattttttttccagtggttctttatgcagaaacaaagttcaaatgtatacttatttctacccttccctatatacaagggttcatagtgcatatgttttttaacatacatacttttttcttatttactttaaaaaacactttttttttagagcagttttaggttcacagcaaaattgattggaaaatacagaattctcatccattccctgcccatccccccacagcttcctccactatcaacatcctgcaccagaagagtacatttgtgacagtcaatgaacctacgttgacaaattaccactcaaagtccatagtttacatgagttcacccttagtggtgttctttctgtgggtttggacaagtgtataatgacctatgtccaccactctagtatcctcctgagtattttcactgccctaaaaattctcagggctctgcttgttcatccttctctcccctcaacccttggcagccactaaactttttttaatttttaatttttaaaattatttatttatttttaaaacagagtcttgctctgttgccaggctggaatgcaatggcttgatcttggctcactgcaacctccgcctcccaggttcaagtgattcccctgcctcagcctcccgagtagctgagactacaggcacccgctaccacgcctggctaattttttgtattttagtagagatgggatttcaccatgttggccaggatggtctcgatctccttaccttgtggcctgcttcgttttcccaaagtgctgggattacaggtgtgaaccactgcatctggcctgcagccactaaactttttattgtctccatggtttttgccttttccggaatgtcaacagttggagccatacagtatgtatccttttcagattggcttctttcccttagtaatatgtatttaaggtttctccatgtttttttcatagcttgatagctcatttcgttttagcactggatagtattccatcgtctggatataccacggtttatttacccactcacctactgaaggacatcttggttgcttccagcttttggcaattatggataaagctgtaataagcatccttagtggatttttgtatgtacataattttttggctcatttgggtaaataccaaggatcgtgattgctagattgatcaaatggtaagagtgtgtttagtgttgtaagaaactgctgaactgtcttccacagtagctgtaccatttagcatactcaccagtaatgaatgacagctcctgttcctttgcatcctctctagcttttggtatctacgtgtgtgtgtgtgttttctttggataggcatgatacatatgttttttaacttattaatttgtcttggacatcttttcaaattagcacatagagaacttttacatttactttgtgaacatctgtgtagtggaatggatgtgctgtagttaatctgtcttctaatatggacgcttgggttatttctaatattttccttttatgaacaatgctacagtgaccataagtcacttttctgtgtggtactggtatttctgtaggataagtttctagaaataggattgtttggtgaaagttgagtgtcttttcctatgtttaaggtcattttttgcaatctgcgcgtttctgtctttgggtcattttctgttagttttgtgttttttcaagacagagtcttgctcttgcctcccaggctggagtgcagtggcatgatctcagctcactgcagcctcctcttcccaggttcaagcgattctcctgcctcagcctcccaagtagctgggattacaagcatgcaccaccatgcacggctgatttttatatttttagtagacatggggtttcaccatgttggccaggctggtctcgaacacctgacctgaagtgatcccacctgccttagtcccccagagtgctgggattacagccatgagccactgtgcctggtctattttgttagttttttgaagctcttgaaatgttaggaagaatatagctcttggtgatacgagttgcatatatttttttgtcagtttgtcttttgattttatagagcaatgagtttcaaccccattctgatttcatggtctatggctcttcgtcactataattatgctacctggaataatacatgtttttcattcctgaaggtttgtttacatgtaactatgatttaatgcatctagcattttgaaactgtcttctaataacaatttcttcacttgatagacacggcatcagcgaggagatacgcatcctctaaccttagatgaaattttggatgaaacacaacatttagatattggactcaagcagaaacaatggctaatgactgaggtaagaatttagttgattatcaagagagatttcctgtaactagaattttcttttttttttaagacagagtcttgctctgttgcacaggctagagtgcagtggcatgatctcagcccactgctgactcagcctcccgagtagttgggactacaggcatgtgccacgataccaggctaatttttgtgtttttagtagagacggggtttcaccatgttggccaggctggtgttgaactcctgacctcaagtgatccgcccacctcggcctcccagagtgctggggttataggcatgagccactgcgccttgcctagaatgttttaatatggtgaaatctgataatgctttttactttttcttaaaagaaatggtgtagggtctttgttttttgaatgtacacatttataagattgatttgttggttttcatataattttatgttatctgtttcaaaatgttaaaggtaagactttgtgtaatagttgtaaagaagtcattgtaccaattcgacttaatgtttttacagattaatgcttattttgtattgccagatttatagtttgtgtgcttgtaaattgaattgtttttgttttaggaaatttaaagcataaggtactgcagggataggaagatattttgttgcacaattactgctattatggcttgatgtggaaaaaaagtcacgaatgctgtgtatgaacacacatcatttgaagaaaccccaacgcagtcagtgaccatgctaatttggaaatgaatagcatttaaaaattcaaatgtttaccgctttaaaatatgaagtgaaaactaagaagactactttctaggaccagagatagattctagaaaccaaatgtaaaattcctaacatacaattcatttatttttttaccaagcaaaatacaggtcttgacttttataatgtaacatgaccattaatcagtataattgtagttcattgtattagtgatatacaaacaatggtaatccacatttaaatttgctggtttagctaaccttgagaattcatagactaccaacatttagttaacaatgactttgatcattttactattctattctcccttttttcttctttctgtgtttcttctctttctcctttcagggtcaggctggcagctgcagaagaaaatatatagggttgctctttttgaagagctttccttctgatactaactgtacaacagaactgactagaaacataattatattcagtaattcctgcattcctactcagtttcattctcaagctgacattataggtaaagttcttgtatgcactagtctggtccttttcagttccttccacagctgccattgccagttgatagcagatggggaagaccattgactagtaagggttatgttccttactttataatgccagtatgtgataagctgtactttgcagatggagtgggcactactcagttcactttgtctattaatatttgtaggtgttttattgattcctacacattttgactactagaagaatatgggttcagcttttttcaaagtagttgtgataaaatggtttatttctcttcaaagaatttatgtaaataaaacacagtttcttttataaaaagtgagcaccgtgctgatctactgttctggaattctggatgtccaggattttaggcctgccagtttgtattcataaggtacttttaatttgccactgtattggctagtgttgtattttaaaataattagtagaattaagaatgtgtatatgggctgggcacagtggctcacgcctataatcccagtactttgggaggctgaggtgggtggatcacctgaggtcagaagttcaagaccagcctggccaatgtggtgaaaccccgtctctactaaaaatacaaaaattcgctgggtgtggtggtgcgcacctgcagtcccaggtgctgagagggagggaggcaggagagggaggctgaggcaggagaatcgcttgaacccaggaggcggaggttgcagtgagctgagatcgcgccactgcactccagcctgggcgacagagcaagattacgtttcaaaaatatatatatatatttatgttccatttgttaatatattccaattgtatcactgttacaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggtaatctctcttttctttctatgtcttaatataatttgaatgaataatgacttcttggttttaaaaatatcaaacattttacaattgtttttaaagcttctattatatacacatgggttacagtgagccacttgaaggtttgaaatttgtcttgtgccacctagcaggaaagggagcagccatctctgtgtaactttgacgggttcttgttgctgttactatatgattgtttgattgttcaggctatttctggaaaattttcctcaaaggcaatagagtttctcttgtaagctctgtttgtaaataagagtgtcttctataatactagtagatgttccttacctgaggaactagaggcattaaaacatgaaagcattggttaataacctggctgttttgaagtcctaaaggggctatctatgaaagtcctactgatacagatgacatttccagtttaaatttgaaactcactggggaaagctgcttgtttccatttgtcacagttgctcattattaatgttaacttgttaagcaggttcattcattttgctgcctgtagaagaaaacttgcccctttgtctcttcttcttggtaatggaattatacatgtcagatcttctggtattgtactacaagtccctgaggctctgtttatttatttcaattttttttctgttctattaatccattgtcaagttcactcacttttcttcttcacttccaacttgttaagcccagttggtgaattttttaattgtatttttcagttctagtctttctttgtaaatttttcttctggtttctgtttctttgctgaattttgttttcttttttttccattcgtgacaagtatcttttgttacacccttaagtatgatttcttatagctgctttaaaattcttcttattctaacagccgagtcatctcagagctggtctgcattgactgtctcttttatgggtcatattttcctgtttcttcatatatctaatacatttctgttgggtcttagaccttgtggattatattaatatgtgtaaagactcaggattctgttacattcctcccaagagtgtttctatttgttttgttttgtggttaagtgggcagttactccaaaccttgtctgccctacagcaggtagcatatgatatgtctcttctgttcttctagccttagcccgtttgcttggaatcttggaatctttttccaagactggcttatttcacttagcataatattctcaaggttcatccatgttgtacttgcaacaggattttcttcctttttaaagctgaataatattccattgtgtttttgttgttgaattgtgggagttttaaaaaatatattctggatattaattccttaacagatacatgatttgcaaatattttctcccattctgtaggttgccattttactctgttgattgtgctctttaatttgccagtttctgagtttgctgcactcttgtctatttttgattttgttgcctgtgcctttagtatcatgtttaaatcactgccaaatctaatgtcatgaagcttttgtcctatgttttcttctaggagttttatagttttgggtcttaggtatttagagttaatttttgtatatggtgtaagagtccaactttattccttttcatgtggatatccagttttctcagtgtcttgatgaagagaccgtcctttgcccattgaatagtcttagtcttggtactcatgtggaagatcatttgaccatatatgtgaaggtttatttctgggccctctattctgcctgtatgtctttcttcatgccagcactacaatgttttgattaatgtagccttttttttttttttttttttgagacagagtcacactgtcacccatgctggagtgcagtgatgcaatcttgggtcactgcaacctctgcctcccaggttcaagcagtagtcctgcctcagcctcctgattagctgggattataggcacacaccaccacacccaactaatttttttatttttggtagagatgtggttttaccatgttggccagtctggtctcgaactcctgacctcaagtgatctgcccaccctcggcttcccaaagtggtggcattccaggtgtgagccactgcacctggcctgattaatgtagctctgtaatatattttgaaatcagtaagagtgagatcaccaattttgttctttttcaagattgttttggctatgtattagtctattcttgcaatgctataaaggaatgcttgagactggataatttataaagaaaagagattgatttggctcacagttctgcaggctctccaggaagcatgatgctggtgtctactcagcttatggggaggtctcaggaaacttataatcatggcagaaggtgaaggggaaacaggctcatcttacatggccggagcaggagcaagagagagtggggaaggtgccacacacttttaaatgaccagatctcatgagaactcattatcaggagaacagcaccaagagggaaatccaccttcataccagtcaccgcccaccaggccccacctccaacattggggattacagtttgacatgagatttgatggggacacagatctaaaccatttcaggctttttgaggtcccttgagatttgatataaatttttggatggatttttccatttctgcaaaaaatgccattgggattttgatagggattaccttgaataggtaactttgggtagtattgccatcgtaactgtattaagttttttaatacatgagcacagaattcatttattcatgtctttaattttttttagcaatgccttcaggttctttcatttattttatgtatgtacaatttgactgtcccttatctgtaatgcttgggaccagaactgtttcagattttgggatttttttcaaattttgggatattttcattataccagttaaacattccagagttgaaaatctgaaatccaaaatgctccagtgagtatttctttctttctttctttcttttttttttttttttgaggcggagtctctttctgttgccctggctggtgtgcagtggggtgatctcagctcactgcaacctctgtctccttggtttaagagattctcctgtctcagcctcccaagtagctgggattacagacacctgccaccgtgttcagctaatttttctatttttagtagagatggggtttcaccatgttgaccaggctggtctcaaaactcctgacctcggccgagtgcagtggctcacgcctgtaatcccagcactttgggaggccgaggcgggtggatcacgaggtcaggagattgagaccgtcctggctaacatggtgaaacgctgtctctactaaaaagtacaaaaaattagccgggcgtggtggcgggcacctgtagtcccagctactcgggaggctgaggcaggagaatggcgtgagccaccgtgcggagcttgcagtgagccaagatcgcgtcactgcactccagcctggttgacagagtgagactccgtctcaaaacaaacaaactcctgaccccaaatgatcctcctgcctcccaaagtgctgggattataggtgtgagccatcacacctggcccccagtaagtatttctttggcatgtcatgtcagcacttaaaaagttttggattttggattcgagattttgggatttgggttgctcatcctgtagttatcaccttttaccaccttgatctagtggactattatttttaagctactttaagtcattttatgaataatttacataagtaagaataatgggatgatgaaaacagctttattagagattttagtaagaatttaacacagcaaacttctgtatcaagtaatttttggaaaacacatcaaaaagaagaatactgtcatatatccttttagcaaagtgagatgataaagattcttttcacaaaatactgtgtgataatcttctggtgaataacgggatgagaatattgtttccattttgtattgagaagcattttgttcgcttgttgattcttaagcttgagaatcttcacttgagttattgtcatctaaagactccatagcttgagactttattcctatgatgaatttttgccagatagtctagagtgctgctatttggctttttgcattcatattttgattcatctaataattgtgaaatgtctttggtcagttttcttgtctttgctctcaagggtagaaaatacaaaattttttttgtcaggtgtactcaatgaaagttaaaagacaacaagaagactcttccaatcttttatatctcttgaaaaggagtaatgtaatcctttgggcaatgcagtaagaaaactgaaggatgcccatgtatttcactattgcatcacatttctaggtgatttaatcattcttctattttcttattattttagcgttttaaaagcacaattggaaataattgatgggtaatgatgagtaaggagcgaaatatctcaaggtagaggaaaagtaagaacaccaagattctattatgtgtcttagattagtgaaagagccccatggacccaaatagtaattgcagcaaagattgaattttccgttttaagtgaaacacgttttatttttgttctttggaagacctctaagaatacaagtctggaaatatcaatttttaaaaaattgaactactcaagaaagaaactcaaaaactaaaattggggctgagtgcagtggctcacacctatagtccctgtactttctgatgctgaggtgggaagatcgcttgagcccaggagttcaagaccagccctggcaacatagtgagaccctttgtctacaaaaaattgaaaacattagctagacgtggtggcaatgcaccagtggtcccagttactccagaggctgaggtgggaggattgcttgagcctgggaggttgaggctgcagtgagctgcactccagtctgggtggagtctcttaaaaacaaaactaaaactaaaattgggtccagtggacctatggtggtggaccctatggtggtatactgagtgtgttaaggaaatgaaactcctttattgtttaaattttttttttttttggtgaggtaatttggagttaactgaaaaatctttattttatctatctttaaggctttgggggaccagatactatttgtaaatcgtcccgataagaagaaaatacttttcttcaatgataagagctgtcagttttctgtggatgaaggtgagcttttctgtattatactttagtttgcaagtatattacaattttagggtggtaaaattaatatttataatacaattataatttaaatcttatattgcttttttagcattatcatttcttagaacacagccagtggcccctgtgtctaacatattgttgcttagaatgcaatttgaaatatgtgatttgaaagattttaggttaattatacttacaatcgcagttcaggatttcttaatgtttatagctcaactgaaccaaacgggtttatttctttatctttagacttttacaaatgtaagttcatatcctgatacaaaagcttgatacaggatgggaaaaagaataaacttttattggtgaatagtgttctcttatcttatgaatctttcagttatcaaattgaataaggaaggagatgatgtttttctttctggaaattgtggagttggatgctaagctgtatattgaatctcttactaagtatatgatacgtatgtttggactttagttttaaatttttgtcaataatttgtcattaaacaagggtttagtgatgaaaaatgtattattcaagtttaccaattgccattttagcaagtgttggtggtattttactgtaaatttgtattacttttgaagttttataaaatggcaggaaaataattggacatcaatttaattgattttgtgatttgtgcagtaaccttaagttttccttttgttatctgtctatagatatccaggcttgtggttctggtagatagggctttagtttccctgaacttgttttaggaaattgtatttttgtgaaaatcccaattgagtaccttacatgtaattggttcacaataaatgttaattaaataaaaatgtgcagaatattccagttctttgatgttgttgtttctaataagcttttatataacaaagcaagtatgtagtgaacttatgctatccattgtagtgataggtgcctgttgaacaaagacttcagtactgcctggcgatttttatattgctttcagtcttcgttacttgcaatgttgcctttatgctaatttttatatttcttgcttttgaaaacatttaaggctgggcatggtggctcatgcctctaatcctagcactttcagaggccaaggtgggaggatcgcttcaggctaggagttcaagaccagcctgggcaaaaaagtgagaccctatctctattaaaaactgaaaaattagccaggcttggtggcgcatgcctgtggtctcagctactcacaaggctgagacaagagtatagcttgaactcaggagttagaggttacggtgagctgattgtgccaccgcactccagcctgggtgacagagtgagactctgcctttaaaaaagaaagttaaaaaccatttaagatatttctgagctcaaaaaaaaaaaaatctaagaaataaccgattcctttattcttaggtataataacaatcattttgaaaaatatttgcagtacttaaaaaaacctatcacaagtattacaagttcagatagagagtaagagcctatactaaaaggcagatgtgcctttcccttctctagctgcagtccctttcttttgtggcagctgcttaactagttttattttggattcttcagttttttcccaattgctaataatatgcttatgctattgtttcttgattttttttcaactttaaacattgtgtgacttactgtcatttctctttcctatacctatctctctcctcccaatatagttgtatctctagttaagttttagtttctccgtcatttactttgatgccttcaacaaacatatttaaatgttctcagtgggaattttagtgttaagtctgctctgcagatggcagcatagtgtagcatgtctgttgtgtaagcagatgtttaacttgaggcgggtggttgataggaaagagattgcagtagctctgtaagagtgtacatgaagctctagaatttcttaatagcatttctttggggttattttaggagtacactgtgtgtttagcagtgggaagcccagatgttcttgtaatctgcacgctaagctgtcactttctggcccttgtgtgctctttctgtggatactattgttttaactttgctttttcctgtttgtgtatcttttatctatacttccttaatattacccgttttcatttgtcattttatatggcctttgttggcctaaactcttttctatttccttattgcatagcttataggggtaaaatgagaattttcactttcccccctagaaaacattaacaatctagaaatacatagagtaaaatagtaatattaaactctagcatatgtgatgcagaaattaaacatgcatcatggatatgtgttccgtgtcttgtgataacatatgcttggtagttaaatcttacataatcaggaacaagttctgtaaataatttgatgtttattcttttagtttgctttctcagcattacaaatattccataacgatgtatggctggttagtattccactgtgtgtacctgattaatgagttttaaaatagttaacaatgctgaagcaaatgtctttacatatcttacacattggctatgtattttttattttaatgaagtagtcatagaaatcaggaagataatgcagaagtaaattgagaaaatatttttgcatcttttcagatctttgttgttgctaacttatttaatatatggtgaaatgtactgctaggtttcttaatatttaaccacccttacactcctagataacctttctttggcttcatgtatttctaaatttttaatattaatgtatttaggacaattgtttcagtatggtcacttttcttttttgtgtgctttgtcagattttggttatggttattatgctgggttcataaaaagaaaagtagtttttcttcctctccccccctcattccttatgagaatagtagattctttaaaaatgtgaaggcatatacccatgaatgtatctggctaattgctttcttggcaacattcttaatgttttatttgcttatgtccttaagttttctatcttgcaagtcaattttgataattctgtgtttttctacaaaaccattctttttaaaatttcaaatttaatagtgtgcggtttttcagagcgtggccctcggacttaattttctcactgttattttctctatggtgcacttttgtatttgttctttccttatttctttgtgaactacttattttatctctgttgtttgttgtgttttcattttaacagaaaatattcttatcagatcatcatctacatacatatttattttttgactacttgatctaagcagtgactgagcaaacatcagaatctctcacaacttttatgtttttgtttatttttcctgtagttactgctttttatattttcatgcagagtttttagtttataaacgttcttggcagtcgtagtttattttaagaattgtgttcaaaatcattataatgtgtccccctttgttgtatttaatgttcttttccttgatgtctggctttattcccatctgactgtcataacctctggctttttaaaaattttatatattttttcccatcttttactttctgtctgtatttttttgttgttgttttaagtatttcctttctagatggcatatggctggctttaacttttgaatcagttctgactgtcattttacatttaccgtctttattatatgttgtaatctccccatcatttacttggaaatggtataatttattttcattctcttatcctctgttgtctttttattcccttgttgacaatttctgggatttttgttacagtttattaatgtttattcgtaagcctgtttattcaagaaatatttaatggtctcctcctaagtgccctagtcattttgctaaatatagaggtaagatagaccagtccctgtctttatggagcttccattctgaagtggaggacaatatacaaaatttgaaaatactgcggattgtatgaaatgctaggaagaaaataaatgagctctatggtaaggtgtgggtggtgaagttcagatacaacctttgaaaaaaggtgaaataagccaaaacaggaaaaatggggtggagctagccttgccaagggtcagaatagtgtccacgtgtgggactgtaaggcgagtatccaggcagagggaatagcaaagacaaagattgtgggaaggactttagtttttttcctagagtggcttttgtttcaccagattcagtgaacacctttttttttttttttttgagacggagtttcgctcttgttgcccaggctggagtgcaatggtgcagtcttggctcacaacaacctctgcctcccgggttcaagcaattctcctgcctcagcctcccgagtagctgggattataggcatgccaccacgcctggctaattttgtatttttagtagagaccaggtttctccatgttggtcagtctggtctcagactcccgacctcaggtgatctgtttgccttggcctcccaaagtcagtgaacactcttataacaaatgatttgtaacgtcatctttgcttttgtgaaattaagttcatagataatataacctactgatacacatactttcttaaaaagtcagtgtaataccctaagtgtaatgtaaagaatgaaaatatatttttattctttaaaatatattttttatggtttaaaaatttacttcagccaggtgctgtgacccatgactgtaatcccagcactttgggaggcctgccttaggcgatcacttgaggtcaggatttcaagaccagcctggtcaacatggtgaaatcccatttctcctaaaagtacaaaaattagccggacatgctggtgcgtgtctgtaatcccagctacctgggaggctgaaacacaagaatcgcatgaacctgggaggtggaggttgtagtgagcctagattgtgccactgcactccaacctggacaacagagcaaggctctgtctcaaaaaaaaaaaaaagattaaaaaatgtataagtgctcaggcagttaccctagaatgtaaatggaatggaattgaaacagttgtatatctttctattgtagagtcaccatgaagatgatagccaccaatgggccaatatagttacgatgtattggcaacttagatgtcataactggtctcttccttaagtggtaaaggattcttggtaaagttctgaaaatacaaagtacatttcttctgtgatttatcaaggttaataatgctatattctgtgtacagtatacattgtatattcctagaaaagtttattaaaagtgccaaaaatactttgtttatatatgttaaatagaattgggtttgtaggctcagcttattgttataaactggtatttttcactgatctgtgtccctcttaagaaggatggtgggggttaagcagggctttcgaccttggcagtgttaacatttggggttggttgagtagtttttttttggtgtggggagtgtcctgagccttgtagggcattgatcagcatccttggcttgtttagataccagtagcttagcttccctgcagtgtgacaaccaaaactttctttagacattatcaaatgtcacctggagaacaaattccccttgttgggaacttggttaaaggtccagtttatgttgatagaatagaggaagattgagacccactgttttcagattccttttcctggctcctgtcattccgcacacttggtggtggaagaagatcacagtgaatgaggttgctgtccttgaccttccaggctgagcgggtagaatggcataggaagcatagttcagctgtttgcattttgtcattttggtgttcacacggtgctgtagagacaccagagggaacagccatttacaggaacctcgggtaaggtaccaccagtcttttagttgaaagtgccagtattacgtaaatcagtaacaaaaacaaaacaaaacaagtttttgttaatgatataaggaatgtgtgtttccagggaagacccattgaaaacggacacgttttaacattcatctctagcctcagaatgctttatgctttgtgtgaagattttcgtttcgttccactaggtggcaaccttagccatagagaggaactctgagtgcgcacacttcaggcacacagagggttctgtctgtaatagaagcacttgtcctaaaatgagaattagctcaaggagagagttgatggtgtagtaattttttaatccagtgtagaagtgaacacagagtagttggacctaggcaggcaacttatttttcaaaggcatttctttccttaagtcagaagcttattcatttaaaggtagtataaatgtgatggggaagaggctggtgctgaggagttagattgtaggttttatctttttttaatttattttttattattattttttactctaaaaaaagatttattcattccatgtaggttttatcttagctcagtcccttactagcctaggcaagacacttaacctctctctgagattcctcatctgtaaaatagaaataatagtattgttacctcattgtctttgaggattaaatgagtgaatataaataaaagtgcttggaacttggaacagaatctggtggaaagtaagaacatggtaatgttaactattattagtatcggaaaaataaaatagtacccatggtgctagtcattttaatcctacttaacctggttatttatttatccatctgtcactgactcactggttttatagttttgtgtttggttaaacagatagcaaagaaagccaatttagcagtctcaggccacatttgtgctgattttttgcagttacgttatggtttttggtgtttctgatgagaattctaatggacaatctttttcctcattgctggcaacttttttacttactggaagcttaaacagtttcacctttatcttaagaattcaggattcttatagtagctaccacttttgagtctgtgctctggggctctcatactgttttagatcattatttatttatttattttttgagacagagtctcgctttgtcaccaggctggggtgcagtggcgtgatctccgctcactgcaacctctgccccctgggttcaagcgattcttctgcctcagcctccctagtagctgggactgcaggtgggtgccaccacgcccagctaatttttgtatttttagtagagatggggtttcacagtgttggccaggatggtctcgatctcttgacctagtgatctgcccaccttggcctcccaaagtactgggattacaggtgtgagccaccgtgccctgcctgatcgttattttttaaatggctacatggtattctattttgttgatatactctaaaacaattttttctggcccatttccaggtatacaaactccacagatgggaagtttttttttttttttttgtgagacaaactctcgctctgttgcccaggctggagtgcaatggcacagtctcggcttactgcaacctctgcctcccaggttgaagcgattctcctgtctcagactcccgagtagctgggattagaagtacgtaccaccatgcctggctaattttttgtgtttttagtagagacagggtttcaccatgttggccaggctagttcttgaactcctgacctcaagtgatttgcctgcctcagccgcccaaagtgctgggataacaggcgtgagccactgtgcccagccagttatttatttatttttttggttttatttttttgctctatgctgttacagatagtgctgtgtgtacattttcttgaggttgaattgctggatcaaaagatagacatatttttgaaaatactaatgccttaccaaatgtctgttgtaaaattgggccaatttatacctccacagtaataaatgagaaggaatcttatttcttcatgtcctcataaatactgattgggtgtttttagttgactttgccaacctcatagaacataaagagtatcttgttttttattttattaatttttataaatagagacagggtctcgctttgttgcccagactggtcttgaactcctgggccaaacgatcctcctgccttggcttcccaaagtgcagggattactggtgtgagccaccatgcccagccaaagattgtcttgttttaaaaattcattttctttcacgcattttataaaattaaagaaaaccaggttatttctctttgtcaactgaacattttgtccccacatgttttaaaaagtaattaaatttgagattctgtgagattgtacctctaaaatacccgtgttccagtattcatcttaagtatttatgcagctgtaatacatttacgtagatgtcatatttaaatgatttacatagtagatgtcatatatttacatttacatagtagatgtcatgtttaaatattgcaacagcattgagctaaggaaaggcagggattaagtataaatgttttattgaaaaaaattgaagagtttttattcagggtttttctctgaaaatagctcaagtgactttaaacaaaaggaactagttaaattaaaaattttaaagtgtactttcagttctattgtgccatgaaaatttatagtgttgtgtgttctttctatacagtaatatacagatcagctttccagaccattgctgccactatttaagtaggtaatattacctctgcgattgtgtcataagaggtccgcagtatgtaagcttctttgcatatcaggtagaaaggcaaagaaatttctgttttcaaggaactgaaattttgcagtggtagaaagtgtattgaatgaaattaaccagtgagtaaaaggtatgtttttcctatgtacttctttcccattttgcctttattgttatacaaagagaagtacacagttgacttgttggacagatatgtaatacatattctaaagaaatggatacagttttcacatgttgataaattagaacttaacaaattgatgatcaaaataccagaactattctttggtaggatatagtttctttaacagctataataataagtttgacatgtaaaattctggctattgcctacattttaaaacagtaattttgcatgctttattgggattacagagatatttttgttgctgagttggaagtttgacctgaaattattttctttcatatatgcctatagtgagcaaagctagccacattcattaaacagcctttaaagtttggctgaaaagcagatagttggggacttttagcttctacttagaatggagaaagctagagagagcatcgttcctaccttgacagcaacaacaaaccccagaagtctgcgtgctgatatcttcttgaattcatcagtgagctgaggttgcaggacaacctcccaacccaaactgtaaggagagacaggcacccccttggaaaggtaagacctgagcacttgtttacctgagacagacaaagtgaacatcccgcaggagaattcagttaaaatttaatgaacttagtgtggaccagcaagaaaacagagatcgcctggggggctgcagacacagggggagtttgtatccactcacaggctcttctccacagatttcattggatgcttacaaaaaagattgaggcaagggtgtgggtactgagaaagtgtcccttactgttccccctggaggagagggacagtagatccttttggaaagacacgaagccctgtctgagtccttcttcccttctttgctcctatgagataagagccttaaaccactgtggaaagagaacagaaaaaaagtctttcgtccttggcgagggacaggaatatgtgctaggcccagaactttagtggaggagaaagggcaggagcactgagaaggccacaccccagtcaccaaggaagacagtgtttgcccaagaccaaggcttaatcctaatgtcagagaatcttcccacccatacgaggctaacagctgtggactgacaggtgacactggagatcggtgtaaggcgcaagaacgtggaggcagaccagctcagatgcagcgtaaaaggaagaccaaaaaagctgaaggtcgaacagacactgaggaaaacatcctctggcaaaccagccactaccctaacacagttcgaagctggtggtacattgtgggtaaccatggcagcaacaaattccaaaccacgcttctgttctgacaatagattgactcaacctccacacactaaagatctggcagaaggaaaggcgggcccatttcccaggcataaaaactatttacctcagtcttagctgtcttacaaaggatatcctgctttcaaaaaagttttgaggcataaaaagaaggaaggaagaacaacacactattgagacaggacacttttaagaccaaattctttggaactaccagacatggaattgagacaggacatttttaagaccaaattctttggaactaccagacatggaatctaaaataactgttcagtatgttaaaatctctagtagaaaaggcaggcaacttgtatggtcaggtaggatatttcagcagagagatagacactgtaagaaaataaaataaatgctaaaaatgaaaatgacagtaacataggtgaaaaatgtcttcaacaagctcattattaaacttggtgtagccaaagaaggagtctgtgaacttgaatacagctgaagtgtgaaaaaaatagggcagagaacccataagctgtgagacaatatcaagtggtctgaatttgtaaagtctgagaaggaaaagaaagaaaacggggcagaagaaatacttgaagatgtaatgaccaagaattttctaaaattaatgatggacaccaaagatctgtgaagctcagagaacaccaatagatcatcccccaaaccaggcaaatgacagaaaaacaccgaggcatatcatattcaaattgcagaatatgaaagatggaaaatattgaaggcagtcagaggaaagagactaattccagaggaaaaaaagaatgcagagttcttattagaacccatgcagaccgaaagataatgcagcacatctttaaatggccaaaagggagaaaatcctttcaacccagaattccgtacacagcaaaaataatcttttcttttcttttctcttcttttcttttttcttttccttccccttccccttttcctttcctttcttttcttttttcttgtctgactctgtggcccaggcgagagtgcagtggtgcaatcttggctcactacaacctctgcctccagggctcaattcatcctcccatctcagcctcctgagtagctaggactgcaggtacatgccactacatctagctaatttttttgtatttctagtagagatggggtttcaccatgttgccaaggctggttttgaactcttgggctcaagcagtctgcccttctcagcctcccaaagtgttaggattacgggtgtgagcaactgcatccggcaaaaataatctttcagaaatgaaggacaaatgctctctcagagaaacagaaatggagagaattcattgccatcagacctgcactactggaaatattaaaggaagttgttcaggaagaagaggtatgacattagacatttggatctatacaaatacgtttctaggagatagagtttttattatttaaaaatatttttctaatttctctgaaagatgaccataaatcaaaaatattaacaatatattttgtgtttagggcgtgttatgggaaataaaatttatgacaaattagcttaaaggtcagaagggatcaataattggtctagtatactgttctaatgtctttacatgacatatgaaatgctatgacttactctaagctaggctctgattaattaaatatgtatgttgtaaacctaggtcaaccactaaaaacattttttgaaaaaaatgtaataagccaatagtggagataaaatggaatcatacaaatgtatccagctaatctaaatgaacacggagacagaaggaaaacacaaggagcagatggaacagatagagacagtggtgaagattatagcctttattccaactacattaatcattgtgttaaatgtaaatggtctaaacacactatttttcagcttgggtgcaaaagcaagactctagtatatacttttttttttttttttgagatgaagttttgctcttgttgcccaggctggagtgcagtggtgtgatctcggctcaccgcaacctccacctactgggttcaagtgattctcctgcctcacctccccagtagctgggattacaggcatacaccaccacgcccgtctaatttagtattttttagtagagacaggatttcttcatgttggttgggctggtctcgaacttctgacctcaggcgatcttcccacctcggcctcccaaagtgctgggattataggcatgagccaccgtgcctggccacttttttttttttttttttttaaagatccattcctgcagctgtctagtatatactgtctataagaaacccactgtaggccactttaggtcagaagttcaagaccagcctgaccaacatggtgaaaccctatctctactaaaaataccaaaattagccaggcgtggtggtgcgtgccagtaagcccagctactcaggaggctgaggcagtagaattgcttcagctggggaggtggaggttgcagtgagctgagatcgcgccattgcattccagcctgggtgacagagggagactctgtctaaaaaaagaaaaaaaaagaaactcactttaaatatagatgggttaggccaggtgtggtggctcatagctgtaatcccagcattttgggaggccgaggtgggcagatcacctgaggtcaggaattcaagaccagcctagccaacatggtgaaaccctcatctctactaaaaatacaaaagttagctgagtgtggtggcatgcgcctgtaatcccagctacttggggggctgaggcaggagaatgtcttgatcccaagaggcggaggctgcagtgagccaagattgctccactgcactccagcctgggtgacagagcaagactccatctcgaaagaaagataaaaaaataaaaaataaatatagacaggttaaaagtaaaagcatgtaaaatgatatactgtgcaaacactatcaggaaagctagggtggctatattaatatcagacagagtagatttcagagccaggaaaattaccaaggattaaagaaggacatgggccgggcatggtggctaacacctgtgatcccagcactttgggaagctgaggcaggaggatcgcttgaggccagcctgggcaacgtggcgaaacctcgtctctacaaaaaataaaaactcagcctggtgtggtggtgtgcacctgtagtctcgtagtgctactcaggaagctgaggtgggaggatcacctgaacccaggagttggaggttgcaataagccatgactgtgccactgcactccagtttgggtgacggagccacagcctgtctcaaaaagaaaaaggacgttacataatggtaaaagtatcaattctccaagagtacataatagtcctaaatacctatatatctaacaacaggccttccaaatacatgaattaaaaatggatgaaactaaaaggagaaatacatacatccacagttagactacagcattcctctttcagtagttgattgaacagatagatggaaaattatgatatagaagtccggaagagcaccatcaactaatttgacctaattgggatttatagaacagactgtcctgcagcagcagaatactgtgcatgtattttcctttttttctcttttgagacaggtttcactcttgttgccctggttggagtgcaatggtgtgatctcagctcactgcaacctcctcccgggttcaagtgattctcctgcctcagcctcctgagtagctgggactacaggcacgtgccaccacacctggctaatttttgtatttttagtagagacggggtttcaggtcaggctggtctcaaactcctggcttcaagtgacccgcctgcctcagcctcccaaagtgctgggattacatgcgtgagccactgtgcctggccctgtgtgtatgttttcaagttcatctggaatattcaccaagatggatggtattctggcccacaaaacaagctttaattgtatttgaaagaattgaaagtatcattggccctccatgtcttttggttctgcatctgtggattcaaccaactatagactgaaaatatttggaaaaaaattttgtctttattaaacacatacagacgttttccttgtcattattccctaaacaatacagtataactatttacatggtgtttaaattgtaccaggcattgtaagtaatccagagattatttaaagtgcatgggaggataggcataagttatatgtagatactataccatttgatatcagagacttgagcatctgtagattttggtatctgtatgagtcctggaaccaatcccccatggataccaaaggctgactatacgtgaacgatgtgtgtgagccgtaatggaattaggctagaaatcaataacagagctagtagctatatttggagactgtccatttggaaattattttatttatgtattttttgagacagagtctcactgtataggctggagtgcagtggcatgatcacagctcactgcagccttgacctccctgggcacaggcgatcctcctatctcagcctccccagtagctaggactacaggtgtgtgtcaccatgcctggctaatgtttgtatttttttgtagagatgggattttgcagtgttgcccagtctggtcttgaacccctaggctcaagtgatctgcctacctcagcttcccagagtgctaggattacagatgtgagccaccacacccagcctgaaattaaatacctttaagtaacctatggttcaaggaggaaatcacagggaggtaaaaacattgttgcattaaatgaaagtgaaagcacagtgtatcaaaattcatgggatgcagctatagcagtgcttatagggaaataaagagcattaagtgcttatagtaaaaaaaaaaattctattgtatggccatacacttttcatgtatcagttgatggatatttgggtttttccactttttggctgttgtgaataatactgctattaacatacctatacaagtttttgtgtggacatgtgttttcatttctcttaggtatatacctaggagtagaattgctacatcatatggtagttctgtggttaactttttgaggaattgtcatactattttgcaaagcagctacattaatttacattctcaccagcaacttaggaaggttctgctttccccacacccttgccaacactgattttagccattctggtggatgtgaagtgttactgtgattttgatttgcatttccctaatgactaatgatgttgaacatctttttatgtgctgattggccattttatattttattttatttttattttatttttttactgtagaaacagggtctcactctgtttcctgggcttgagtgcagtgatgctatcataactcattgcagcctcaagctcttagggtcatgcaatcctcccttctcagcctcctgagtagctagggcaacaggtgtgccacggtacctgggtaatattttaattttttatagaggcagggtcttactctgttgcccaggctgaccttgaactcctggcctcaagtaatcctcctgccgtggcctttcaaagtgctggaattataggtgtgaaccaccacatccggtccatctgtatatttcatttggcaaaatgtgtattgaaatcctttgtccatttaaaaaattgttttgtgcttttattacagagctgtaagaattctttattctggatacaaggccattgtgagatacatgctttacagatatttttttccattctgtgggttgtcttttcactttcttgatggtgtcttatgaggtataaaagtttttaattttgggccaggcgcagtggctcacacctgtaatcccagcactttgagaggccgaggcaggtggatcatccgaggttaggagttcgagaccagcttggccaacatggcaaaaccctgtctctactaaaaatacaaaaatcagctgggcatggtggtccccatctgtaatcccagctactcgggaggctgaggcaggaggatcacttgaacctgggagggtgaggttgtagtgagctgagattgcgccactgcactccagcctgggtgacagagtgcaactctgtctcaaaaaaaaaaaaaagtttttgatttcaatcaagtcctttatctttatttcttttgctgcttgtgcttttggtgtcatgtctaaaccattgcctaatccaaggtcatgaagatttacctctgttttttcctctaggagttaggggtttttcctctaggagttagagtttttgtttatggtgtgagacgtgggtccagtgtcctttagaaagctaaatagtaggtatagatctctacattgtaatatatactactgtataacccagccatcccactcttgggtgttaacccaaattcacattaaattaatgggtatttatactggctttcttcataaccaccaacaattggaaacaactcacatcctttaactgtcccttaacttccccttaactgtggcacatacttacagtggaatacaactcagcaatgaaaaggaacaaaggactgacattccaacaacatggatgaatctcagaggcatcgtgcctcatgagggaagccagattcgaaagggacatgctgtgtgattttatttatatgtttatgatattcctgggaaacagaaccatagaaacagatcaggggctgcccgtggagagagtgactgcagaggagcatagggtgatttgcggttgtggaactgtctatatcattatcatggtggtgttagcatgaccatatgcttgtcaaaacttcaggaattgtacagtaaaatgtgcaggattttaattttcataaattataccttagtaaaataaaaggacaatttaaagtagttgttcaaaagaatatggtgtttctcccattgtaaagcagttttcaaggtaaagagttaccccacggcttctccccttcttgttttggtgtctggtgtttatcccgagtaaaaagtgcaattgctcagtgtagatttcagcaggatcaccaagaacagcaagtgctgccaagttcttctcattctgtccagcctctgctgcacagatttgggcagacgatgcctgttctttacagatgtccagatagcaggtcatactgtggtagtgacagaattctcaagaaatacttgttgaaatgttgaggatgaagtggcacttgtctttataatcctgcctgcttaagttatacttaaaatttattttttatttttaagacagcgtcttgctctgttgctcaggctggaatgtaatggcacagtcataggtcactgcagccttgaactcccctggactcaagccatcctcccacctcagtctcttagctgggactacaggcatatgcctccatgtctggccaatttattattttaaaaattttggtagagatggaggtctcgcttttgcccagactggtcttgaacttctggcttcaagtgatcctcccaccttggcctcccaaagtactgggattacaggtgtgagtcattgcaccatgccaatacttttttcttttttttgaggtggagtctcgctttgtcagcaggcttgagtgcagtagtgcgatcttggttactgcaacctctgcttcctggattcaagtgattctcctgcctcagcctcctgagtagctgtgattacaggcgtgtgccaccacgcccggataattttttttttgcatttttagtagagatggggtttcaccatgttggtcaggctggtctcaaactcctgacctcgtgatccgcctccctcagcctccaaaagtgctgggattacaggcgtgagccactgtgcctggccaggccagtacttttttaaaaagaaaattttcaagcagtgtgtattagtttcctgttgctgctgtaagatgttactacaaacttcatggcttaaaacaacacaaacgtattatcttactgttctggaggtcagaagtcttaaatgggtaaaaagggctgcacttctggatactcatgggaagaattcgttttcttgccttttcagcttccagaggctacccgaatttcttggcttgtgtcccagcatcactctgacctctgcttccaccttgactcaggctctcttgcctgcctctttcctttataaggacccttgtgattacattaggtctgctcaaataatccaggataacctgcctttcaagattcctttttctttggaccaacacctcctcattccccttctcctagcctctagtagccatcattctactctctgcttctgttgagttctgattgttttagattccacgtagaggtgaaaacatgcggtttttgtcattcggtgcctggcttatttcatttaacaatgtcctccaggtttattcatgttgcaaatgacagaattcctttcttttttaaggctaatagaattccattgtgtgtatatatattatatttttgttatccgttcatctgttgatagacacttagactgagtctttatctcgactgttgtaagtaatgctgcagtgaacatgggagtgcaagcatctcctcaacatactaagttcaagtccttagaataaatatccagaagtgggattgctggatcaaatgataatctagttattagttttctggggggactccatacagttttccataatggctacaccaatttacatttccaccaacagtgtacaggtgttccctctgctacatcctcatcagtgcatgttatctttcctctttttgaggataaccattctcacaggtgtgaagtgatggctcattgtacttctctttctcctttttcctttaagtctctgccccagttggaaatcattgtggttttgatttgtatttccctaatgattagcaatgatgagcaatatatctgttggtcatttgtgtggttttttttttttttttttttttaagacggagtcttgctctgttgcccaggctggagtgcagtggtgcggtcttggctcattgcaacctccgtatcttgggttcaagcaattctcctgcctcagcctcccaagtagctggaattacaggtgcccgccaccatgcccagctgagtttgtatttttagtagagatggagttttgccatggtggccaggctggtctcgaactcctgaccttaggtgatccacatgccttggcctcccaaagtgctgggattataggcatgagccactgtgcctggcctcatttgtatatcttcttttgagaaatgtctgaatatttctgacatttcaggatttctgaattttcagacaatattcagatcttttgccaatttttaaatcaggttattttttttttttgctattattttgagttccatatatatggaaaatatatataatttttttttcttttttagaggcagcgtctcattttgttgcccagattgtaatgcagcggcatgatctcagctaactgcagcctccacctcccaggctgaagtgatcctgtcatcttagcctcctaagtagctgggactgcagatatgtactgccaaacttggctaatcttaaaacattttttgtagagacgaggtctcactatattgcccaggctggtctcaaactcctaggctcaagcaatcttcctgcctcgccctcccaaagtgctgggattataggcatgagttgtggcacctgccctatattttgtatattaaacccatattagatgtattgcttgcaaatatattctcccagtttgtaggttgtctcttcagtctgtttactttgccatgctgcagctttttggtttgttgtaatcccagttgtctatgtttgcttttgttgcctgaacttttggggtcaaatccaaaaaatgattgccctgaccagtgttgtgttgttttccctgtgttttcttgtagtattttcacaggttcaggtcttatgtttaagtcttcaatccattttgagttgatttttctatatggtgtgagacagtggcctcatttcattctcctgcatgtggatattcagttttcccgacaccctttattgaagagactgtccttttcccattgtgtgttcttggcacctttgtcaaagatcagcggattgtaaatgcatgggttcattactgggcttttgtttatgccagtcccatgctgttttgattaccgtagcattgtaatatagtttgaagtagtgtggtacctctagttttgtttgtttcgctcaagattgccttggctattcagtttttttgtgtgtttccattagacttttagaattattttttctatttatgtgaaaaatgacattggaatttttatagggattgcattgaatctgtggatcactttggatagtatggacattttaacagtattaattcttccaattcagaatccaaatcttgagatctcctcatctcaagattcttagtcaccaaagtctcttttatggtaatgtattcacaggttctggggattacgttgtggacatcttgggtgggggtgcatttttctgtgtagcacacaagaaattattttgataggtctcaaatgtaagatcactagaagatgaggtaaattgagaaatgtcctattttctggaactgcaaagtggatataatgacacttttgaggataaaaagtcacgttaataacacgtgttgttaaaggaaaagggaggaaggcatggcgtgttgctcgttgagattctgcatttggttttgttgttgttgttgttttagagacagggtctctctttgtctcccaggctggagtgcagtggcacaattgtagctcacaacgtcaaactgggttcaagctctcttcccacctcagtctcctgagtagctgggactacaagtgaacaccaccatgcccggcttgttttttaaatttttgagatggtgtctctatatattgcccaggctggccttgagctcctgggttcaagcagtcctcccacctccatctccctaagctctggaattacaggcatgagccactgggcctggcctttttttttttttttttttttttttttaaagggcaaagatgtaccttaatgctaacactagaacaccatagcctaatgtggggctgagaaaaagtggcaagtgcgtgaattattagtaagtatgatcctccttatttttaggttatttctttaaaattttacactagcaatacacaaatatttctgcatattattaataaaacctttgtcaagtctgcagaacaaaaaaatgaaaattctctaagcaaactgtattcttttctctggggatacctattggtgtgtattttccacatctttacgatgtatttaatatgtatgtgtttttgctttttaagaaatttttagaagttttgtttcttctgctttacataaatgagatcactttgtgtctagtagctgatcctcttcttaaatgttttatattgcctttattaaagacaccagcacacagaaaattatgatgggtgttagatggtgatgataacagtaataggtgtagataatgctgtttcatttgcaggcattattttcggtgctttattaactcctctaatcctcactattctatgaggcaggtattattattactattatcgttattattattattgagacggagtttcgctcttgttgcccaggctggagtgcaatggcgtgatctcggctcaccgcaacctctgccttccggactcaagcgattctccttcctcagcctcccaagtagctgggactacaggcatgtgccaccacgcctggctaattttgtatttttaatagagatggggtttctccatgttggtcaggctggtctcgaactcccgacctcaggtgatccgcctgccttggcctcctaaagtgcttggattacagagccaccacgctcggcgaggcaggtattattattatcctcactttacagatgaagaaatggaggcagaaaaattaagatgtttgcaccactttgtgcaggaaatgtggtaactgaggtcacagccaggccatctggctctgaggcctgcaccacactgttgtgctacttttgcatttacgggaaagggctaagcacagacaaaatgtgagtgcgttatttgggaattttaagcaaagcctcattggtaagttggctcattttcttcccttctatggcagttacacagttttttattcttaactcatgtgggacaaggaagggtcttttgaaatgaaaggatcaaatctgagcttttaaattctagtctgttttctcctcttttctgctaagagagtagatttctaaatcagttctgattttatttacccttacagtttagagtgtgcctgactttcatgatacttggctgtcttctgccataataaagtgtctgcctttaaatttgatgtcccttgatcattttgttttcaaaaaagagattgctatttttaaaaacccaaaatatgtagatcttggtttttaaataccattctataataaaacaagtcaggaatccttgaagaaatcattgattccaaatgaggggaaatacaagatgagcctggaacatcttttagtaccgccagaaagtgagagaaagaagaaaaactggaggaaaaaaaaaaaaagggaagcaagtcagggacataggaaccaacatgaaggaaatcttagtgattagagctgggatgtttgaaccacaaaataaatactgatcgtcggctgggcacggtggctcacgcctgtaatcccagcactttgggaggctgaggcgggcagatcacaagatcaggagatcgagaccatcctggataacacggtgaaaccctgtctctactaaaaaatacaaaaagttaactgggcgtggtggctggcgcctgtagtcccagctactcgggaggctgagacaggagaatggcgtgaacccgggaggtggagcttgcagtgagccgagatcgcaccactgcactccagcctgggtgacagtgcgagactccatctcaaaataaataaaataaataaataaaataaataaataaataaatactgatcgtcatggattatctgtgtaataaatatgtagatataaatctgtacagtaatatccatgagtctgctaaattaaataattgaaaaacaagttggaggttgggcacagtggctcaggctggtaatcccagtactttgggaggccaaggcaggtggatcgcttgagtctagacgttcgagaccagccttggcaacatgatgaaaccctgtctttactaaaaatacaaaagttagcctggtgtggtggtatgtgcctgtagtccccagccacttgggaggctgagggaggaagattgattgagcccaggaagttgaggcttcagtgagccaagattgtgccactgcactccagcctaggtgacaaagtgagaccctgtctcaacaaacaaacagtgaactgaaggaagagcagctctttgtgttttttgttatgttttgttttttgagatggagtctcgctgtgttacccaggctggagtacagtggcacaatctcagctcactgcaccctccgcctcccaggttcaagtgattttcctgcctcagccttctgagtagctgggattacaggtacccactgccatgcccagctaatttttgtatttttagtagagacacagtttcaccatgttggccaggctggtcttgaactcctgaccttgaatgatccaccctcctcggcctcccaaagtgctgggattacaggcatgagccaccgtgcccagcctattatagtagaattctaattagtacatatggaaggaatgatggaaataatttgtcagtagttacttacaagtagtcatttttgtaggtaagcactaccaatggatgctattataaaattagtgataatatgagaaacggtatttatatagtctgaaaatatctctccattaattattaactacaaaggaaaaactgatagcttcatgacagagaaacctgagagataacaccttgcctgatggtcagcgtttaccgggtccatgttgacactatgtagcttgctactgtgccccaagaagggcacaagctcgttactgtgttgttcttgccagaattgcataacctcaatctagtaatgaggaaatactagacaaacccaaatggaagtttctgtaaaacaactgaccagtggggaaacaaagactggccacacttagagaatggaggagaccaaagagatgtgacaggcaggatcctgggccaagaaaagagcatcggtgaagttgaagtttcacttcaaacttgtgaagtttcagtaaggcctgttgatgaattaatagtaatatgtccatgttagtttcaataattatacagttatgtaaggtgttaacattaggggaagctggataaagggcatataggaactctgtgtactcattttgtaacccttttgttagtgtaaaattattttttaaaagtctaaaaaatgtaaaaagaaaaatataggccagacatggtggctcgacacctgtaatcccagcacttcgggaggccgaggcagatggattgcctgagctcaggagtttgagcccagcctaggcaacatggtaaaacctcatctctacacaaccccccacccccccagaaacaacttagctgggcatggtggtgtgtaccttggtcccagctcctcaggaggctgaggtgggaggattgcttaagcccaggaggtggaggttacagtgagctgagattgcgccactgctttccagtttgggcaacagaactagaccctgtctcaaaaataaataaattttaaaaaaagaaaacagtctgtcttgtctagggtgtagtagacaatgatggtatttcatacattcggtagtcaaatcgttgaagtcttgtctaggctgtagtagacagtgatggtgtttcatacattcagtagtcaaatcactgaggacctgtcatgtgctaggtacagtgccgactgtcatggaaacgagatggaaatacgccgactatcatggaaacaagatggaaatagagctccctgctctcaaggagcttagagaggccgagacaatcatgcacacagttgttatcagttaggtcatgtccataatgtgtgcagatgaacgttcagtgggtgtgtagtagaaagaacccctaatgtatctatggaaattaaaaaatcttatttagagacattttggatttaaataactttatgctcaggttgaattctttgtagtagattttgccacttttgccattggtcacctgcaatgaaaagcttcagggtaggtggcagtaaaccgatttccatggtatcaccagagtcctgcctgtgtgggcatcatttgctttatgcagcgtgtactgaaatgagagagaaagggggaaggaaggaaaaggggaaaaggaaagaaatctggcctagcacagtatcagatgcctacttcatttatcatttgtaaacggaccgtgggaagttcttggctctggaagaaaaggagggcggcgctgggtgagggtctggggtgggaagaaaggaagggaaggtgcatcccctcagtgcgtggggcagttgtgagtgtgaggctctgtgaagcctcggggctcagagagcttttccttttttcgttcctgagcgtgtaagtcttaggattttgtgtctgaaagtagcttctgataattaagtgaaaccagtgatcagaacctgtcttcaggagcagaatgtaagatgtaaataatgttcatttggaatgcttcccaattgtggtctctcttggttgcaaaaatagtgatgtggcagagggactacaggtttctgaagacaagctgcaggcaggactgtcgcctttctccttgtattacagagaggaggtgagacagtgtttctatttcagccatcccccctttccctttcatgcctccttagtcaccagttaccaggttatttgatttcaaaagtcttttttgcagataaattgttgaataacctcatttccatgtgaaacttcggttcccgtctccctacacgtttcttattttctattatcaatgagagaggaatgagtatatcatgcttaggggagctgagcaggaaataagctgttagccctaaatagaggaattaaaggagggtgttgacggcccaggaaagcagggcggcttcattgtggcagccctcatttgctggcctcaagaaacagccccactgtcggggctgtgtgggtgcagttctgtctccaggcctttccctgcaccgtgtcccacatgtggatgttctgccctgacttgtttcatgatgacatatcagatgtgctcatttggatccagaggagataacactgaaacctggattttgatcaagatgctatagtttgtaaaaatggattgtaaaataactagtgtctgtttgatacagaatttcagaaactgtggaggagtgtcactgtagattccatggacgaggagaaaattgaagaatatctgaagcgacagggtatttcttccatgcaggaatctggaccaaagaaagtggtgcgtaatctctagcaaagcagcttaatcccctgccctgggaactgttagcctgctccgctttctgccctctgaagagctgggagttgttcccccgccattgtttctcagtgtccgcagcccaggtcacatctgaggtattgcaggcctgcagacccgccctcggtgctgctccaggcctgtgagtgcctttctacacccagctcctcccaagcagtcctgctcttgaggtatagccatatggaaccttccagggcctgtgtgttccccactctcccactctaagctgctacaagcccttctccctattcttaaagggatgctgtgccttgatctgcacaacctttcagacttgaacggggccctcccctgctccgtgagcctcgccgtcctggtgcctggttctgccatagtaactttcaggtcctctaggaaccagatatttttgtccgtatagtctctaaatcctgctcacaggggatgttagtaattaaatgatgacttttacattgccttgcaccagcaaataaaatctgtagtctaagaacaaagcccggggggatgattcaccagcacccttgttagcagtgctgtgctcctcccccctttccttatccaccgtcatgcttcatagcttgtcacctgtgtctttctggggtgtggggtgggcatgtgtgtttggtgaatttttaggactcacctaaagggaagctttattgtcaatctctttccacaaatgagtgtaattgcagcccttcatgatttcgtattattgtctcatttgttaatgtttttcatcatgtgatgctaatatttcaagtatatagaaaagaatagagaatattacagaccttcatgtgctcctcctttctcaggattttgccatattttcttcagatctttttaaaatcggtaatggtggatacgtttttaaacctgatgacaaagacagagctgaagggcttcatcgtcccttttgtttgacttagtgcctagaaccattttggcaggtttttgtacctgctccttcattcccgatggcatctgcatctcaggggaacaaaggcccggggtctggtcagggcgtgtgctgtgccccatgtgtgctgctgggtggcagagcaggagaagggtccgaacctggcatcctcagccactggcatctgggcatgctcagaacatcctggccacaccacccctcagagcagctgttgtttctaattgtttttaccttttcctttaggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctgatttccatgggtcacgtgctggggatgtgatgaagcctgcagtctgcactgtgttgctgagcacatggatttcaccactggaacacaggtgtgctgcttgttagcaagcagagcaataaagatgtgctggatgtcattgttaatgttttcttttaaaaagaagcgtcagtgtcagccgggcaagctggctcacgcctgtaatcccagcactttgggaggctgaggcaggtggatcacgaggttaaaagatcgagaccatcccggccaacatggtgaaaccctgtctctactaaaaatataaaaattagctgggcgttggggcatgtgcctgtactcctagctacttgggaggctgaggcaggagaatcacttgaacccgggaggcggaggttgcagtgagctgagatcgtgccactgcactccagcctggtgacagaacgagactccgtcttaaaaaaaaaaaaaaagtatcagtgtccagcttcttgggtttggtaaattccaggatggcaagcctttgtagtgtctcctcgtcaacctgaacgtcagctataccatgcctccaccctcatgtggcctgaccggagatggttctggcggagatgccctctgtcaccggcccagctcatgagagccattaccaaatatgtgagtgttctttagagtgagggtgactcacgggaaattcacgtggttctgctttctacggcaaagtttgcattttcctcacctgcactgtttatgttctgctgtggtcctttgtgctggtggtcatggtcctcccgtcacagcatgggatagtagtggattaggaaacgaggtgttggttctcagaaaaggcatgatggaaacccagagcaggaagtgctttgtgcagacgacaaagaacctttttttgctttttcagttgttttctcttttctacttacctctcatccctttacagtgttatctgtttgctttacctctttcttacctccaagccccaaaacatggcaggagaggatgtaactgaggttcccacgataatttagaacacaggaaatacagcctgtcttgctttgtatcaggtttttttctggtaaggaagagctttaatatcttatggcatgaaactagctttcctgtaaaaaatctagagttagcttatctccaggtaggtacctacttttgtgatctccacactccatcttattttatgggccaggtctggaagtacagtttggacatctcatctgctttgcagggagatgggcatcagggcctccgtcgtgggctctgtgatcaggttctccatctctgtgataaggcgcttactgccagttgtgttattggttgtgacttctagcaatgcctgtgctcagcagtacttcgtgggctggcctgataattgatttcagttattttgtctaaaattcatttcagaaatgaagatctagcaaaatgaagtgactcactaaattgctgtactcaacaaaattccgtagctttatctcattcacttgcagtttcttttgttaagcctcgacccactcagtctactacatgtaagagcaaatcctccatataccccatctcaaggtactggggttgcatcatcgggtgacatgttgaggatacagtgtttgtgggaacattgatggaaggttacttgtgttggacggtcatattacaggcacacctcattttattgtacttgctttatgtgttttcacagatacagtggagtttcttttccatattgaaggtttgtgggaaccctgcttcaagcagatctgttggtgccgtttttccaacagcatgtgctcactttttggcaataatatattttaaattaaagtatataattggattctttaagacataatgctattgctcactttctactatcatgtagcataaacattttaatatgcactgggaaaccaaa

SEQ ID NO: 17208 - DNA, 26843 bp, Human
aatataattaattattttatggtatgtcatgctgtaatttatattacctcacccttactgatcttcagattgtgccctaatattttgcacctttgcttggaggataaagttcttagcctatatacaaaggaaagcctctgcggccctagcaacaatctacctctaaaagccttcattcagctttattttatttttagagacagggtctcactatatcgcccaggctggagtgcactggcatgatctcagctcactgcagacttgacctcctgggctcaagtgattctcccacctcagcctcttgagtagctgggagcacaggctacgccatcacgcgcagctattttttttttttagacaggtttagctatgttgcccagaggggtctcgaactcctgagctgaagcaatctgcctccttccgcctcccaaagtgctgagaatacaggagtgagctaccgcgcccggcctcaagctctaaactgcagcaataatcactggtagttcctttgcactcaggttcctaaacttgaaatcccacccttcccggacatccttgcccagattcctaacctttgaacacaacgtaggcgtgacttccttttggaaagccttttgcaagccttctgggtatggttctgcaacaccctgtgtatatctctatcatagcactcaggcactgcattgtgtttatttgcttacagggctatctttcccagtttttttttttcttctccatagaaccagaaagtcggataagctgagtttcttgaggacaaattcagtaacttgtaaatatttgaatatccaagagttgtagagtaccaaactgtggagctcaataaatttcagatgaactaaactgaatagtcaggtgggatgctagatggatgggtcaggaaaaagaattttcttttttcttgcaaagtgttgggattacaggcgtgagccaccgcgcttagccaggaaatataatttctttctttcttttttttttttttgagacggggtctcattctgtcgcccaggctggagtgcagtggtgcaaactcggctcaaagcaacctccgcatgcgggttcaagcaattctcctgcctcagcctcccgaatagctggaattacaggcgaccgccaccacacccggctaatttttgtatttttagtagagacggggtttcaccatatttgccaggctggtctggaactcctgaccttgtgatccgcccgcctcggcctcccaaagtgctgagattacaggcgtgagccaccgcgcctggccaggaaagataatttccaagtacgaaatgttgtagattgggaggacctcagtagcttgggagaagtgcacagtggtgagttataggacggcaatgaggtcatggaactatgaagtcaaggttaacaataacgcgtgcaggcaaaactgaaaaggggcggaacaaggggtagcgggtctccaggacctggcattaggacgtgcgtgttagggggcaggtatttggagccaggccccactttcgagttgtctttccgcaggaaccagagactgcggacggggccaggaaccaggaaccgttagggagataaggaaggtgttatagcccacattcatcctatacggccacaaggccggggggcccaggctgcctcctcacagcatcagctttttcttcggcttcatttccctctggaaagcgctttctcacagacgctgcaaagaccgaaggggcagcccctgccctgctaccctccagggagccaccgctctagagcccaggctcctctggacatcatgtgacttgggggacgacttgcctttcttctgaaacacggctacagactataactttaaaacacggggcttagctccccctcaataacgacacggccgtcagtatttaccacgttattgaccctctccagccggcccgcggcaagaagagttccacttccttcccggaaaacgcggccggaaggggcgggctttccgcctgcaccaggcgcttccgccaccatggcttcacgtggggttgttggcattttcttcctctctgctgtcccccttgtgtgtctggagctccggcgtgggatcccggatataggtaagtgtgattttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggtgtgatggttttacgtgtaagagggtagaggcaaagagcacaggggcaatcatagacagtgctttcgcatcctggcgaacactgaaaaggaaataaacaggttgataagatgaaggtcttgtgagaatttaggctgagaagttttttgttttgtttttagagacagggtctcactatgttgcccaggctggtctcgaactcctgggttcaagagatcctcctgcctcggcctctcaaagtgctgggattacaggcctgcgccactgcgcccggccctaggtttaaataaggggccacgcccgtgaaaagccagtgggggcagggaagggatgggggaggggaggaatattttaggcaaaaagattgtgacacgttggaggaaaaggtgaaggccattgtggctgaatcaaggagagttgggaggaggaggaggaggaattggctcaggataatgacgtttattgaacacctattataagccaaacaccaggtgctggttattatctcatttaatctgcactgcaatcagaggagggtaggcactattataatccccattttacagttgagggaactaaaatttagggaggttaagtgacttccctaagttttaaaaaggtcactcgattctgtatggagaatgctttggacagaagctatggtggaagcagtgaggcacatcaggctttggaagttgacaagtggtgatgatggcctggactagaacaataacaggagatgaaatgtagacagaattgggatattgacggagtaggatcaaccaacaggctttgtttatgggttgatgtttggggcaagggaaaggaaggattcaaggacgactgcctcatgggggactgagcaaacctaggtatttggtagtgctactggtaaaggggaaatggaaagaaaaactgtggagatgctgagaatcatgagttgatttttggacatttcagtgatcagtttacatgtctgtctccctttttaaggtcaattctaaagttagagaccataatgaaacttggctttgtgtactccctctctttctccacattttctccctgctcacaaggagtcagatgcctagaaatgttgcgtgcaataagaaatgaaaataaaatgctttaaaaaaatgtacaaagactgtcctgaagcttctcactcactcaagctgtgttggaatataacaagacctttatccaaaggatcagaaatgttgaattcacactcaccatttccgcaattcacctgttcccttgtcttttcaacatccacccctactctgctcatttattattttttgagacaaggtcttgctcagtcacccaggctgcagtgcagtggcacggtcatggcttactgtagcctggacttcccggctcaagtgatcctcccacctcagccttctgagtagctaggaatacaggggccacaccaccatgccttgcttattttttgtatttttttgcagagatgtggttttgccatgttgcccaggctggtctggaactcctaggctcaagcaatccacccacttcggccacccagagtgctgggattataggtgtgagccaccgtgcccagccagaaatatgcttcttgaaggcagagaccaaatggaatttgtttttgtattcccagcacttaccagtgtctagtttaatagaactagggacaagggttctataaattgcacctgggctcctggcagcatctttatctagttcttgaaattttcatgggattagcttctttctcagaattctgaacgaatgattgtttcctttggattgtttcctcttttcagttttctttttttaatatatattttttcctttttttttctgctacctttggattcttgatagtgagcttccaataattatttcttaacagtatttaagtctgttttatacatcatactttataccagcagcagggctggttatgcctatactgatattcagacatatattgaaaaactagccttgtctttttctactgtgtaaaaacctttattgtcaatacattttacttgtacttaagctagattttttttttcttttttttttttttgagacggagtctcactctgtcacccaggctggagtgcagtggtgcagtctcagctcactgcaacttccgccttctgggttccagcgattctcctgccttagcctcctgagtagctgggactacaggcatgcaccactatgcccgactaatttttttgtatttttagtagaggcggggtttcggtatgttgtgccaggttggtctccaactcctgaccttgtgatccacccgcctcggcctcccaaagtgctgggattacaggcgtgagccaccgcgccctgactaagctaaatattttaaggccagttcctcacgttgaagtacactgcttatggggtctatagtttaagtacacaaaaaaatcccagcactctgggaggccgaggcaggcgagtcatgaggtcaagtaatcgagaccatcctggccaacatggtgaaacgctgtctctactaaaaatacgaaaattagcggagcatggtggcgcacgcctgtagtcccagcttcttgggaggctgaggcaggagaatcgctggaacccgggaggtggaggttgcagtgagccgagatcacaccactgcactccagcctggcaacagagtgagattccatctcaaaacaaaaacaaaaacgaaaaaaccttaaaattttttttctttaaaggtatacacacaaatatagttctttcatattctcatgtgatgtttgcaaattgcttgttagaacgaacagcagtagtatggaacataaatcccacacctcagtggtgtttttttttttttttttttttgagacagagtcttactctgttgcccacgcaggagtgcagtggcacaatctctgctcactgcaacctccgcctcccaggtccaagccattatcctgcctcagcctcccaactagctgggattactggtgtgcaccactgtgcctggctaatgtttgtatttttagtagagacggggtttcaccatgttgcccaggctggttacaaactcctgagttcaagtgatccactcacctcagcttctcaaagtgctgggattatagacgtgagccactgcgcctggcctcaatggtttctttacataccaatactctagatattaaactacttttgtattggccagagataaaatagattaaattatgtgttgtattgaataacacctgaatcaacagttaatactggcaagttggaggagccgtgattttttttttaaagtcatacttcttctctaagcaactttaaattgctagggtttttaaagaatattgggccaagcaaggtggctcatgcctgtaatcccagcactttgggaggccaagttttctttttttaatatatattttttcttttttttttttttttttttttttgctacctttggattcttgatagtgagcttccaataattatttcttaacagcatttaagtctgatttacacatcatactttataccagcagcagggctggttatgcctgtactaatattcagacatatattgaaaaactagccttgtctttttctactgtgtaaaaacctttattgtcaatacattttacttgtacttaagctaaattttttttctttttttttttgagatggagtctcactctgtcacccaggctggagcgcagtggtgcagtctcagctcactgcaacttccgccttctgggttcaagtgattctcctgcctcagcctcctgagtagctgggactacaggcatgaaccaccatgcccaagaaaggaggatcatttggaaaaaaaatatatatattatctgatggcccacatctgtggtcccagctacttgggaggctgacatgggacgactgcttgagccctggaggttgtggctgcagtgagctgttatcaactgctgcactccagcctgggcaagagagtgagaggccatctgaaagaaaaaaaaaaaaaaggcaagaatatacatctatctgttttcagtttaaaataaaacatttaagtctatatatgtttttttctttttttttgagacagagtttcactctgttgcccaggctagagtgcaatggcatgatctctgctcactgcatcctctacctcccaggttcaagtgattctcctgcctcagcctcccaagtgtctggtattacaggcacccaccatcatgcctggctaatttttgtattttggtagagatggaggtttcaccgtgttggccaggttggtcttaaagtcctgacctcaggtgatccacccgccttggcctcccaaagtgctgggattacaggcatgagccatctcgcccggcctatatatatgtttttctgattccttctttaagttttagttaattgactaattaccagccttgatcacgttggattcctctgtatctctgccatttatcttttgaaaattaaaaacacaaaacgagtaaaaattccaagaggatggaaatcatttttaacccagctttgtttcctgtccctcaacatttgccaaattgtattatgcaaagtaggtagttagatttctgctcaaataattttcactttggttcttaatataacaccaaatactggctgggtgcggtggctcatgcctgtaatcccagcactttgggaggctgaggccagcggatcacctgaggtcaggagtttgagaccagcctgtccaacgtggtgaaaccccatctctactgaaaatacaaaactagccaggcatggtggtgcatgcctgtagtcccagctacccaggaggctgaggcaggagaatagctggaacccaggaggcagaggttgcagtgagccaagattgcgccactgcactccagcctgagcaacagactgaggctccgtctcaaaaaaaaaaaataaaataaaataaataaataaataaatagaccaaatactatatttttactttttcctccgcaagcatgtaaatcgtaattttacttacaagtgactaaatgtcaagaaataaagaagcacacagttgcacaatttgtgagaaataagaatttggtgtttcagtgagattatcatagaactagaatttgacacgatattttctttttttcttttttttttttttgagacagagtctctctctgtcgcccaggctggagtgccatggcacgatcttggctcactgcaagctctgcctcacaggttcatgacattttcctgcctcagcctcccaagtagctgggactacaggtacccgccaccgcgcccagctaattttttgtatttttattagagacagggtttcaccgtgatagccaggatggtctggatctcctgacctctgatctgcctgcctcggcctcccaaagtgctgggattacaggtgtgagccaccacacctgaccaacacgatgatattttcagttttatttctagttatgtaattttctctatatgggaaactacaacttatacattactgatattcataatatagtgtagctgatcgctctaattgtaactgtattcccaagatagtgtttattctagaattatgctctgtacatttgttgtggaaatgacaaccatcatgagttttttaatgcccaaaggagagtacagtaaaccctctgtatccctgagttccacattgagtatttaagcacctgtggattgagactattcagaaagggctgggtgtggtggctcacacctacaatcccaggaccttgggaggccgaggcgagcagattgcccgtgttcaggagctcaagaccagcctggacaacatggcgagaccccatctctacaaaaaatacagaaattagccgggtgtggtggtacgtgcctgtagtcccagctacttgggggcactaaggcaggaggccctccttgagccccaggaggttgaggctgcagtgagccgtggtctcaccattgcactccagcagcctgggtggcagagcaagaccaagaagagcaacaccctgtcggccgggcacggtggctcacgcttgtaatcccagaactttggcaggctgaggcgggcggatcatgaggtcaggagatcgggaccatcctggctaacatggtgaaaccccgtctctactaaaaaatacaaaaaattagccaggcgtggtggcaggcacctgtagtcccagctcctcgggaggctgaagcaggagaatggcatgaacctgggaggcagagcttgcagtgagccgagatcatgccactgcactccagcctgggcaacagagcgagactctgtctcaaaaaaaaaaagaagagcaacaccctgtctcttaaaaaaagaaggaaaaaaaaaagaaaatattcaggaaaaaaatggataaatggatgtttgtctgtctgtcccgaacatctacaggcttttttccccgtcgttagtccataaacaataaagtatagcaactatttatagagcctttacattgtattgggtagtatatgagtcatctatagatgatttaaagtatgtgggagcatagactgtatgcaaacactgtgccattttatatcagggacttgagcatccgtggattttggtatactcaggagtcctggaaccaataccccatgaatactgagggatgactattatatgaacaaaatcataagacagttgtataacttctactatacttttccagtacaaataatcttctaatgtgttataatttattaggagtatcaagaaaaatgttttgggttgggcatgttggctcatgcctgtaatcctagcactttgggaggccaaggcaggaggatcacgtgagctcaggagttcgagaccagcctagtcaacatagtgagacctcatctcttaaaaaaaaagttttgaattttaattttagtttttttcctttatcaggaatcaaggattttcttttgctttgtggccggattttgctactgcttgctcttcttactttaattatttctgtgactacctcatggcttaactcatttaaatctccccaagtttatctgaagggtaagtttattatttattctaccctgttataccattctactctaatttatttattctagaactttgcacagtaagagccattttactattaatttgtgatgtgtagtttcagggagagtaatcagtacaactttagtcatgattttttgtgttggtttttaaacattagtgatgattgttttgcatggagtatatcccaacatttttatgagaaattgtacatttttcttatatatgtgttttaaagctatatcatttctaagttgttatatggtaaattccctaattttaaattgtgtgtttgtgctgcttaactgccatttgatacctacagtttatgagctgttctacagagtcaatgtatctaccattaaacttttttttttttttttttgagatggagtctcactctgtcaccagctggagtgcagtggcatgatcttggctcactgcaacctccacctcctgggttcaagtgattctcctgcctcagcctcccgagtatttgggactacaggcatgcaccaccatgccagctaatttttgtattttttgtagagacagggtttcaccatgtttaccaggatggtctcgatctcttgacctcgtgatccgcccacctcggcctcccgatgtgttgggatcacaggcgtgagacaccacacccggccaatctaccattaatcttgaaaggcttttcatcctaatgttttattccattctagcagtttttacttaggcacctttgtcttttatatgtaaatgtttttaattttaggaaatcatgcttgtttttagttttttaatttgagacagagtcccgctctgtcacccaggctggaatgcagtggcgtgcttggctcactgcaacctcctcctcccaggctcaagtgatcctctcgcctcagcttcccgagtagttgggactacaggtgtgtaccactgcacctggctaatttttgtagtttttatagtttttgtagaggtgggatttcgccatgttgcccaggctggtctctagctcctgagctcaagtcctgcctcagtcgcccaaaatgctgggattacaggcttgacccacttcacccagcctgtttgatttttgataagcaaaagtttgtgagtcctagaagccttttaaaataatattgtacttagcctcagaataggtgaatcttaaaaccaaaaactacatattttctatgctactaggaagaagcttgtcattagtgaatttggtacattgtgttttgtttcactgtttattaaaatgtaagtaaataaaaggaaagtgaccagtatttaatgtatagccctttcaaattaactgtgaacaaaaccataatcctaaaaggttatactattcaacccaaacataaatgacaatgtgatgtgttagggtctccccatcatagactttagatttttttctttcttttgatacattatttgattggttgtacttcaaataagatacttgggaagtaaaaagcacttttatgttttgatgtcttagaagaagaagaaaagaatgagaaaagacaaaaacttgtgagaaaaaaacaacaagaagcacaaggagagaaggtaaggcagaatttttagagactttatgcgtagagaaatacaaaaatctctgaggcaattaaaattaagggctgttgcttctgtcttggtgctaagattttaaaaaatatataatgaggtcaaattcacgtgacataaattgaccattttattttacttatttatttttgaaatggagtctcgctgtgtcacctaggctggaatgcagtggcgaaatctcggctcactgcaatctccacctcccaggttcaagtgattctcctgcctctgcctcccgagtagctgggattacaggtgcgcaccaccacacccagctaatttttgtatttttagtagagatgttgttttgctatgttgaccaggctggtcttaaactcctgacctcaggtgatccacctgcctcggcctcccaaaatgctgggattacaggcatgagccaccatgcccagccaaaactgaccaagctgttcagtgacatttagtacattcacaaggctgtacaactaccacctctgttccatcttctgtaaagaaaaccgtatactctttaaacagtcactccccactctgccctcatcccatcctctgaaaaccaccaatctgctttctgttggtatggatttacctattgtggatgaataatattccattgaatagatataccacttttttttttttttttttttgagactgggcctctctctgttgcccaggctggggtggagtggtacaaccatacctcactgtcgcctcaaattcctgggttcatgggatcttcctgcctcagcttcctgggtagctggaactacaggcacacacacaccaccatgctcagctaatttttaaaaaattttgggccaggcgtggtggtgcacgcctgtaatcccagcactttgagaggctgagacgggtggatcacgaggtcaagagatcgagactatcctggccaacaaggtgaaaccctgtctctactaaaaatacaaaaattagctgggcgtggtggcaggcacctgtagtcccagctacttgggagactgaggcaggacaatcacttgaacccaggagccagagatggcagtgagtggagactgcaccactgcactccatcctgggtgacagagtgagactccatctcaaaacaaaaacaaaaacaaaggatgttggcttccctctccagatttaagatctgaaattctaaagatggcacttggtttcccatttgtgacaaatccttggagttgccataccggcattcaatttgaatcaggataggaaaagtagatcctcccattctctcaggaaatgggattgttcccagcatgaaaaccacaacctggttgatactgtcataatcaggcaggtcaaaaacaaatgcctgtcccgcttgctgtccagctgtcggcacgagcctccccacaaccaagcagccaaacagggtggcagtggctctgttcagccagcagggttcttacttggttcttatttacaactttatagacagtgtacatttttaggaacattaatggatagtaacaacacctaatttgttgttttcaacaggccagcagatacatagagaatgttttaaaacctcaccaggaaatgaaattgagaaaactggaggagcgcttttatcaaatgacgggtgaagcctggaaattaagcagtggtcacaaacttggggttggaaaatattctcattttatattttgaatcctcttactatgtttcctattacatgattgatttttaattgaaaatgatgttagactgcttttaggagtttttattgataatgattatcagtttttgttcagcatacttgtttattacatggttaaggggttggtcgttttttttttttttttgagatggagtcttgctttgttcccctaggctggagttcagtggcacaatctcggctcactgcaagctccgcctcccaggttcatgccattctcctgcctcagcctcccgagtagctgggactacaggcgcctgccaccatgcccagctaattttttgtatttttagtagagatggggtctcaccgtgttagccaggatggtctcaatctcctgacctcatgatccgcccgcctcaccctcccaaagtgctgggattacaggcgtgagccactgagcccagctggtctttgtttttaaaagacagtctctctctcttgccctggctggggtgcagtggcacgatcatagctcactgcagcctcaaactccagggctcaagggatcctcctgcctcagcttcttaagtagctgggactataggtgcaccctaccatggactgcacctggctggttaagtggtttttggtgcctaaagagcatataacttggttccttaaaaagctgttgtggtggctaacgcctgtaatcccagcaatttggaaggatgaggcaggcagattgcttgagacgaggagtttgagaccagcctgggcaacataggaagaccctgtctctacaaaaaaaaattaaaaattagccagacgtggtagtgtgtggctgtagtctcagctacttgggaggttgaggcaggaggatcacttgagcccaggaggtcaagaggctgcagtgagctgtgactgtaccactgcactctaggctgggagacagagcaagaccctttctccagaaaaaaaaaaaaaaaaaaaaaagaagactgactgtgacataagatagtctttaaaactgtcaaataaattgttattgtcttatatgaggacaagaatattctgatctttcctcaagtcaagatctccaaggtattaagctcaggttatatatgttattatatattatatattctgatttttaagtcaaattaaactttggttatgttttccttcagcattgaatatgaattttgtcagtttctatagaagtttacaattttaaattttcttttttttttttttgaggctgagtctcactctgtcgcccaagttggagtgcaatggcaccatctcagctcaatgcaacctctgcctctcaggttcaagcaattcttctgcctcagctaatttttgtttttgagacagagtctctctccatcgcccaggctggagtgcagtggtgcgatctcagcttactgcaacctccgcctcctaggctcaagtgattttcctgcctcagtctcccacgtagctgggattacaggtaactgccaccgcgcccagctaatttttgtatgtctttttagtagagatgggatttcaccatgttggccaggctggtctctaactcctgacctcctgtgatctgcccacctcggcgttccaaaatgctgtgattacaagcgtgagccaccatacccggccaatttttgcatttttttagtagagattgggtttcactgtgttaggcaggctggtcttgaactcctgacttcaggtgatctgccctcctcagtctcccaaagtgctgggattacaggtgtgagccatagcacccggctcaagcctcgtgttttcctgtccacggagataatgctttaattttttgggtctcataatggcttgctaatatttttctactgatatgccatcagggtaaaaaaaggaaaaaggaaaaacaattgtgaatagaataaagttgatagaaaacatctctttagaaattgtctgttgtgtttgaccagggtgatgaaggtacaagtcagacatcttttgaaacatcaaacagagaagcagcaaagagccagaacttgcctaaacctttaactgaatttccgtctcctgctgaacagcccacatgcaaggaggtaaagtacttcatgcctctcattgaattgtgtctgtgtgcagtaggagtattgaactctgggtgaggtggtatactgggtgaagatcaggactggcctttcatccagatggtgtcttcccactgccttacaaagcaatcaccccagaataggccgggcatggtggctgacacctgtaatcccaacactttgggaggccgaggccgatggaggttgaggccaggagtttgagaccagcctggccaacatggtgaaaccccatctctatttaaaaaaaaaaaaaaagaataattttccctgttcaatattaatgatgttctgaatccaacttggaagcaataaagacaaatgataataggtttagaaaatactcaattcttagccaggcactgtggctcatgcctgtaatcccagcactttgggacatgaaggcaggcagatcacctgaggtcaggagttcaagaccagcctggccaacatggtgaaaccccatctctactaaaaatacaaaaaaattagctgggcgtggtggcaggcacctgtaatcccagctactgaggaggctgagacaggagaatcgcttgaacctgggaggtggaggttgcagtgagccaagattgcaccattgcactccagcctggacaacagtagtgaaactccatctcaaaaacaaaaaacaaaaaacaaaaagggctgggcatggtggctcatgcctgtaatcccagtagtttgggaggccgaggtgggtggatcacgaggtcacgagttcaagaccagcctggctaagatggtaaaaccccatctctactaaaaatacaaaaattagccaggtgcagtggcaggcgcctgtaatcccagctactcaggaggctgaagcaggagaatctcttgaacccagcggggtggaggttgcagtgagcctagattgcgccactgcactccagcctgcgcgacagagtgagactccgtctcaaaaaaaaaaaaaaaaaagaattgatattttttctttgtttttttgagacggagtctcactctgtcgcccagactggaatacagtggtgaaatctcagctcactgcaggctctgcctcctgggttcacaccattctcaccattctcctgcctcagcctcccgagtagctgggactacaggcgcccaccaccccacccagctaatttttttgtatttttagtagagacggggtttcaccatgttagccaggatggtctcaatctcctgaccacgtgatccgcccgccttggcctcccaaagtgctgggattacaggcgtgagccactgcgcccagccgaaaatactcaattctttttaaggaatttgattatgtaaaaatgaaaaatataatgcttacgaagggaagcattcctattaacttaagaacattatcaagccctatcttgtgagtggctaatagctgttattaacatgagtgtataattttccttactggcccttctagggaatagattagcaatcagtcactttggattagtgcccaggtttattatacatgttgttcattcaaatcttcaatccttaactaagttaattccaattggagctggaaaagattagaaataagaaatctgtttttactggcccttagggaaagctgggaggctgtctattccctgaaaatagtttctaagatattgcttctcaatctgagatttcctggtcccatagtggagattgagcaggggaatcagattattgaactatcactgacctttgaaaaagatcgatatgaactaaacggactgattaaaaattcatgtttgtgttttgttaatgacactgtcttatgctgatggcagattttacttgacagtcacatatgcttttgataccaaaggaaaacaaatgagttatttagcaaatgcaggtaaggttagattaaatgttataaaatatactctatggtattaataaagagttcctggagatgaagtcattggtaacaaatgttttttttttttgttttttttttttttgtttttttttttgagacggagtctcactttgtcacccaggctggagtgcagtggcgtgatctcggctcactgcaagctcctcctcccggcttcacgccattctcctgcctcagcctcccgggtagctgggactacaggtgcccgccaccacgcccggctaattttttgtatttttagtagagacagggttccatcgtgttggccaggatggtctcgatctcctgacctcatgatctgccctcctcggcctcccaaagtgctgggattacaggcgtgagccaccacgcccggccacaaatgtcttaatgaaagaaaatggtctaaatatctggattattttatttttatttttttgagacagagcctcactctgtcacccaggctggagtgcagtggcacagtcatggctcactgcaatctctgcctcctgggttcaagagattctcatgcctcaacctcctgagtagcaggattacaggtgtgcgccaccacgcctagctcatttttgtatttttagtagagatggggtatcaccatgttggccaggctggtctcaaactcctgacctcaggtgatctgcctgcctcagcccccgaaagttctgggattacaggcgtgagacaccacacccagcccaatatctggattcttaatagattaatggaaatagggaaacatgagtaaatgacaaaagcaaccaaagtgaatggtttctggcagtcacctaggagtgtgagtgacaaaaagttcatattcatgttaaaatgtgtatatgggccgggtgtggtggctcacgcctgtaatcccaggactttgggaggctgaggcaggcggatcacaaggtcaggaagtcgagaccatcttggctaacacggggaaaccctatctctactaaaaaatacaaaaaattagcggggcatggtggcaggcgcctgtagtcctagctacttgggaggctgagacaggagaatggcctgaacccaggaggcagagcttgcagtgagccaagatcgcgccactgcactccagcctgggcgacagagtgagactccgtctcagaaaaataaataaataaaataaaataaaataaaataaaataaaataaaataaaatatgtatatgtttgaagcaaaataattttggggtcttactgaattttcttttcttttttttttttttttaagatggaggcttgctctgtcacccaggccagaatgcagtggcacaacctcagctcactgcaacctctgcttcatgggttccaagcgattttcctgcctcagcctcccgagtagctgggattatgggcacccgccatcatgcctggataatttttgtatttttgtagagacggggtttcaccatgtgagccacgctgatcatgaactcttgacctcaagtgatccacctgcctcggcctcccagtgtgtcgggattacaggcatgagccactgcgcccagctgatacatgttaacatttatcctgtttttatatgtatgtatgtgtatatgcatacacaatcatatatatatatatatatatatatatttttttttttttttaaagtgacagggtcttgctttgttgcaatggttggccttgaacttctgagctcaagtgatcttcctgcctcagcctcctgagttgctgggattacggacatgagccactgcatctggcttgcttttttacatagtgcatttttatatattagtaatattttggaacataatagaagcaaaatcctttaagtatgtatagattgggagctattatctcaaatcctatttttatgattaatttttagcacacttgcccaaaaatgtttattaattgaactattttcattataaactctttatagatgtatgaagaaaagatataagtaagcttagatgtgtgtctaaactctgtattgagaggaactcttctcattgacacttttgcttgttgaacatgtttacattcctcttaccaatacttttctttagattcctgatttacctgaagaaccttctcaaacagcagaagaagtaagtctatttttctcttcgaaaattaaacttattttctattttctttgcttaacatccattaaatatgtcttatctaaacttgggtttagaaagaagtgatagcataagtgttcatgtgattatactgtaactaggtcttttttagaacatagagacagggtctcactatgttgcctaggctggccttgaactcctgggctcaagtgatccacccgcctcagcctcctgggtagctgggtcttacttggaatgtagtgtagtatcaaattcctcaacatgagtactattttgcaagcctgctgtctgctgagttgtctttttttttttttgagatgaagtcttgctcttgtcacccaggctagagtgcaatggcatgatctcagctcactgcagcgtccgcctcctgagttcaagtgattctcctgcctcagcctcccaagtagctgggattacaggcatctgccaccacatcgggctagtttttgtatttttagtagagacggggttttaccatgttggccaggctggcctggaactcctgacctcaagtgatctgcctgtcttgacctcccaaagcgctgggattacacccacccactgcctcaggcataggacacgtgggcttttccagaactttaggtcagaaaatgcgttgcttactaaaacagaatcaaaataggcatatgtccgagcactttgggaggccaagaggggaggattacttcagcttaggaattcaagaccagcctgggcaacatagtgagacgctgtcgctacaaaaaggaaaaaaaaaaggaaaaaaaactaggcaaatgacttcaaattgcagttctccttttcaaaggagaaaatgaagagggcgactactttgtagatgttttaatttaggggtggtttgctgttgggggctgggctgggactgatccccaactgtgtcaagctgtcttcttcccagttgctgggtcatagtccgtgatgccttcctgtcactggccacccaacttatagacacttcctaatgtatggggagcacatacgtgtcttgaaagccattaagtcatttgggcaataaatccagaaggagaacctacttcttggggctcggcaacagttatactccttggaaaccttttttttttttttttttaaagagacaggcttttgctctgtctcataggctggagtgtcttggcacgatcatagctgactgcatcttcaacctctcaggctcaagtgatcctcctaccttagcgtcccaagtaactaggactgcaggcatgtgccaccagccctgactaatttttaaattaaaaaaaaattttttttggtaaagattgggtctcagtgttttgctcaggctggtccgactcctggtctcaagtgatcctctcaccttggcctccccaagtggtgggattataggtgtgagtcactgtgcctgatgggaaagttttttgtttttgtttttgtttttgtttttgagactgagtctcaccgcattgctcaagctggagtgcaatggcacaatctcggctctctgaaacctctgcttccgggttcaagccattctcctgcctcagcctcctgagtagctaagaccacaggtgtacgccacaatgcctggctaatatttgtatttttagtagagatggggtttcaccgtgttggccaggctggtcacgaactcctgacctcaagtgatccgcccaccttggccccccaaagtgctgggattacaggcctgagccaccgcacctggcctgattggaaatattttctaacatagctttcctgagagggaggggtgctgctctaaaaccaccacttatgcctaatatgatacccacataactcccagcacagttaatgatcatgttagtcataaagggtttcttgacaggtgaaaaataaacactaatgtgttatcttctcattttataatgtcttttttttttaaaacagagtcttgctgtgtcatccaggctgggtgcagtggcgtgatcacagcttactgttgcctcagattccctgggctcaggctattctcccacttcaacctcccaagtagctgggactagaggcgtgcacccacatctagctaatttttctattttttgtggcggggggtgtctcaaactcctggcctcaagtggtctgcctgtctcagcctcccaaagtcctgggattacaggcgtgagccaccaccatgccctacctatgtcttttaataattagcaaagcagtatctaagtcctttttagctgcttagctgttttatggaatgaaaggaattgcaaagagcaatggatcggagttcttatgtgaatatttcttccttaggtagttactgttgctctccgatgtcccagtgggaatgtcctgaggagaaggtttttgaagtcctacagctcacaggtaagtgaaggaattcacattttgagaaatatctttgttgaatatggcagtagtttattcacatgccgtgggggaaggtgtgatcacactgtcatctgcacctcccatcaggtatggataaaggacatttccaggtactccacgttgcagaaatttggctaactaggcatgcctgccggatgtctctgaattgtgatctctgcattcacattttactcattctttccctttggtgtatttttcctttgttgtttgctttcattacattctcataatttgatgggcaagatgcttttaaatccttaggaagtagccactattaactttagacttttttttttcttttaaaaacaatactgtggcctgggtgcagtggctcatgtctgtaatcccaacactttgggaggccaaggcgggcagatcacttgaggtcaggagttcgaggccagcctggccaacatggttaaaccccatctctactaaaaataagaaaattagccgggcatggtggcggatgcctgtaatcccacctactcgggaggctgaggtgggagaatcacttgaacctgggaggcagaggttgcaatgagccgagatcatgccactgcactccagcctgggtgacagagcaagatcctgtctcaaaaatactaaataataaaaacaatactgtggttgttagtgataatttggaaaacatggaaaagtagagcgagaaaaaaatttgatctgtagtctcatgccaaaaccagttactaacattttggtatatttccgtctctaagtacatttaaacatataattatgtgtgcattaaaaatatatgtaaataattttctgtcctgtttgttgtatttaaccttcaatgacaagaatgctataaaccgtaatggaaaatactggatttgactacataaaaattccggccaggtgcggtggctcatgcctgtgagtagctgggaccaggcacacaccaccgttcctggctaattttttatttttagtagaaatggggttttgccatgttggccaggctggtctcaaactcctgggctcaagtgatccacccaccttggcctacccaagtgttgggattacaggcgtgacccaccacgaccagcccattttactatttatgtatgatagttattttttataaggaacttaaatcaaggaagagataaacatctcagaagactggcagggaaagaaacacatgaatatcatgatttcccgaagaagactcagtgatagataaatatatgaaaaaaatgtttggcctcacatagaatcaatgaagtacaaataaaatgaaacagtattttctacttaactagactgtcaaagattaaaaagaaatagtacccagatttggcaaatgtgttgggaaaacagggattcttaaaactttaatagttttttggctgggtaccatggctcacgcctgtaatcccagcactttgggaggctgaggcaagcggatcatgaggtcaagagatcaagaccatcctggccaacatggtgaaaccttgtctctactaaaaatacaaaaattagccggacgtggtggtgcgtgcctgtagtcccagctactcaggaggctgaggcaggagaatcgcttgaacccaggaggcagaggttgcagtgagccaagatcgtgccactgcactccagtctgggagacagcaagactccatcacaaaaaacaaaacaaaacaaaacctttaatattttttatttttttttaaatagaacaggtctcactatgctgaccaggccaatcttgaactcctgggctcaaatgattctcctgcctcatccttccaaagtgctgggattacaggtgtgagccactgtgcctggccatcataacttgttaatgtgaatgtaaataagatcagtgttcctgacagataatttaccattatttttatttatttttgtaagattggttctcactctgtcaccaaggctgaagcacagtggtgcaatcacagctcactgaaacctcaagctccccggactcaggtgatccttgcacctcacctcctgagtatctgggattacaggcatgcaccaccaggcctggctaatttttgtattttttgtagagactgggtttcgccatcttacccaggctggtctcaaatttctgtgccattatatgtttcgggaaaaaaaatttcatatatatatatatatgtgtgtgtgtatatatatagttttgagaccgagtcttgctctgtcacccaggctggagtgcggtggtgggatctcggctcactgcaacctccgcctcctgggttcaaatcattctccctcctcagcctcctgagggcctgggattacaggtgcccgccaccacgcctggctaatttttggctgggcgcagtggctcacggccataatcccagcacttcgggaggcccaggcaggcagatcacttgaggtcagaagttcaagaccagcctggccaacatggtggaaccccgtctctactaaaaatacaaaaattagctgggcatggtagtgggcgcctgtataatccaagctactctgaaggctgaggcaggagaatcgcttaaacccaggtggtggaggtttcagtgagccgagatcatgccatcgcactccagcctgggtgacagagcgagactcccatctcaaaaaaaaaaaaaaagaatattcctatctctgaactcatggcaagctattttcctttaagttctagaaagtttctttgaaaggtatgaaacttctgtctcattactcctagggatatgattttacattgacaaaattataaaatgttatggtggtctaaagggacatggtgtgtaaagtatttgataatgactaagccaagcttttcatcttctaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaactgtatctatctcatcatttccctctcttgcttataagcctataatgataaagtcatgcactgtaacaccaagttcagacaccaaatgtggtataaaaggcttttaactttgttctactcactccttttttttctcatgctctgttttaaaagtctgctcaggccgggtgtggtggctcacgcctgtaatcccagcactttgagaggccgaggcgggcagatcttgaggtgaagagattgagaccaggcagggcacagtggctcacgcccattatcccagcactttgggaggccaaggcgggtgggccatgaggtcaggagttcaacaccagcctggccaagatggtgaaatcccatctctactaaaaatacaaaaattagccaggttgagtagcaggtgcctgtaattcccaactacttgggagactgaggcaggagaatcgcttgaactcggccagcagaggtttcagtgagcttagatcatgccactgcactccagatggcgacagagtgagactgtgtctcaaaaaaaagaaaaaaaaaaagagttcaagaccaccctgaccaacatggtgaaaccccatctctactaaaaatacaaaaattggctgggcgcagtggctcacgcctgtaatcccagcacttttgggaggccaaggcgggcagatcacgaggtcaggaaattgagaccatcctggctaacacagtgaaaccccgtctctactaaaaatacaaaaaattagctgggcatggtggcgggcacctgtagtcccagctactcatgaggctgaggcaggagaatggcgtgaacccgggaggcggagcttgcagtgagccgagatcgcgccactgcactccagcctgggcgacagagcaagactctgtctcagaaaaaaaaagaaaatacaaaaattagcttggagtggcagcgtgcgcctgtaatcccagctactcgggatgctgaggcaggagaatcgcttaaacccaggaggcagagattgcattgagcctagatcacgccactgcactccagcctggcgacagagtgagactcatctcaaaaaaaaaaaaaaaaaaaaaaaaaaggtctgctcatctggctctcctgggcattccctttatacccttctgtagaattcatcacactgtattatagctatgtcttgttttctcaataggcaattcctcaaaggcagggactgtcttttttgcccccagaagtacctactgtatgttagatacttaatacttctttgaaaataaacagtaagttgtctcaaccttaaattaggggtgggagggcaggttggttctagaatatctcacaccaaaaaaaatgaggccaagcgtggtggcttatgcctgtaaccccagcactttgggagggcaagatgggcagattgcttgagcctaggagttcaagaccagcctgggcaacatggtgaaaccgtgtctctacaaagaatacaaaatacaaaaattatagaatacaaaaattagccaggcatggtggcacatgcctgtagtcccagctactagggaggctaaggtgggaggatcacttgagtctcaaaaaaaaaaaaaaaaagtggtagtacatcacttctgagattaggttataatagaccatggctgtcctggtggtctctcttgggtccctcgctctaggggaagaagtcctgttagtggccccatggagaggcccacacagcaaggaactgaagcttcctgcccacagcaacgagagaaagcttagaggtagccctcaggtcccagccaagtcttcagagccggccactctggccaacagcttgagtacaactgcacgcaagccgcaagccggaaccactgggctaggatgctcccagattctgagctctgaggatttgtgaggtaatttgtgaggcagctaagttttgagttcatttgtaatggagcaatatataacagatttgtgtatctgttagcaaggtgctgccataacaaaaccctccaatgcagga

SEQ ID NO: 17209 - DNA, 35489 bp, Human
tatgtatggaaactggtctgagtgtcctgacttaccagttaccttgtgccataccttagaaacaagggacctgtccaggcttccttctgatggccaacccacttctaatgttggccaatctatttcacacaaagttctaagtttccctggtgtcatagtaaccccatagtcgccattaaatcccttcttaaaatttttcaacatagttcctagaggagtaggcttattttgtgtctgacctgtgtttcctcaagacaaaacaccaagctcacaccaaacgcacaccacaaaacaaagaatgggtaaaaagggcacacacgcactttttcagttttcaccaaaccagaatcaaaaccaaaatcagagtatccagtaatccaagccaggtcaaaccaaaaccaaagtgtcaagcaattcaagtcaagtcaaaaacaaaaaccaaagtgccagtacaggcacgccgtgggtgatcaggccatgcttccactcaaatggagtgggcaagttccgaagaccagtcttaccaagtttcaaatgtccggactccaagtgcctgttccttcccggtgttcagccactgcgttgatactccacgggggcctgccacgcactgctctgactaggcgttccaccggggcaattgcctacccaggagcgctcgcaggatccgcgtcgctcaagctggcgggagttccccgcagggatgctccacagggcaggcctaagccccctaaggggctgcctcgactgtccgtcaattacctcgcttcccagtcagggaaccaagaaatatagcaggatgagtcacagacaaaactcctcagacaccagattaaagcaggaagaggttttttattcggccaggagcgttggcagactcgcgtcttgagagccgagctctccgaaaaagaaattcctagcccttttaagggcttacaactctaaggggtctacgtgaaaaaatcataatagatcaagtaagcgtgggaaacgtgactaggggctatatacatcagctaacagaacaaaaagttttacagtgctttctcatacaatgtctggaatttacagataacaccaatagttttggtcaggggttaataatattattattatcttagccaccagggccaggtggtggtgccaaggtcgtctagctatttatcttacttctgtttctttccaactttttgctttctcccttttctcctgtcttataaactagggaaaaggggaggttggggagaaactgagaaggacaacaggagaagtggtgacctcataccataatcctagcattttgggaggccgaggtgagagaatcgcttgaggccaagagttccctaccagtcctggtaacatagtgagaccctatttctaaaaaaaaaataaaaataataaaaaaaataaaaaaaaaattaaataaataaataaataaattagctgggcgctgtggcgggcacctgtagttcccagctaccgggaaggctgaggagggaggatcgctgcttgagcacagtaggtggaggctgcagtgagcagagatcgcatcactgcacccctgcctgggggagagtgagacccagtctcaaagaaaaagcaagaacaaacaaaagtggtctctggaacaaacctggacaaacaacccttcgaatagaggcaaatttctcttcctggagaagccgtgccactggcaactccccagggggccagctcgggaaaagccagctgaaacgagaggacgttcaccgttcctcgcctcgatccaccggacttcagaaggctacacgcggcaggcgccgctcgggatccaggggccggggtgagaacggaggcggagaaacccctcaggctccgccaccggggcggggaactgggaggcggccccgcctctgggcatcctcctgggtcttgcctagcggcgggcgcatgcttagtcaccgtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgagtaccgccggtttgttcgggcggggggcgcctctttgtctcggtctttcgggggacagcctgtgctcgttcctatggcgatcctgtcccccggcgctgggctttcctcttttccacccccgcaactccccattccgaagccaggaacccagcaggtggaggagagagaggcgtccgggggcttctctgcggcccgcaaagccgagccagcgtctgcttccgcacggatgcgatattgaccagggccggggcgggttagattaaccttcctccatcctcacttgtccaagtgggagaggattggattctgttcttgaccgcgtgaaacacaaaactgcatctgggaacattgctggtggcctgtgtgtagggacgagggtgacggtgccatagatcctggttcttgaaaaatgtagatcctggttctcccgtttcaagggcagaatgatttatagcggttgttgtcaaccttggctacacattcgaatcacctgagggtgcctggattcccgacttaattggtctgaggtgcacttgggctttgggatgtttcccgacttaattggtctgaagtgcagcctgggctttgggattttcgggtgatctgaattgcagccaaggcgaccttgagtaggtgagttctcagagcttttgttttgtcttggttttatgtggattgcaaaactaaaaacagagggatgtaaatcctgagatttacaaaattcataatttttgaaaataagggtttttgtttgtgtttgttttttgagacagggtcttgccctgtcacctaggctagagtgcagtggccatcatagctcactgcagcctcgaactcccgggctcaagggatcctctcaccttggcctcctgagtagctggaactacagggggctaatcaccacgcctagttaattattattattttttgtagagatgggggtctcgctatgttgcccttgctgatttcaacctcttggactcaaccgatcttcccgcctcagcctcccaaagtgctgggattacaagcctgagccactgcactcattctaaaaataaatgttgtttccaagttattggtgtgcccgcccttttctatcacaagatttgggtgttgacgattaaaatgctgtatccaagaggaacctgggatttgggataggttctctaaattcctttggagatgaatatttaaattatgtcaaattgggagctctttaaggacagggatgggcttctgtgtttgtgtgtctcttatcaccttaaaatcccttgctcaataagcacttgtgcaatgaatgaaactaaaaatggacagttatgaaaaggttgacttcattgttcagtgccttggagatgaacatggagatgaagagaaaggaaaaatctctgttaattatcaacttgcactttgacaccatagtccagacagaaggttagaaatctgtctctccagaaggcagattgtggggtgccactaagtgcccccctcccacacctcatgagagtacttgatcacttctcacttctgttctgctctccacattttctctgtcttcctctttctctacttatgttataatgtgcttcagaggttcacccactttaccttcctgttatgaattctttttttttttttttttttgagagggagtctcactctgtcacccaggctggagtacagtggtgcaatctgggctcactgcaacctctgcctcccaggttcaagcagttctcccgtctcagcctctcgagtagctgggaatgcaggtgcatgccaccatgcccggctagtttttgtacttttaatagagatggggttttgccatgttggccaggctggtctcaaactcctgacctctggtaatccacccaccttggcctcccaaagtgcttggattacaagcatgagccaccacacccagctaattttttatttttaaaatgtatttatctatttttttttcgatatggagtcttgctctgtcacccaggctggagtgcagtggtgcaatctcggctcactgcaacctccgcctcctgggttcaagcaactctcctgcctcggcctcccaaattgctgagattacaggtgccactacacccagctaacttttgtatttttagtagagccaggctggtcttgaactcctgaccttgtgatccgctcacctccgcctcccaaagtgctgggattacaggcgtgagccaccacgcctggcctgtttttattttatttattgttttttagaaacagggttttgccatgttgcccaaactggtctcttatgcctgtgcttaagcagtcggcctgccttggcctcccaaaatgctgggattacaggcatcagccaccactcctgtcccattttttgtattttaagtgctgggattgggggtgggtagggagaaaacgatagatataaacatttgtgagacatgtcccttcccttaaggaattttgtggttgtgaaagaaaaaaatattggaaccccaaagtatgccagaaggaaagttcagcttgggaactgaatcacacaaatactgcttttccttttgttcccaaacagacagctgtaatttcacaatcccatgtcatagccttatctcctctactcctgcttttcacttttactttatcttatgtaaaatgtagatttactgaggctcataagaacctcacaagaatgtaaccatctaggctgggcgtgatggctcacgccagcactttgggaggccgaggtgggcagatcacctgaggtcaggagttcgagaccagcctggccaacacggtgaaactccatctctactaaaaatacaaaaattagccgggtgtggtggcacatgctacttgggaggctgaggcatgagaatcacttgagcccaggaggcagaggttgcagtgagccaagatcatgcctctgcactccagtgtgggcaacagagtgagactctgtctcaaaaaaaaaaaaaaaaaaaaaaaaggtggggggttgggtagtattctttgacattcggaacctcaaaagatgggtcccaggcctaggcatcaaaacgggatatgttgtgtaatcaaatttggagcacagagtgtctctttaatagaaataagagatgagaagctgatgggtaggttgtggtttgaaaaatgtggagtttctggacacacagtgaactatgggggcaggggcgggtttgagcaaaccagtgactcagtgaaagtagttttgtggtaagccataggattgagatctcacccttggcgatgcccaatagaagtttgtctttctgtctttttctttttcttttcctttcagtttatagagatagggtctcactacattgcctaggctggtattgaactcctggactcaagcaatcctcctgctttggtctccgaaagtgttaggattacaggcgtgagccactgtgcacggcagaagtttaagattggttctcccatgagttctttcctaaataaaatccattaatttctaacgcttggggaagttttaaagttgtggtgaatgaactcacacggaaggttcaaattagaatgtgtgtctagcagtggtcatttacaggtagtgagattggttggtttttcattgttttatcagtgttccttcatttaattgttcaaccgttaaagtttatgggaggccattgttttggaccagtctcctgtactaggtcccagcagacctgggggtgtgtgtgtgtgtgtgtgtgtgtttgttgctctgtcacccaggctggagtgcagtggggtgatctcggctcactgcaacctccgtctcctgggttcaaggaattcatgtgcctcagcctcgtaagtagctgggactacaggcgcaggccaccacgcctggcaatttttttgtatttttagtagagatgaggtttcaccatgttggccaggctgatcccgaactcctgacctaaagtgatccacccgcctcggcctcccaaagtgctgggattacaagtatgagccaccgcgtctggcatgttgtttcatttttaagagacagggtctccctctgtttcccaggctggagggcagtggtgtgatctcagctcactgtagcctcaaactcctgggctcaagcgatcctcccacctcaacctcccgactagctggttctgcaggtagataccactgagccttgcttgaattcagcatttcaagtctccaaaaggttaagtatattgcttatctcatgatctcgtgtagactggagagaaatgcaaagatcgcccaaagtcaaggtgaattagagccttctgggagctttgcctctgtggttcgcttctctgcctacacatgtgatgggagagtcagcttaaggaaaagttgtttctaaattgctgctccctttgccccagggcctggggaacttgcggtcctgggttcctgctgagtgtactgattctgtgataagaataactaggttcttgtggttttggcgagtagtacttaccaatgagagttgggtagtaagggttgatcatgtgacaaaagttcatgattgccaagtcacagtgaactatgctgcacagcagcagttggagaggcctaggggagagagaggtaggggctttgaaagatcagtgaacagcaggctgctcagtgaatcattgttcatctaggctgaaaacaattacccagcaacatgtaaatcataacctcatttggaagtgatactgtgtactttgatattatgatgtctataccctgataaagctgaacactggacatgctttttttttttttttgagacagggtctcattgtgtcacccaggctggagttcaggggcatgatcatagctcactgcaaccttgaactcccaagctcaagtgaccctcccacctcagtctccccagtagtcaggaccacaggcacatggccaccaccaagccctggctgattttttaaatttttagtagagacaaggtcttgctttgttgcccaggctggtctcgaactgctggtctcgaactcctgagctcaagcagtcctcccaccttagcctctcaaagtgctgggattacaggcatgagccaccgtgcccagcctgaacatgcattattaaatgcaatttactaaaaggaggtcagtttaaaggaactctgtcatcagttcctgcaatattgacagatagccctccgaaatagaaggttaccctaatgtgtctcctgggtttagaatttcatagaatggggcccacccatattcataagtgacaaataaaggagtggccataaagggtggggctagttaaaacaagcaaatgctattgttgaaatttggcttttaacttaccttgttgactgcttcctttttttgtactagtcttcatatactgttgctttgccatctgcctcaaaacccactaaatctgcagggctaggaaaagatagactgcctctgaatccttcagggtgtctatttctttgtaaaacatactttgaaaagtaaccacagagaatgcttttttttttttttgagacagagtctggctgtcacccaggctggagtgtagtggtaccatcttggctcactgtaacctctgcctcccgtgttcaagcgattctcctgcccagcctcctgagtagctgggactacaggcgtgtgccactacacccagctaattttttttttgtagagatgaggtttcaccacgttggccaggctggtctcgaactcctgacctcaaccgatccacccacctcggccttccaaagtgctggaattatagaaatgagccaccgtgtctgtccaagaatccaagaactttttttatagagggaaactaaaggaatgatatggaaatactgataccctttggcttttttttttcttcttgacacgaagtctcactctgtcaccctggctggagtgcagtggcacgatcttggctcacggcaacctccacctcccgagttcaagtgattctcctacctcagcctcctgagtagctgggattacaggtgcccgccaccacacctggctaatttttttatatttttagtagagactgagttttgccatgttggccaagctggtgtcaaactcctgacttcaagtgatccgcccgccttggcctcccaaagtgctgggattacaggcctgaaccaccatgcccggaccactttggcatttgtaagtggcttccagtcagtgagaattcattaccttctattcactaggtgttgcaacattaaatattactgcagttacttttgcaccagcctaataggatgtggaggtcctaggtccttttctttttgggggacgggagatggtgggtatcaggtaatagtggggactgacatccagaagagttgtctcacaaaactcttcttctccccggatgccccagagtaacaattatttttattttttaaatttttttgttttttgaggcagggtctcactctgtcgcccaggctgtagtgcagtggcacgatcatggctcactgcagcctcaatatcctgggttcaggtgatcctcctgcctcagcttcccaactggctgagactacaggctattatttgtggtgatggggtctcgctgtgttgtccaggctcctctcaaactcctgggctcaaaggatcctccagtcttgacccgtcaaaagtgctaggattacaggtgtgagccacggcacccagtcacactttttaaaaatctggtgatttcctgagactggaaggttcaggttaatgttctgcttagctaagaattgaacaaaaacagcctttgttaatatctcttgcaaatgtatccattgattttcttgctttagattctgctttacacagactgcttttttttttttctctttttctcaagcttgatgcctccctgaactaaccttcatctgaaatgaaaaaaaagactttgaaggtggagacatggatattgaatagtgaatatgtgccagggacagggccatgtccagacagcattatatttagtcatggttggtgtaaagctgatgaaatgcaacagagacagggatctttatctgtttaagtcatcagtatagtccaagcccctagaacagtgttttgcacatagcaagtactcagtatatagttgctgaaataattgagttgatgaatcgatagtgttttgccttggaaattatgactcgtctattttctgagtagttctcattctggtcttgaattagattttaggcagcaaagaaggacgacagagggaggaaactgtaggcaattctgtggtgggaggttgtggggaaccagaggaaggaagttaacaatttttttttgagacagggtcttgctctgtcacccaggctggagtgcagtggtgcaatatagctcatggcagcctcaaactcctgggctcaaacgatcctcccacctcagcctcccatgtagctgggactacaggcgtgcaacaccacacccggctaatttttaaattttttatttgtggagacgaggccttactatgtttctcaggccggtctctaactcgtgggctcaagcagtcctcccacctcacctcccaaagttttgggattacagtgtgagccaccacacccagccggaagttcactattgaacacagttgatgttcttggcaggcgcaattgcagattaaccaagttcttgttttactgccaacatgggcaatgtgaagtttctacctggctaggcaggattgaaggtaacgaggcaggccctaggaaaaatggtgaagcttctgaattttgccacctgttatcaccagataacaggcggcccactgatcgggattctgaacactagattgatgccagcaggcccactgatcgggattctgaacactagattggttggaaaaggaagctctcaggaatggatcatcggtttggaaagggaggctgagttacaggagtctccttgatgatgtatttactgaacggcctgtgaaattttgtttcttagctgggtgtggtggctcacgcctgttatcccagcactttgggaggctgaagtgggtggatcacttgaggccaggagtttgagaccagcctggtcaacatggtgaaaccccatctctcctaaaaattcaaaaattggccaggcgcggtggctcaggccagtaatcccagcactttgggaggccgaggtgggcggatcatgaggtcagtagatcgacaccatcctggctaacatggtgaaactccgtctctactaaaaatacattaaaaaaaaaaaatttatccaggtgtggtagtacacacctgttgtcccagctactcgggaggctgaggcaggagaattgcttgaacccaggaggcagaggttgcagtgagccgagatcgcaccactgcacttcagcctgatgacagagtgagacctcgtctcaaaaaaaaaaaaaaaaaaaatttaaaaattagctgggcgtggtggcgggcacctgtaatcccaggtactcgggaggctgaagctggagaattgcttgaactcaggaggcagaggttgtgatgaaccgagatggcaccactggactccagctgggcaacaagagtgagactccatctcaaaacaaaacaaagcaaaaaacaaaacaaaacaccttagcagggcatagtggtgcgtgcctataatctcagctactcgggaagctaagaatcactggaacctgggaggcagaagttgcagtgagctgagattgtgtcactgcacactccagtctgggcgacagagtgagactctgtctcaaaaagaaaaaaagaaacttgtttcttatccctcattaatgcccacctggagaaccggggaatctgccagtcttgtatgctgagggtcttagcaatgtgcaactctgggcaaccagagccctgagaactcatctgataatgctccagtctgggaggcaaacttcctttgtgatcagctgatgtgttttaggtaggaaggcccctggggaatttatctccgcctttccgtatgccttgtgtgcgtgtggggagccagcagacgcagaaataattcagaggtatcagagtcaccatcacatctatcatagattagaaatagatgctttatataccttatctctgacctgctcaaaatctccataatggaagcattcttcccttaactgagctaggagaaatttggaaactcagccacctctagccactaaatgggagagctgagagtcaaactcctatctgtctgacttgaggcctgtgctccctctgacaacctgatgcacaggtcagctagagcagcagtccccagcctttttggcaccaggaaccagttttgtggaagacaatttttccacggaccagcagtggggtatggtttcaggatgattcaggattcaagtgaatcacatttatttatttatttatttatttatttatttatttttatttttttgagacagaatttcactcttgttgcccaggctggagtgcaatggcatgatctcggctcactgcagcctctgcctcctgggttcaagcgattctcctgcctcagccttccaagtagctgggattacaggcacccaccaccacacctggctaatttttgtatttttattagagacggaggtttcaccatgttggccaggctggtcttgaactcctgacctcaggtaattgcccgcctcagcctcccaaagtgctgcaattacaggcttgcggcaccacgcccagcctgcatcacatttattgtgcactttatttctattattattatgttgtaatatataatgaaataattatgcaactcaccataaactagactccgacggagccctgagcttgttttcctgcaactagttggtcccatctggggctgatgggagacagtgacagatcatcagcaattagattctcataaggagtgtgcaacctacatcccttgcatgcacagttcacaatagggttcacgctcctatgagaatctaatgccgccactgatctgaaaggaggtgggtggagctcaggcagtaatgctagcgacggggagcagctataaatacatatgaagcttcgctcacttgcccgccactcacctcctgctgcagcctggttcctaataggcacctgggggtcagggagccctgagctagagaaaggggaaagaaggctgagtgcggtggctcatgcttgtaattccaacttttgggaggctaacgtgagaggactgcttcagcccagcattttgagaccagcctgcgcaacatagtaagaccctgtctctaatgtgtttgtttgtttgtttgtttgtttcctttttcttttgagatggagtttcgctcttgttgcccaggctggagtgcaatggcacgatctccgctcacggcaacctccacctcctgggttcaagcgattctcctgcctcagcctcccaagtagctgggattacaggcatgtgctaccacgcccagctaattttgcatttttagtagaaacagggtttctccatgttggtcaggctggtcttgaactaccgacctcaggtgatctgcccgcctcggcctcccgaagtgctgggattacaggcataagccaccatgcccagcctccgtctctaatttgtaagaaattgaaaaaaaaaaaatttggggggaaagagaagggagcagcagaggggatgggtgagcgagagcatgccagcttttcacccctggcctccccagctctcactggaactaagtgtatgtgtattttttgagatagggtctcattctgttgcccaagctggagtgcagtggtgctatctcggctcactgtagccttgacctcccaagctcaagtgattctcctgcctcagcctccccagtagctgggactacaggcttcactatcacccctggctaatttttgtattttttctagagacagtgtttcaccttgttgcccaggctcatcttgaactcctggcctcaagcgatccacctgccttggcctcccaaagtgctgggattataggcatgagccgccactcccagcctaaatgtgcttttcgttccttccaagtcagaggcgctgaagtcatgtcatgttgctggcatgtaaataggcctctaaaagcagtggaaatccctggaggcctgttcacaggagctggcaaaataggacagtggtatttcagggtcataggcttcctttcaaccagtgccccaggccccaaagtgtgttgtgctggggcgcagcttctctggcccaacaaggccacaattttccaccatcctcttcctctggtttctggcccagtgctcttcaattttagggaatgtggagattctgctgctgccccttgagtcagtatcttggacaggctcagagcctctctctggctggcactgtaggccaagatactgatacagtccccaagagcagggactgtatctgtttagtgccttaccttgcataatgcctggcacaagtgagtgcttactcagtacctctgaatgaatgcctgcaagctaagacgacgtagaagcaaaaaaggcagaaacttctaaaaaaacaaaccagagttatagacaccaggcaccagtgaaagcccaccttggcgcttagaagaaacatattccaaaaaaagaatatgttttaaaattaaacatattttttaaaaactttttttaaaaacatatttttaaaattagaaaaagaagccttaaataactttaaagtagcttcaaatatacatgaggaacaaactgatggtatgtgagagtagtttagaacattgagtgctttatgacacccttggattgcttttgatgattcttgggaagccagaaatggtgactggaagaccagcagtatttatgtagcagacaaatcatctctacctttgggaaaattgcttttggagtctgtcctagttgaagccacttagtgaacttaaatggtgaactgcagggtataaaggtgtgggtggaaggcacggggaagcacgttgcctgccaaataactggaaaaggcaggttggatgagaaaatcattcccattatggggctagcattgttcttcccacagagtttcgacctcctttctctgctcttaccattaggaaacccctgctgtgcgtcctcctttcttagaaatggcttattctatttatcccagtaatgttgtcaggtacttgggggttgagaagtagcatatcctcagcttggccagatgaaagggcactctagatagaaagccatacgtttattattattatttatttttagaggtagggtctggctctgttacctaggctggagtgcagtggtatgatcagagcttattgtagccttcaactcctgggctcaagagatccttccgcctcagcctcctgaatagctggaactacgggcatgcaccaccaaacccaactaattttttattttttatttttttacagagatggggtctcagggtctcactgtgttgcccaggctggtccctaactcctgggctcgagcaatcatctttcttttcggcctcccaaagcgtggggattacaggcgtgagccaccacacccagcccataaattattctaatttttagtatgaagtacttgtgatactctgccatgaaggatgcagtgctggcaggaatagtggaataattgctgcttgtaaacatttaagattctcctgtggattttggtgagtgatcattaaactgttttccaaaagcatatacaggccaagcgtggtggctcatgcctataatctcagcactttgggaggctgaggcaggagaatcacttgatctcaggagttcaagaccagcctgggcaatatactgagaccttgtctctatttttataaagtatttttaatttttatttaaaaaataaaataaaaagcatatacaggccacgtatggtagctcacacctgtaatctcaacactttgggaggccgagttaggaggattgcttgagcccaggagtttgagaccagcctgggcaacatagtgagaccctgtctctatatttttagaaaaatattttttatttttttttaaaaagtatatccaggcgtgatggctcacgcctgtaatcccagcactttgggatgccaaggcgagtggatcacttgagctcaggagtttaagaccagcctgggcaacatggtgcgactctgtctctactaaaaataccaggcatggcggtgaacgcctgtggtcccagctactcgggggctgaggagggagaattgtttgatcccggggagcggaggttgcagtgagctgagattgcaccatggcactccagcctgagtgacagagcaagactctgtctcaaaaaaaaaaaaaaaaaaaaaaaaaagcatatagaacaaaatgtgaaagttttctccctctccagagaaacactgttgactgcttggagtatagccaaactgtgtttacacccatatatacatacacacatactgcatatgaatacgaattgggttgtggcataactactattctgcaactttctttttgatgcataacagtgtatgttagaactctttccatatagtgcatagaaatctaccttgcccttttaaatggctgcagaatattccacagactcaatgtataactatttactacttccctgccgatggatatttaacctgtctgtagttacccgttatcaccaagcttcaaggaatagccccataaatgcatctttggacacgggagcataatatgtgactacttttctaggttactgtaaaagtagaattgctgggccaatcaggatatgtttgctaacactagttatagtcaacctttaaaatttttgccaatctgacagatgaaaaatatttcattatttaaattatcttttatctttacttttaaaaaatgtagatttcgtctgggcgtggtggctcatgcctgtaattccagcactttgggaggccaaggtgtgtggatcacttgaggtcatgagttcgagaccagcctggccaacaaggcgaatccccatctctactaaaaatacaaaaattagccaggcaggatggcaggcgcctgtaatctcagctactcgggaggctgaggcatgagaattgcttgagcctgggaggcagaggttgcagtgagctgagatcttgccactatactccagcctgcgcgatatagtaagactcagtctcaaaaaaaaaacaaccaaacaaaaaaataatgtagttttctggctgggcacagtggctcatgactgtaatcccagcactttgggaggctgaggcaggtggatcacctgaggtcagtagttcgagaccagcatggccaacatggcaaaaccccatctctactgaaaatacaaaaattagctgggcatggtggtgcacacctacagtcccaactattcaagaggctgaggcaggagaatcgcttgaatctgggaggtggagtttgcagtaagctgtgatcgcaccattgcactccagcctgggcaacaaagcgagactccgtctcaaaaaaaaaaaaaagtagttttctgagtcttgctttttctacttttattccataagtgtatttctatatattaactaagagtgaaatggaaatgattgtaaccaaatatgtatttgtacataacatgataatctgtgcatttgtgcatttcgcttttctacatctttggttacttctttaggccaaatgcctagtagttataaatcaaagtcattttatgagctctaatatttatttaggttttctcaagtttctgtactaatggttaatcaatatcctaagttccatgccatgtactttaaatttttgtgcttttggtgagtattcaccagtatctcaatgttcagcctttctttgtgtgtgtgtttcttttttgaggcagagtctttcagtgtcacccaggctggagtgcagtggcatgatcatgatcatggcttactgcagccttgtctttccaggctcaaagggtccccccacctcagcctcctgagtagctgggaccacaggcatgcaccaccacacccagctacttttttttgtagagacgtggtctcgcttgttgcccaggctggtctcgaattcatgggcttaagcaatccaactgcctcagctcccaaagtgctggaattacaggtgtgaactaccaagccctggcccatcttgggtgtttatccatgtattctgcagtactttcccgagaagtcctcttagacagcagctcaaatgggctgattgttctttctctgtccaagaaaaatgctgatgaatgaacttctctccctcattacagaaggaaaataatgttcttatctttttgtaacaaagaaagtaactagaatttagtacactgtgacttagaacccaaggaagactcctcgcttgatgcttagcgtgcatttcttgcagatttcgtttgatggtttgaattcaatattcttaaagtgtgtctcttttttttttttccaggtgaatgttggatgtgtacccaaaaaggtagaatttttatttctctttccctttacaatcctttttctatttggtaaatcataatcaaaatcagaatgtttccaaatagatcagttaaaattctttctgcaaaaaaaacccctagaccctactaaaagtagcttaagcaataggattgtttttgtttgatttgtgttttttaaatttttttatttatttttaattactttttatttttattattattgtttttttgagacggagtttcgttcttgtcacccaggctagagtacagtggcgcgatcttggctcaccgcaacctctgcctcctgggttcaagtgattctcttgcctcagcctcccaagtagctgggatgacaggcgtgcgccactgcacttgactgatttttgtatttttagtagagatgggggtttcaccgtgttggccaggctggtctcgaactcctgacctcaggtgatctgcccacctcagcctcccaaaatgctgggattataggcatgagccacagaccccagccaaggcctggtcatctacaccacaggatagttttttctcagcaaaaagacccagccagcaaaccaaactgttgaatggaatcttctcaagttctgtgggttcatggattttctgtatcacattagtgattttttcgttgttaatatctgtggtgcaggtcacattgaatgaattcattttttttacccttgacaaagaggaaaaaacagcagctcttatttgtaaagctgcctcttgcttatacttgcaaagaattttaccactcatttgaatgtactttcaacatatgttgtaatctcaagcttaccacctttattaatgacattccattttaacttgtcatctttttggtattatataagcaaatctcctaatctcatcagtgatgcatacctgagtttaattccaaaaagtctttttgaagtcttttccctggtataggtaaggtgtttttctttctgtcttaggaagacttttcttctctgggacattttccctcaactatttcctttcctattagtcatactttttgtaatctgttctacttggagccatgcaattatgactgtatgaattatataaattaattataaggtggttttatgtagtttaaaccagttatggtggtaaatttcgtgttgattggtacaagtttatttttttttaaatataccactgggctaatactgcacagtaaactgattttgtaatggtttagtctcatatttacttattccttctgatcacatgcggtagacatttatgtatgggtcatttatatatatttttttctttttttcttttctttttttttttttggttggtgtgttttgagacagagtctcactcttgcccaggccggaatgcagtggtgtgatttcagctcactgcaatctccacctcccaggttcaagtgattctcctgcctcagcacaagtagctgggactacaggcgtgcatcaccatgcctggctaattttttttgtatttttattagaaatgagatttcaccatgttggccaagatggtctcgaactcctgacctcaagtgatctacctccctctgccttccaaagtgctgggattatagtcatgagccactgtgcccggccttgtgtttgtttctttttagtctgtttttaatagctttccccttatctctttaaaaaaaaatgttttaagttagcaaggtatagtagattttatttattattattattattattttatcttttgagacagagactctgtcactcaggctggagtgcagcagtgtgatcttggctcactacaacctctgccctcagggttcaagcaattctcctgcctcagcttcccaagtagctgggactacaggtgtgtgccaccatacccagctaatttttgtatttttaatagagatggggttttgccatgttggccaggctggtcccgaactcttgacctcaagtgatccacctgcctcgggctcccaaagtgctgggattacagacgtgagctgccgtgcccagctaggtttgtttttaatttaaagggcagtatttttatctgctgttacctagttaccattcattcatgattccttttttccctcaggactgatttactgctgttttggatccttttttttttttttttttacaggtaatgtggaacacagctgtccactctgaattcatgcatgatcatgctgattatggctttccaagttgtgagggtaaattcaattggcggtaagtgtcaacactcagagggttcagtttccaagtgtagatatttttcttttataactgagccataaacttttttagggatggaggaggaattgcggtaaatattcacaatacgagatttacagtttagccatttttaagtatacaattgagtgccattaagcgcattcacattgttatacagtcgtcaccactattaccacttccagaacttttctgctatcccaaacagaaactattctattaaacaataacccctcattctcttctccccctggcccctgggaacctctattctgctttctgtctctatgaatttgccaattctagggaactcatataagtggaatcatacaatatttgttcctttatgtctagtgtattttgttttcacggtttgtccatgttgtagtatgtatcagaacctcattcctttttgtttgtttgttaagacagggtcttgctctgttgtccacgctggagtgcagtggtgcaatcatagctcactgctatcttgagctcctgggctcaagctatcctcccacttcagcctcctgagtagctgggactacaggcacgtgccaccatgcctgcctattttttttaatttttgtttttagtagagatgaggtctcactgtggtgcccaggctagtcttgaactcctgagctgaagtgatcctcccgcctcagcctcccaatgtgctgggattacaagtgtgagccactgtgcccagccttcattccttttaaaggcagaataagatttcttcatatggataaaaccacattttgtttatccattcatttgttagtgaatttttgggttgtttttaccttttttttttttttttttgagacggagtctcactctgtcacccaggctggagtgcagtggtgcgatctcggctcactgcacgctccgcctaccgggttcacgccattctcctgcctcagcctcctgagtagctgggactacaggcgcccaccagcatgcctgggtaattttttgtattttttttagtagagacgggatttcactgtgttagccagaatgatctcgatcttctgacctcgtgatccgcccacctcagcctcccaaagtgctgggattacaggcgtgagccaccgcgcccggcctgtttttaccttttggttattgtgaacaatgctgctatgaacattcgtatatgggtatctgttcaggtctctgcttccagtttcttttgggtctgtacttagaagtgaaattgccgaatcgtatggtagttttgtgtttaactatttaaggaactgctgtaaatcctttgaagccattaacagttttgaagaaatttagcaaatttatttatttagcaagtgtttattaagtgcccaccacgtcctatgcacatcatgttctaggcactttgccaaaacatttctccttgtcttctgcgcagaaagacgatgccaactgagtgtgttctccactgagtggcacagaggcttttaacacatggggcagcagaatgacacagggaagggatgactgtcttcggagacattcactcactgcggttgctgttgacagtcagtgattctctgctcggggtgttcagggacagatgccttagttactaactagaaggggaagatcctgtttctgaatactgacttgggtttcattgcagtgttattaaggaaaagcgggatgcctatgtgagccgcctgaatgccatctatcaaaacaatctcaccaaggtgtgtatgctgggtttttaactttgagaaagagctgttcccttcttgagtactcagctaagtcttgccagactgtagccctatttatttatttatttttattattatttttttggagacagggtctcgctctgtcgcccaggctggagtgcaggggcgcaatctcggctcactgcaacctccgcctcctgagttcaagcaattctcctgcctcagcctcctgagtagctgggactacaggcgtgtgccaccacacccatcgaatttttgtatttttttagtagaaacagggtttcaccatgttggccaggctggtctcgaactcctgacctcaggtgatctgcccaccttgtcctctcaaagtgctgagattacaggcatgagccactgcgcccggccctattttatttttaacgaccaggtctctatctgtcgccaggctggagtacggtggtgcaatgatagctcactgtagcctccaagtcctgggctcaagcagtcctcccacctcagtctccttagtaactaggactgtaggcatgcaccaccacacctggctaatttttaaaatattttgtagagatttctcactgtgttgcctaggctggtctttaaactcctgccttagcctcccaaagtgttgggattatagagatgagccactgtgcctggcctcttactttttctattattgaaattgacctgtcagagcagaagcctctgacctagatggccagtctcttctgcagagagagggtggcatgtgccagagctggcagaccaggcctcacctaatggctgcaccttgagtaggtctggcctggcaattagattcagaagtcacatacgagagactttgtgcaccagtataccagtttattaattaaaatgaggagtgctatctagctgaaaacctgccattgtgtgtttgtttgttttttgagacagagtttctctattcacccaggctggaatgcacaatctcagctcagtgcaacctctgcctcccgccaggttcaagcaattctcctgcctcagcctcccaagcagctgggattagaggtgtgcaccaccacgcctgggtaatttttgtatttttactagaaacgggatttcaccatgttggccaggggtctcgaactcctgacctcaagtgatttgcccacctcggcctcccaaagtgctgagattataggcgtgagctaccgcacctggccaaacctaccattgtttatttgcctagagtaagacctccttaagagaccaaattaggattcagaaggttgtttttatgaatgacatctgatcaagaaaactgggcagaggtgtgtttgcctccagcaactgtatgtcatccttcactatcctgatgcttttcccccatagtgctgggatgtcacacctttcccaccaggaccatgtaggtgacattgacaacctgtgcatcacttaactctccttttccttgacaatatcttcccgccacccttcatttgtctttgtggtctcactttgctgtttctaagatttcttacggttgtttgtttgtttgtttgtttgtttatttgtgaaacagaatcttgctctgtcgcccaggctggaatgcagtgatgtgatctcggctcactgcgacctctgcctcccaggttcaagcaattcttgtgcctcagcctcccgagtagctgggactacaggcacgtgcccccacacctgcctaattttttttgtatttttagtagagatagggtttcaccatgttggccaggctggtcttgaactcctagcctgaagtgatctgcctgcctcagcctcccaaagtgctgggattacaggggtgaacaaccactcctggccctcttaggttatatttagatcagtaacttttttttttttttttgaaaagggtcttactctgtcacccaggctgaagtgcagtggcatgatctcagctcactacagcctcgacctcccaggctcaagtgatcctcctgctttggccttccaacatgctgggattacaggcatcagccactacacctggcttagatcagtagattcttgatgataattaggccactgtgatctcagtagcagcatatttataaaccaatttttaggacgagttacttcatacatagctaactgtatacagttttatattcttattcattgggtttattttttggagggtgaattttccaaccttaatcctcaatccagggggaaaaatatttaaaggcctgcagtccttaagcacaggagattttaaggctgagtatagagtaacactggcagtactaaaacacaccaagttttttatttttattttttatttttttgaagtcaggatctcactctcttgagcagactggagggcactgtcgtgatcacagctcactgcagccttaacctcccaggctcaagcaatcctcccacctcagccccctgagtagcttgggctataagcactgtcccaccacaccctactacttttaaaaaacgtttgtagaggccgggcgcggtggctcacacctgtaatcccagtactttgggaggccgaagcgagtggatcatgaggtcaggagattgagaccatcctggctaacacggtgaaaccccagccctactaaaaaatacaaaaattgaccaggtgtggtggcgggcgcctgtattcccagctatttggaaggctgaggcaggagaatggcgtgaaccctggaggcggagcttgcagtgagctgagatcacaccactgcactccagcctgggcaaaaatgcaagactctgtctcaaaaaaaaaaattttttttgtagagatgaggtcttgctatgttgcccacgctgatcttgaactcctggactcaagcaacccttctgccttgtcctcccaaaatatgggaattataggcataaaccactgcatctggccttttttttttttaatggagctgactgaaatacttttgcaaaagaggtaggaaaattattcaggaaccagcattttgtaatacttagaaatcttggtgtgtactatagcttatggtgatcttatggggaaggaattacctatagttgacccagaaattctatattgcaaaggaaactttctatctaatatcctggaaactgaaagtaaaaatctcactgcttcctcctctgaactagtgtctgtcctatcgccacgcgagccatactcctttttgtctagcattgcagatgaagtcattaagacctgagggaatggtgttctggaggcctgtggattttgtctttgaccttgattcagcttgattaagcctggcacctgcaggaacaggcctggagggtgcagggaaagaagaagataactcaattcagaatcaagcacgttccaatatgttaaagcattccactttgtaatcatgcttacatggttccattattcttgtaagttgaccacatttgcatgcccctgcatgtatcatggctggcgaaagcgtgccagcagcccctaagtgaaggcctgggtacagaggattccagtaagagcaaatccaaaagtaagagtctgagttctcaccgtctccagcgtagaacttcagtgtcatgtacttttgtggtattcttcccattttacgaaagcacaagcattgcgtttccctcccttggccagagtattcctctcttgctcttgcctctgttcatttcaccattatcctgttgtctttcttagccttctgcctctcctccagacacaccagtctttttgagagagggtcttgtctctgtcgcccaggatggagtgcagtggcgtaatctcggctcactgcaacctctgcctcccaggttcaaggaattctcgtgcctcagcctcctgagcagctgggattacaggtgcccgccaccacttctggctaatttttatatttttagtagagatggggtttctccatgttggtcaggctggtctcgaactcccgacctcaggtgatctgcctgcctcggccttccaaagtgctggaattacagatgtgagccaccatgcccaggccagacacaccattctgtaatgtgattacattgcacataaggaactttcgccctcaattcttgggggcaaagatgtcatctttcttacgggggtgccttgcatatacttttttgtctctgggttttggcccaagttagcacttttatttcttcttctttttcctccttcttccttctttcttctttccttccttcttctaacttctttctttcttcctcctcctcctccctcttctcctcctcctccttcttccttcccctgctccccttccctccttccttcttcttctttctcctcctcctccccctcactttgtcatccaggctggagtgcagtggtgccatctcagctcactgcagcctcaacctcccagattcaagcaatcctcctgcctcagcccctcaaagagctgggactacaggtgtgcagcaccatgcatggctaatttttgtatttttagtagagactgggttttgacatgtttcccaggctggtctcgaactcctgagctcaagctatccacccacctctgcctcccaaagtgctaggattacaggtgtaagccacctgtgcccagcctatttcatcttactgtatacttccggcaactaatggcaacccctttcctaagtataggttgccagttagaagttctacagaaacttgaaaaacggagaattgtgttggcatcagcaaaccaagaatcaaaatgttcagtagagaaatgaaagttctgataagttgcagtaggtgtctttgtttttattctaagaacaggctaatgtcatggttccttctttagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgagtcatacaacaggtactcattaacagcagtcaggagtttactgttgctttcaacctgaaaagccatgccaggggatctgcctaaaccagttctctctttggagccaggccatgggagaaggtctctgcagaacctaactccagttggcttagtggtagctagtgatgcagtcgcccaggctggagtgcagtggcacgatcttggctcactgctacctccgcctcctgggttcaagtgattctcctgcctcagcctcccaagtagctgggactacaggcatgccaccaccacacttggctagttttggtatttttagtagagatggggtttcatcatattggccaggctggtcttgaactcttgacctcaggtgatccacccaccttggcctcccaaagtgctgggattgcaggccaccgtgcccagccaagagatttcatttggccccaggctcagacatattgcaggtaacagagggagagaaatcaatgaaagcctcattctttccttcttagcttagcatacattgtttccagcctcagtttgtcagacgggttgttatttacaagacacgtgataatttattgttttgttcaagagagagaaatacttgtaaggatgtagcttgagtagctaagtgagcttttatatgcatatttttctcttttaagtagagacttatagaagattaaagctgtaaggaatctcagagatggtcataacttcttttgcattttattttattatttatttatttatttatttatttagagacagagtctggctctgtcacccaggctggagtgcagtggcacaacctcagctcactgcaacctccacctcctgggttcaagcgattttcctgcctcagactcccgagtagctgggattacaggtgtccgccaccacgcccagctaattatgtactttagtagagacagagtttcaccatgttggtcacatgggcccacctcggcctcccaaagtgctgggattacaggcgtgagccactgtgcccggcctattattttattttatattattttatttttttgagacagggtcttgctctgttgtccaggctggagtgcagtggtgtgatcacagctcactaaggccttgaccaggacgtttagatgggagatggctcaagcgatatctttcttttttcccagctagattataaggactttgtggatggtgaacatagtttatacatcttttgaattttccatggattagcttcataagatccattatcaaggtgaatttttttttttttttttttttttttgtgagacagattcttgctctgccacccaggctggagtgcagtggcgcaatctccactcactggaacctctgcctcccgggtttaagcaattctcctgcctcagcctccttagtagctggtactacaggcacataccaccatgtccagctaattttttttgtatttttagtggaggtggggttttgccacgttgtccaggccagtctcaaactcctgacctcagttgatctgcccaccttggcctcccaaagtgctgggattacaggtgtgagccactgcacccggccaaaatgcaacatatatatttttttgtttgtttgtttgttcagagacagagttttgcttttgtcacccaggctggagtgcaatgggaggatcttggctcactgcaacctctgcctcctgtgttcaagcaattctcctgccccagcctcctgagtagcagggattacaggcatgcgccaccacactcagctaatttttgtatttttagtagagacggggtttcaccatgttggccaggctagtctcgaacatttgacctcaggcgatctgcctgtcttagtctcccaaagtgctgggattataggtgtgagccactgcacctggcctaatatatttaataactgatgagaaatgagggtaggggggctacagagagaaggaatcagcagttgacaactgaaggctttgtctgcattattgggagcaggtggtaactgaagtggtaaacttgagagagatatgggttggaagataaaattaaggttcagttctaaatagactaagtttgaagccaatgtaaaattgtgtggcgagatagttagaaacatggaactgcaacctggggagaaggtcaaacctggaagaatgcatctggaagtcctgcaagataggacctgctatcctatatccaaaggtttcaatctccttttcactacatgtatatttcactatataggttgtacctcttgtaattcaatgtgtacaccatataggttgaaacctttgaaagaataagcagagaggaaagggccacgtcgattttttttttttttttttttttggagacaaaatcttgctctgttcccaggctggagtgcagtggcacgatctcggctcactgcaacctccacctcccaggttcaagtgattctcctgcctcagcctcccaagtagctgggactataggtgcgtgccaccatgcccagctaatttttgtatttttagtagagacagggtttcaccacgttggccaggccacatagattttgaactacatagaaatttgtcttttcaggcaggaacggtgtctcacacctgtaatgagctgagccccagggttcctacctgcccttggggtgggagggtgaacagatccaacagagtctgttcatgaccactgagatcttcattcttcagagaaatgtaaaagttatttagccatcatggcttctgtttctagagagaaaataaaaatgttaactcagggaggatttggttggcagctttccaagcagagactttaacaaaacttgtcaaaacggagactatgttggctgtgaaagtgtttggtttttggcataaaatgttgtgattactttgcaagagaaagagcagtcttgtgtgatctatgttgcctttttctacataggtgccagcttaggaataaccagcgatggattttttcagctggaagaattgcccgggtaagccaacctgacctgacctcagtgactcattcttccttactgtctcctggtaacttttcttcgtcttctcctcccaagcatttaatgtaggcctttcctgaattccctcctcttacagcttctcttttcatgaccttgtatatctcattcctagaactcctcagtagatccctcaaatctttcatgctttcaatcagaggccaaagtcaaatgcagggtaatttgaagactgcatagcaaagtcctaaaactgtcttctttcttcaacttaatacagcatcaattaagaatgtgtctaaagtagcttgtattttagaatagaatagctggttttggccagatgtggtggctcatggctgtaatcctagcactttgggaggctgaagcgggcagatcacctgaggtcaggagctcgagaccagcctggccaacatggtgaaaccctgtctctactaaaactatggaaattagctgggtgtggtggtgcgggcctgtagtctcagctactcgggaagctgaggcaggagaatcacttgaattctcaaggcggagttgcagtgagacaagatcacaccaagaaagaaagaaagagagagagagtgccaccacgccccgctaattttgtatttttagtagaggtgggttttctccatgttggtcaggctggtctcaaactcctgacctcaggtgatccgcccgcctcagcctcccaaagtgctggaattacagatgtgagccaccacacctggccagattttcttttaatgaacaaacatttttttttttagagacagggtcttcttccatcgcccaggcaggagtgcagtggtgccatcatggcttgtggtagccttgagctcttgggctcaagcaatcctttcacctcagcctcccgagtagctgggactacaaacgtgcaccaccatacctggttaactttttaatttaaatttttgtagagatggggtctcgttctgttgtccaggctggtctagaattcctggcctcaagcaatcctcccaccttggcctctcaaagcagtaggaatacaagcatgggccaccgtgctgaatggatttagattcatagaggggcaaaaagatcatgaggaagtttgtttctctgatttgaagttgctgtacattgcaggctttctagtttagagggatgctcctgtcacttgtgagaagaggtgatgcctggaaacaggtggggagggacccaatgtgttggcgcagggactggccttcattcatcttctgagtggcactcactgtggagtttgcattgctcaactcttctgctccctcaggggctgtgctaatccagtttgaggtcctaatcctatgcttttagaagggcttttagggagagtgactcatagtccatgagcctatcttcactttgattcacccagagtcatggacagttcagacagcacgaggcagttcagaaaggaccagggagctgctttgcagttccataggatggtgaaaatgtcccttgaagatacctcagaccaggcaggcttctgacttggaggagttctaagaaaaccatacagtcttttttggtttgctatcaggtcgcagaaatgtgttagagaacagccttccttccctgtgatccaccctgcattgtttgattttagggttgagtgacatgacatatgtgaggatgtagtgagacatacagtcatgactcattatgtttggataatgtaatttcattccggactcaccctcaaagaagtttcattataaatagctgttcattagcaattttaaatatttacatttatgcatgtcatcaacaaaaggctctgaaacacaagaaaatgaatttacgattgatacgtgattcttcaagtctactttatctttgttacggtgttggtgaataagtaataactgggcaagtacataaataatgtagggaagatagcatgatttagtttttgcactgagggggcttctgtttggatggagcatgaaccttgtggaatactgtgcatgagtagtcctggggctgcaacgaggtaaagagaaatcttttagggattcagccgcctgaaagatcagttccagaagccaggcacagtggcttatgcctgtaatctcagcactttgggaggcctgaggcgagcgaatttcttgagcccaggagtttgaaaccagcctaggcaacacagcacaacccgatctctgcaaaaaaaatacaaaaattagctgggtgtgttggcacatgctggtagtcttggctacttgggaggctcaggccggaggatcacttgagcctaggagttcgagaccagcctgggcaacatagggagatattgtctctgcacagagttttttcctctctgaagaaatgaggctaaagagctttaaaaacaatgaaaaatacatttcccttctgtgacgggatattagggatttttcttttcttttgagatagggtcttttgctctgtcacccaggctggactgcagtggtatagtcatagctcactgcagcctccacctcccagacacaagttatcctcctgcctcagcctctcaagtaactgggaccacagacatggaccatcatacttggataatttttatttttacttttaggggttttttgtttgtttgtttgtttgtttgtttgttttgtttttttgagacagagtctcgctctgtttcccaggctggagtgcattggtgcaatcttggcttactgcatcctctgcctcctaagggcaagcgattctcctgcctcagcctcccgagtagctgggattacaggcacacaccactgcacctggctaactttttgtatttttagtagagacggggttcaccatgttggccagattggtctcgaactcctgaccaggtgatccacccacctcagcctcccaaagtgctaggattatgggcatgagccaccgtgcctggccttacttttatgtttttgtagagatggggtctcactttattgcccaggctcaaaggaatattttctacttaaagttgcagtggtatccaggattggatcttggaacagaaaaaaaaaaagattaatagaaaaactgggctaggcaaggtagcttacacctgtaatgccggcactttgggaggccaaggtaagagcattgcttgagcccaggagctaagactagcctgggctaacatggtgagactctgtctctacaaaagaaaatataaaacttagctgggtgtggcgatgaatgtctgtagtcccagctactcaggaggctgaggctggaggatggcttgagtcctggaggttgaggctgcagtgagccgtgttcacaccactacactccagcctgggtgacagagaccctgtctcaaaaaaaagggaaaaagtgaaaatctgcagtctagggtttagtcattagtaatgtaccaatgtcaatttcttattttgacaaaggtatcctaattaagtaaaatattaactttagggaaaactgatcaaggggtataataagggaaatctctgtactatctctgcaacttttctgtaaacgtgaaattattccaaaattagtttatttaagaatactaaccctctgctcgcgtctcagccgcagcgtcattgttggtgcaggttacattgctgtggagatggcagggatcctgtcagccctgggttctaagacatcactgatgatacggcatgataaggtaaatgccacctttttcttttcgcttttcttgatgttaatttaaaaaatgaagaattttttcttatgttgtcgttaaatactagggtgcaaagcaggtgtgggggtcatttggttggtttcatatggtgctgtatccaagttacctgaatttggcctatatccctcccagttgctggttgatgatgataattttgagttggtcaaattggctggtaatttcatcactaagtggtagatagtcatgagatgccctcatagggagacgtggggcctaaacataactattagctaaattaaacagactgttaggttaatttatttttttatttttattttttgagacagagtctcactcttttgtccaggctggagtgcagtggcaccatctcggctcactgcaacctctgcctcctgggctcaagcgagtctcatgcctcagcctcccaagtagctgggattacaggtatccaccaccatgcccaactaatttttgtatttttagtagagatggggtttcaccatgttggccaggctggtctcgaactccctacctcaggtgatccacccacctcgacctcccaaagtgctgggattacaggtgtgagccaccaagccccgccaggttaatttattaatttctggaaatcaattttatatgatcaagtaatgttagattgttaccactcattctaaacaatttactaaattctttgcattaaagcaggggtgtccaatcttttggcttccctgagccacactggaaggagtagaattgtcttggactacacataaaatacactaacacaaacaatagctgatgagctaataaaaaaataaattgcagactgggcacagtggctcacgcctctaattcccagcactttgggaggctgaggcgggcggatcacttgaggtcaggagttggagaccagcctggccaacatggtgaaaccccatctctactaaaaatccaaaaattatccaggcatggtggcaggcaactaatcacagctacacgggaggctgaggcataagaatcgcctgaacccaagaggcagaggttgcagagagccaagattgcaccactgcactccagcctgggcaacagagcaagactctgtctcaaaacaaaaaacaaaacaaaacaaaaaaactgcaaaaaaatctcatagcattttaagaaagtgtacaaatttgtgttgggccacattcaaagtcatcctggtccgcacacggcctgcaggctgcaggtcgaacgagcttacattaaagggaatcttgtagatcatacacttgaaattttttttttttttaagagacagagtcttgctatgttacccagtctgcagtacagtggcatgatcatagctcactgcagccttctgagctcataggattttcctgcctcagccttccaagtagctgaggctacaggtgtgggccaccatgccctgactaattttttttttttttttttttgagacagagtctcactgtgttgcccaggctagagtgcggtggcacatcatggctcattgcagcctcaaccttctgggctcaagcgatcttcccaccccagcctcccaaatagccaggactacaggaacatgccaccacacccagtgaggtttcaccatgttgcccaggctggtctcaaactcctgagctcaagtgatccgcccacctcggcctcccaaagtgcttgggattacaggcatgcgccacctgactactttttatatatttttagagatgaggtcttactatgttgcccaggctggtctcgaactcctggcctcaagctatcctcctgcctcagcctcccaagtagcaggtggagttcaagaccaacctgggcaacatagtgagacccccatctctactacaaaaaattaaaaaattagcaaggtgtagtggtatacgcctgtagttgcagctacttgggaggctgaggtaggagaatcacttgaatccaggaggtcaaggctgcagtgagcaaaga

SEQ ID NO: 17210 - DNA, 8011 bp, Human
ctttttttttttttgagtcagagtctttctctgttgcccaggctgaagtgcagtggagtgatctcagatcaccatgacctctgcctctcgggggtctcgtgcctgagcctcctgagctgctgggattccaggcatgagccatcacgccaggctaatttttgtatttttagtagagatggggttttgccatgttggccaggctggtctcgaactcctgacctaggtaatctgccagcctcagcctcccaaaggtatgagccaccacacccggcctatttttcatcataaaaataagacacaattctaatgcacaattaaaaggaaaatggaggtataaaagcaagtgctctatattacaggatgggatacagtacactattataattaaaaaggtttactgtgtggattatgctgatccatggaaatcagtaagtgaagttttgataaagtggagcaagtgacgaatacactgaactgtaaggtctttggagatgggccacgtctacttatattcaatccacagggctacacctagttcttggtacacagtacatgctcagcaagagtctgttgaatgaacacatacatggtttatctgtttgtctcttccgagttcttgacttctgtctgctctgacctctggcagctttccactagtttctagctttcattctgcttacctggatttcggaactctagcctgccccactcttagataaacgcatgccctctgtggccctggaaccttagtgacttctgctataccaaagtctccacgcccagggtgacacgcagctgcagctccgtaaacctctaacatgatgtcagcaaatattaaaaaaaaaaagtttataaaacaatgaataaactttgttaaaggtacaaatgaaaattagcaaacatgggaagataattgagtaaagagtttaaagttaaaaacgaattgcagtcattctaggggaaggaacagttgtatttgaaaacctgtatggttacatgaactgcctaaaaaacaagctaaggaaaattaaagctcagatttatatattttaagaaattaattgcaattaatttcctgggattaaatagcatttcctcaaccccagctgtcattaaaaagaggcaaatacagccaaggactggatctccggaaggctgacagcactgaccctcaagaaggcaccggctgacagacagaacattctgccctaatatgtgctgaaattccgctgagagcagagtggtacattgaaccctttaggggcttacaaaagaagtgtcctgtgttttagagtcacagagttttgcagaaacaagtatgaattcacctagtggccccctgcaccaggtctttcctgtgggcactgagtgccagacacatcaatatgtaatagcagaatgaatgactgaacgaacgattgaatgaaaagaaatgagaggcagcaggttgtcagattctatgaggcaatcacagcatcaggtgaccttagtatctatttgagaggactgccatttattctcgggagcgcacggctctaaagaggcccatatccaggcagtgagctctggtggggggcgcctttagatgcaagaaggaggaaacagctcgaaatccctgggcctgagcgcggcccgtgcaggccggagggtcaagaactctccaccggcggcagcggcccggtgtctgccccggcttcgccccggcctaaggctgcctgtgctataaatacgcggcccacatgccgcggtgacacggtgttccctgggctcggcgggacagataacatgaatgtgccctttaaacgtcccaagttgcagggacagcccccggcccagcctcgctcccggaagcgccttcgcccccgatgccctctgcagctgggaggagggggcgccccgcacctgcccagccaatgcgcggcgcgagcgccggccgcgacccgcctcctctcgcgagagcccggcggggatataagggggagctgcgggccaggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtgaggaccgcgcggtgcaagaggcgggcgcgggcgcggcgggccgggcggggcgcgcgatgcggcgcgagctgcagggcgcggggcgccgcggaaaatctgcgccaggccccagggccgggcgcccgcccgcccgcccgccccccgcccgcgggggaagaaggtgccctctgcgtagagacaggtccagcgtcagtcgcagattcctggtgtcgggtggcgcccggcgttcgggtgtctatatatggaaacccacccggagccggtttacgtgtgccagatcctgcgcccgtgacagcacgggcgtgcactcaggcccggaggcacctagtgattgccagtatttttggcaccgtcttatgcgcacgcacctttacaataaaaacatcaaaataatcatcacccaagaattcccttatcgtatctcatgcacaatgctgtatgtaggctgacgccttcatctttatgtaacctctgtgagagagttattcttctccattttacagatgaagctgaggttttgaaatattaagaaacaattttcggaataaactcagatcatcctgtctccaaatcttttcctcccctacctggtcgctgaatggtttatcatcctctcgtgttttcctccacctgcccaaaaggtcagggcccctcaatgaggaagagcccaatttgggagtcagaattactaacaacaaaacccccacaaattgctcacaacggcagcaaacccttaataattgattacttggattatctgcttgaaaactttggaggcctaatgtttagtggatttattctccttcctctattagagcatctagtagagatcctcatctccagggtgatcagagtgacactgagaaattgtcattttttggccatcatgtctattaaatccaaagccctttgaagcagggagtgttactcatttctgtcccccagtaagcccctcatacagttctcaaacctagggaaagtgaaataaataaatggctatagctttatataattcaatcaccttttcagtttatttggggcaataccttttccctcaaataccctaataattgaagcaacattggattattttggcttgttatccagtaactaacatggataacagtatccatttacacgtcctcagtatccatttgatttcctcatcctttttttcttcaaaaaaaaaatctaggaagtgcaaacctttttttttctcctgtcctcttcccttctctctaccctgcctgtcctctgtcacccaccctcccctccaccaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaagggggtaagcttgtgctctactcatctaaacttgtttggttttgcccgaggagaacattttacagggctcctttcagtcttccttactggaaattaattttcaaaattatttgataaggacttagggaagaaagatggtattaattccccctaacgttctcaactatcctattagggaaaagtattttccattttattagagatgataagaacatgaatagtaagacatttagatgtgaatttaactaggtatccagcattatagagaccctaggccctcttcccttagagcctgggtgcaaaagctagggaaaagaagtagttagctacttcttacaaagaactcttgcttccctcctagttacaggtgttagtgggatggggtgtttagctgggtagagatggcctgaagcaatctgttgtgccagagaaagttttggcttctataggttgaaccatacgaaattgccactttaaaagtcaaaaacagtccaatgttagcagtttcgtatgtttcaacgaatagttacagccttttatttagactgcataacctcgtgcaggatcatctgaggctcggcctcagttcggtcctccataaaaaaaggtaaccgcgtagcataatactcctgctccactgcgcccttcttgtttcgcagttgggcagtccatgaattacttggttaattgccccagttcttcactgaccttgaactaatggagtaggaatgacaggagacccagcctgccagtgaagcaaggaaggagatgtccagtgggatgttgcatggagctgggactccatgcccagatgaccctgattttataaaactggtaacagtgtgtacagatatgtttcaggggaaaagtctctttcctccagcgttacggagccctcaccagcatttgtttccacagccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttctattttattgaactcttattaactgtaaaatgcatttttaaaagatcaaaaatgcatattttctagcatgattcatgtatcagtcagcagccaagcttctaaatgccagatattatattgagaatgtattatatgagaacgtacaatgcttaaagttccggttttcaaacttaggcaggtcatattctatctatcttatccagcgttactgtaggctagaaagtgataatggctttcataatcctgccttgtcttaggcactttcctgcagtctttagaaattctaagattctgctaaaagttttaaatcacaatctggagaattttctatgattaggaagtgctctgttttcatccctttagataactgtgacacctagaattttatgttaagtagagagtattcattgaaaatcaaggccaggtgcagtggctcacacctgtcaccccagcactttgggaggcagaggtgggcgtatcacttcaggccaggagtttgagaccagcctggccaaccgagcgaaaccccatctctaataaaaatacaaaaaattagctgggtgtggtggcgcacacctgtaatcccaactactcaggaggctgaggcatcagaatcacttgaacccgagaggcagaggttgcagtgagctgagatggcatgccaccacatccatcctaagcgacagggcaagactctgtctcaaaaaaaaaaaaaagaaagaaaatcagttgtcttagtttaagctactataacaaggtactgtagactgatggcttataagcaacagaaacttatttctcagttctgtagtctggaggtccaagatcaaggtgacactgtggtcaggttctgatgagggccctcttctgggttataaactacggacttcttgtatccttacatggcagaaagagcgacagagctctctgtagtcccttttataagctcactaatcccattcatgagggccctaccctcatgacccaattacctcccaaatgcccctcctccaaacaccaccactttgggggttaagatttcaacagatgaattttgaagggacacaaacattcagtccatagcatcacttatcaagctagtatttaatacctcttaggccccgtggaagggaaaatagataggaacctgccctgaaagatgcttcagttggggagaaaaggtgaaattccattgttagacaatttgtttaagacaatacatcttgcttgagaaggaatagaagggaaatgaaatggggggagggagtggtaggagatggaggctttgaaagaaaataaccagatttagaaacatgggtatagaaagcatcctccagtacttctgtaacaatttatcaagacctacaggaagtcagttttggatttgctcctccgagatttgcgagccagaggaaaatacttagactatcaggttggaaagttcacacttggaccaggaaaagaccaagcagttgctatagtctcctggattgtgactaatctggaggaagcaagtccctgtatccttggcaaagcttgaaaggcaggcaaatgtcttctctgtgttttctgacaggtggttgggtggtgggggttggtctctgtacctcctgttctttaccttgcttaccaagcccttccaccgactcactcctgcctccccagctaaaaattggctgtgttgcttttaccacagttaccaaggtctgagttttataaaatccaggatcacatctgacctcacctggtagatatctaggccaataaagtctaaagggctaaaaagaaggtacctctccatcctgtctcctcgaggccaggcagcacatgtgcagttaagaggcctcctggatccattgtcctcctgttgcttttcgttctaagtgatccaaactctattgctgatagggaataaaagcagggcaggctagtagtgggcaagtgctttgatggagcgtatctccaagcagggcccaagtttaggaggaggaagacct

SEQ ID NO: 17211 - DNA, 9772 bp, Human
taatattaaagcaactgagtgtagatttgcaactatagtgtgtatcttcatttgtgtgatgaaagagttttattctttctagagttaaataagagttttatagttctttgtaactatttaaaaggaaattgctactccttttaaaaaataattggaaaggaagtatgatttgttggtatatagacatagaaatagttttatactatattttagtccttaaagtatggaacttaatgaaattgtttaaaaaaatctttatttttcacttcctgcttcaaattttcaataaacaaactctaaagaataatttcctttttttgtaaaagataaatctttagttttaattttagaaaaggtttccagtgtcatttctcaaaataactagtaaagtttacatttacttgggaaaaccttctttcagataaatgagtgaaattaccaaattaccaaatgagtgaaatgaatcagattgctgataaacattggttcatatgctctctggccatttaattagtatttctatcaaaaaactcttttgtatttctaaagtaaaaattaaccctcagaatgtttaattctaattgaagtttacatggtttttattttaagatgaaattcaaggagcagaccattaccaaataaacactggagtaatagaaatatattttagatattgctatttgttaatgaaataaatggtactcagatactttttttaaagttttaaagttttataaaattttataaaattcagaaaaccaagcatatagcttaatattttctcaataatctttatattaaggcacatttgccattttctgaattgaccataatacatcccatttattaaaatatttgttagttttgttaacagaaagatgaggaagtttgacttttgagaatatacttgattttgagaatatacttgatcagttaaagttaaaaatggagaaaagttaatttattgggtttttttgtatttacataagatgcaatctcattcctaaagtcagaggtgtattagggccaaaaaatgttctccgatcatgttccaatgttgtattgtgggcaaagaagaccacctagccagtagcttgttgtgtttagttagctaacccttggcaaattcaggagtcccacagtcacttttctacatacggtggcacccttcttatggattagagctctttttttaaaaaaaattgtgttttgaaaaaaattaaataatagttgcaagaataagtcagtgaactttaacataccctttatctagattccattcaccagttgttaacattttgctacattctctttaccactcaacatgatagtattgttttatttttgctcaacaatttgagaataggttgcagacatcttgaacctttcttctaaatggtagcatacatgtcctggaaacagacatactcttacctagtcatagtacaatgatcaaattcaagaagttaaactttggtacaatagtattatctaatttacagtccatattaaaatgttttctgattgtcccagcagtgtctttatagtgacttttttccccaaacacaagatcatgcattgcatttagttgtcatgtaagttttgttgcgtttagaacatgtcacttctgtccagaaatagaggtagtcttctgactcttacctctcacaagctttgttgaagaaaaaggacattaggaatttcaaagaggctgcttaaaaaaaaaaagagagactcttttgttcttaatttttacaactttgtctgggttttggtttcttgactcagcaaagtctgtaatgcagccctgcttggtaagcattaaaggcggtactgaagctttcctttattttataatcccagttgttttttctagaaaccatcaatagcgtctaaatgactgactcaatttttggatcctattctcatgactaagcaaatgtttgactgaaaccagcccatataaatgtcactgtgcctctaactctctgtagccattcctgaatttctttcagcactgggaaaaccagtctatgcaccaaaaatgtctaaaactggaaccaaggtaagtagtcatattgatttttagcctacccgcttttcacctaatgatgcattcaacacacagaaaagcttttgcttctttgcctagaggtgagtatgatagtggttagagaactgggattgagagagaagattaagaaatgcttattatattttccacccttaacagaattaccgaacactttattaagggtttatctttatgtatggtgctatgttaaatactatacaggtaatttataaatatcattattatttctgccttctagcaactaatattctatgcaactgatattctccataggaataaggcatgctaatggggattatattgagcagaaaacttttaataatcaattaaaattttgttttctgaaatttagcctcaaccatttgtgttctaaaaggccaaagtggatgggccaatcaggtgaataaagtcctacatctctcttccattcaagcaattatttttactcgttcctcaaataaagtgctcccttacagtcagaaaattgcctctaaaatatttaactcacaattactggattggaaattattctttcaggtagggctttgggaatgagggaatatgctttcattttcttttttgcgcttccactgatgagacaaaactgctgcctgatttttacccccagctatttgaaaattttcaaacccattgaatcctcaaagaatggcaaagaaatgttgaatgaatatttgtatatctttcacttatattctccagttgttgacattttgccatatttggtctctcctatttccatctctctttattaaaccatttgaaaattagtagcagattttattatacttttgccttaagtatttaggcatgtatctcctaaaaacaagggcatttccctgtataaacactgtatcactagcatgtccccaagagttatcataaatataatagctaatattgagaccatattcaaatctcccctgattgtccccagaaaagtgcttcatggtggacttttcccctaatacaggatccagtgaaaaacatgtattgtaattggttgtcatgtctctttattctctttaattttttttagcctctctaaaaatgtccctctaccctttttgttgttgttcttgagacatttttcaaagcctaggttagatgtcttttagaaagtcttgcaatctagatttgtctaattgtttcctcatgtttagattcagaataaatatatttggcaagaaagctacataggcaatgttgtgtacttcctgttgcatcaggtcagaaggtacctgttaacttgttctgtaatttattagtgcttgatttttttttcattggaaaatagaactaataatcatgcttgtcattcaggaggtttggggagaaaaattagtgtcttcagtgctctgaggttcttgaaaatataccatgcaaatcccactaaaaaagaatttttggtccttagaggagggatatccatgtatcttgaggtaaagctgttctacaaccatcttagatgaaaacatctgcttttaaagatttgcagagtagtaatagtgtactcttttttatttatagatgagtcgttcatttagttaaataacttttgcttgctagggtaaaggagatagtaaattatttcttactttttctcattgcttcttcctttcccactatcttgatagcagtttaatcagaggagttatgggcttggcaaaaggaatagattttactaagtatgttttcattacttctgggatactcaagatatttttctctctgctgcattggattagtaggccatttttccaaaaataaacctgataatgataggaattttgtaataatttctaggaaaactttctgcacatttctttagccttctctacaaaatattttgcccaaaggtcaaaacctctaggctgacaatagcatggatttcatggttattctacaaaaagaaattgagcacagctaggtgcaacattctctggctctgagatatagaaggtctcccactgaaaggagagcttagtcttggagctcagtaatgattccatagcaacaggatgagggctttgtttcaacttttggatggttggctggtctcctgggagggtggacatcaggtgaccgtatcaggcatcatgtatctttttacttagcagatattgataattagtcacgcaaatgtgcagaaggcagtaaatgtgagaaactatgaagtgaaatagatggtattattaacttcatttcccataggatatcttttgcaaaggctctttttagtgacttgtttggtcaaaaaccaaaggcaaatagaacatatgaattaaggagtttagaatctatccattcttagagaagttatttgactttcctaaagatctctccacaggtcatgaggaagagcccctgaggcttaggcccagccttggtcattgtccaagagagtaagtgctgccatgttaaacgaagctaactgggcaggcagaaagacagcaaaggaaaataaagtgaacaatagtttactcaccaggagttttgcactgcagcccaccagcttgtctgcaactaacttgtaactaggtagtgacattaggccaatcacttaacttcttcatctgtaaaaactgtagcaaaagcttattgctaatcatgagtcagctattcaactaagtactttatcaacatccccttggaccctcagagcataccgtctgcaagagacactatcatcctgttttgccaatgaagagctgtagagaaaggttcattgccctgtccaaggtcacgtagcaagaaagcagtagtattgagacttttcttttttttcttcatccgtaaactgaggtaccatatatctaaatctgtactgtgctaagatgggaagggaactgaaacacataaagaaatttgggcaggggataaaggagaggaagtagatgatttaggggtgggaaggaaaagggacccttttagggaacaggaaagagaataattgagataaatgggaagggaagggaaagattaaggtggagggaaacaattattagtatattagtatctagatagaaagaactacccaggatagaggagaatgagattttatagctttttatgagtcattcttcgtttcttcctctcattccctccatctaattagtcaccaaatcctgaagttctttactgttttctcatcatcattcacattggagttgccttttggttggccctcatcatctctcacctggcccacagcagccatccgtttctaggcacacactactaagtccaactcactcataatcaccaaagggattccagcatgattctggtgtcatttttctggctttattttctagtacttcaccacatattcaatatgtactggacttaatgaactacttattgtccctataatgggccatgttctttcactttattcttttaaacatgtttgttccttttcatttgcctctggaaaacacctacttatccttcaatgctcagctcaaagatcctctcaagacagtatccggctctgctcctttcatctgaaatgactcacatagttttcgcccgtgaaatccataaagtaaatcagccacaaggtggcggcataatgccaggtaattaacggttcgaagcatgacacctgtggtttcagtttataacctagcattgatctgaaattccatcttaaaaaaaaaaaagatgaaaagattgtggaattattgaataacaagggacaagctctgtagctcatttgtagttttcatcgtggttttcaggaactgcttggtgaatccttgggagttcctaggaactctgtctcctgtttcagccagaaaagctctgagagttgttttaaagccagaacttccagtctgctgtagtcttcaaataggaagctgaagctcagagaggtggctggatgaagatagtaaggctaattgtagagagggagctctgtagtccagacttactgtttctgctttcacagggctgcatatttttcagtgccatcagagacttaccccaggcattgtggtagaaacttgataagcgttggaggcaaagaggattcttatcattttgttactttgcaactactctgttggcaataaactaataataaagaacatgatatgatacattttcatgtatgaaagctctacatctatctaaaataagctctgtaaagctaaggttcatgctttatttttctctatgtatcctccatatcacctaggagtcatcttcatgaaacaattattgaagtcaagtgatgggcacagaggattgatagctcaaataaggcttggtacttgcccttggaaaaagtatgctaggattctggtgggaggggtagacatataaatggataatttataatatgatgtaagtacagagagctgtgggaacataaaggaaggaaaatgaacttgagtctgagactgctcacttctattagagccctcttctgttttgcttcatgttcagccttcaggaagaactcatttctgttgttgacaactgaagttgtctgtcagaaagcaatgttgtaaggtgacgtacagctacatatttttcctcaaaattgaggtgaaaggaatttctaaagtaggcattatgttcttaatttttatctgtgaattaagccacccagctcctcagctctttctctgttggccctctacttcagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctggtgagtctggggactgtgtactccctctgtttcccacgccctctgtccgctttctcttgcttttaggtgaacattttcttgagtcttctctacctcttaatgagtagctgcttgttggctgctgaggcttgagtaacatcttagagcagctcatcactagaatgactacactaatttccagggtgctgtctctgcctcttgagtgttttgaagaattaattttttcttattgaaagttagctgttttagtcagtacatggtgagatgggagttcagatcatctagctttcaaggtgataagttctgagcaatactgttctctaagttcttgacctgctggtgatttccataatggtttctgttcattttctcctgtgtcttttcagcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatcccactgctgactataatgcctctccttaaatgcttctagggaccagcaatacagtgctcgccacagtgggcagtcacacaaagctacccatctgccagatcaccaatctagatctttgtgccaaacaaaatgagatctcattaaaaggttagaaagtcatactgacatgtggtggttcctttagcttatgttttgcattaattcaacaggcacagtaataattgctaccatttattgagtgcctacattatttcattttctccttacaaccctgtgagaggtagtttttcggtattttataaataaggaaactgagagaaatttaaaatgtgcccaaattcaccagttggtggatggaggagccaggattcagtccaggctacttctgctcccaaagtcattgttctgctttctaacacatacattcaacacattggctggagatctgtgcatatagtgtctgtagaagcccctgaaaatttttaaaggtagaaaagacggggtcctctgatgttccagttgaggggacagagtgtctatcaagaacagccagtgaaaatagggttattatttgaaaatggtggagccataagccatctgaagtccttgtttaagatctaaagcctgctatgttagttacttctcaatcctaagtttagattttttgtgtaaagaaaggacatattaaaagtgtccctacattataatagttgaaatggagttttatcaagttttacttgctttgagtaacccctgagattttatttaatcttgaagagaagaatgaagaaggaaacagtatggccaggagtatttagtgaacatacaagtgaacctggggatatgcagaatgcacccatctgtaaatgagatagcaaagcccctgtcatctaggagccttccccaaaaggacaaattagaattgctaaatttcccttgtgtatactctatagtgcacagtgcatactcaccccaaaatatgtttattcatgttgttatcttcccctcccttttgtcattttgtctgtttcaagtgagagactgaaaaaagtgggtgtaagtaagggagggaaacctgacaaatggagaaggaatgggaggccatttgctgagctgcaaagagctctggcctgtgagctgactgcagccatcagctctggatcttgccaccataccatgaagctacctttccttatctccaaaacaagggagttgagccaaatgctctctggagtctcatccaacacaaacattctaattccccagacaccagcaggaggacattaaaaaactagctgatgaccaaggactactgacacttacttttagaggcataatttctggaagtgacctcagaaatccactgattttttgccaaagaaataggctgtgataagtaagttagtatcagtctcttttctcatatcaactgcttgccatgttctttggtgagttggtcacagtctgttcaactagaaaagcagttctggcagcagggtaggaaaacaagaagtgtcaggatgactaaccacagtttcagagaagtagaagatggcttttgacagataaaagcaggattattattttggagtgttgcatgcctcctggttcatgccttggtccagaaagagattgctatcattttctccagttgcagacacaccaatcaactttctgcttaaaaggaatttgactaacaattgatattagaggtcaaaaacactttatatccttatctatcagtcagtcccagctcttttggtagaacattcagctgttaggacaagaagctggtgtcttacctgtcacccacacccagaacagcacctgataattcagttatctccccctaccttttattgttttatcgctctgaaatgggggatctcaataaaataaagcaagggcacccttaaaccattttaaccctatttccatcacaagaatttctctaagacaagtctctgaatattcccatatatggagctcactgtctattggga

SEQ ID NO: 17212 - DNA, 16302 bp, Human
ttctacaggcaggtgcaactgtgcatgtatacatatgctgggagtgccattgttttatgaataaggaaacaaaatgctgtgtggcacacccagtgtcacaggccctcttaccgtgcagtggaagaggtggaatttaaacccaagactgcctgacaccaaaggctggactcttcccctgcttcctctcccagggctcccatactccacagcctaggagaaggccagctcaggttgtttgagactgggttgaaacccaggtgcataagtggtggtgcacgatttccatgttattggatctttttatctgtttgagtcctgccttttattttagttgcactcatggccttcacctatataagtctaatatattcctcaggtcccagaccattctcctcctctttgttctgcatcctcaggccccagatccttctcaacctctttctgtacgttgctcaagctcaatgaatgtttgtctcctcactggctgaagctaaacctttgttgtgccccagaatctgaatgtctggtttctgtacccattttgctagtatcgttcctatttgaaaacaatgcctacagcccacatccacagagctgggatctttagatttgggtttttcaatcaatcctcaaaaactatttctctccagaaattaattagggctgtgcctcagttagttttatgtagttataacagaatatcagagaccagggaatttataatgaacagaaattactttggctcatggtttggggggctgggaagtctaagatcgaggggctatacctgctgagagccttcatgctacatcataacatggtggaaggcatcacacaggtgaaaggaagagagaaggggaccaaacacatccttttatcaggaactcactttcaagataatggcatattccattcatgagggtggagccctcatcaggataggataatcctctcagcattacacaatagccaccactgtgtaccagcaagcacacagaaggattcagcagttcctaaacttatttgaatgcagaatccttggacagggacaggaaggaagagaagggctaggagtagggagagagttagggggtggttactcacctcatggactagggctttatagaatgcccttcatgataacctcttctagaggcttctttcccattttgtctcttttctctcatgacaaactactgctgatatgtgttttttgttgaaatacagtttttaaaagataattgtcttttgtatggtcccaataagtagaacctttctgaatcacaaatagaagctaaaaaaaaaaaaaaaaaaagaaggcaagagtcccaaccaatgtgttgccacccacctgcccttcagtatctttcttttagcaagagtatggggctttagtctcttaatgagcttgcttccatacatatgcataaaaggaagaataggcttgaaatacaatgtgagaactttttatatctctttgactttttccccttaagtaaagtcattgtttaaaaataacttaaatgatgataagtagaacattttccacccagatggccaaagtgcttaaggaatctcaactgtgcttctggcagatgactgtggggttcaactacctccctgatctaacaagggctttgcacacagagtgtcagccaggaagtctgaattcaccaagcaccactgggacataagataactattagagtggccaaggagacctccacagcaaaggtgttaggggagagggggagaatgggacagtcctccatattcctattcaggaggggacctgcaaatcagaatctaatcataagagccttgaacaaatgttatgatttctcaggaaacagttgggaaacttaaattcatttgtatgtacaggtggatatgaggttgctcaagggtctaaggttagaatcattgggaaatgctatccaaagtactgacttaggaaaatccaagttcagaattcaaggtgaacttggttagcccttccagttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacgggcaagtagggacagttcccactctggggcagggatgtgggcaagctggagagactggccagggtgagggaacccagagacaccctggcaggtgttttctgtattggaagccctgccgagaactctctgttctcctctgccagggtcagcaacaacgcacttattgttagtaaaaacaagtgttaacagtgatcctactctgacacttgtgtcagatttaatggtttacggggaatcttcacaaatattctttggctttgccataaagcaggggtttttttgtgtggtctttctaggtttctacttcctgtgaaatgtattgcatttctctaccccttcccacagggtggcctgggatctctgttctatcttacactggatgtgctagagactgactgccatgtgctcagaaagaaggcatggcaagactgtggaatgaggatattttttgaatcagtgagtgcttgtttttataaaccattaagggccctagggaaagcaagtaggtacactctttctacagggtcaagggtgctcaatatctgtcatcttttaaatggcccactttataatctcctggcaggtgcccataagcttattctaatgctctagacagaacaaagtttaattcatgagaggggtttctgagaagtcccattggggtcatgcagaacagaatggaaaagttgccccaagttgtgtttttacctccaagaccttccgttaggctctgaaccagtgtttcaattgtgagaaaaagacctgaggtgtgaatattctggacgtggggttaatgtagactgcagaagtgatggaggtagagctttgtctatttgttttattttgctttgtttcaataaactccgatgccaggtttgaggggaggaaaatggatgacttgcagtatgaaagctctcaagggcgccgtgtaaggatttcctgaaaccacagagcataataaagggcctcagaattaatcttctaaagatgatcatagaagagacttgaaaatagataatccatttcatttcattcttaattatcctgggatgattttcagtaattgatataaaactttacagtgtgagtacagaatagtgatgtaagtgtttagaagaaaactatttgatcaagatattttcctaatcatgtagccaattggtcaaactgtacccaacttgattttgaaaagtgaatatcctgttgtgaattatatttgttatggtgacactagctactaaaacacagacacaaaaactgtatactcactctaacatgatagaagttcatttctcacgcatgtaaagttgaaagtagaagttcctgattagatgggtgctttgctccaggggtgatttgagacccaagtttattccacactctggctctagactctgcagcctcagctcacgacttccatggttacctgctcatctgcatcaagctgtgcacagagaaagagcatagaggacagtgagaacgtgggagacccttatgagccagatctggaaatggttacacctcacttctgctcaccttcctgtggttagaactcaattatacacagtcacacgtgttggggaggcttggaaacatattctagctgtgtcctagggaaaggttaaacagtttgatcatcaactgcagttcctcccagccaaaaccacagaatttgatcttaagtttctaactactttaaaagaaaatgtctgactttaattttggaggtattttaaaagctcatagttgcattcgctatgtcataaaatgcatttgttggtttcaggtttatggtcaatgcaaagcaatattttatatgaacaacccaagtagagttctctatttagctgcttataactgtactcttcgcccaggtaagaaatcactacgattttgttagttttaataaaggatggaaaagagtacttaaccaggtctttgccaagaatgtatagggtatctctcattcttattttctgtttattcttaatgccagtttcttaatatttccagtacttacctccttactgaaattcatactatactgctcctcttcccacaattaatcttactaaactacctctacatttatatgctgcatcagatcttacattttcagtctgacataaatggtataatttctatgactgttccctcaggcttcctttcttgctatctctgccattatttcccagactacaccaactcttcactccattctactggatgccaccctgttttctgaacatgcactgcaatttccagtctctgtgtcttgcttgtgcctctccctctgctgagcatgccctcccctgatgacctctgaccttgggacacacctattctttaaggaccaacaccacttcttccacagtgttctctattctagaaaggaatggtgcttttgtaatctgcattcctataaaattttgtctaaactactcagggaacacataatgcactgccttgatttgagggtcgcatatcttacatcatgtagaatagtttctcctttcctcctcctgctgcacccttcctcagttcccaccaagtagaaggtgtcaataatgttgttaagtaaataattggactagaaatgaggctgaaacttaatgacacttgaaatatgcacatgcattcatttgggaccttccttttttcaagggaaggtctttggaaagagagcatccacagtgcaggaaaacagaatttggtcccctgtcgaacaactacgtgcgtgtcgctcccctggtggatcctgtgcaagtgtagattctgattccacaggtcttggtcaggacctgagatcctgcatctctaataagctccaggagataagaatgctgctggttgctttgaataacaaggcaagcgagcaaacattttgttaggcacagtttaaggttcctggttgtgaaggcaagattcacagaacagcaagtagtaaacagtctcaggacttaaatggaagtcataagtatcagagctatgggaggtcaggaagtgacaggtggtgatgattcaggagtgacaagctgtagctggaagtcccccattatctccaccagtccccaagtgcatgcagataaacacaaaatttctaaaaacaatgtgtttgctctgcaaaagcagcttcaagataaattctgtaccttgactttcacactaggcttattgacctcagctcctcccaaacagaaatctgactgtacttaatgtgatcattctactcagtcacacagtgacttgacccattttgttttctggctcacttgcatttttcttcttaaaaaaatatttagtcttattttttattgataaataatagttatacctatttatggcatatatagtgatatttccatatatatactgtattgtgatcggattaggttattagtatatccatcatctcaaacctttatcacttccttgtgtcgggaacattcaatacccttctagctatttgaaattttatcttattgttaactgtagtcatcctacagtggtccagaacactagaatttatccccctatctagctgtaattttgtatcctttgacagatctcacttgcatttctaaccaaacggggtgcgcttctgccttctactatgccattcacttatccattcattctacaagcatttactaagcactgcctatgtatcagatatgatgttcggtgttaggaactgaaaggtaaataagatattgcggtaatgaaatcccaatctctgaagacagtctactttacagggtcaataatgagaaaagatagtgaactagttggaggaaaaggtcctattttaatatactatattatgtgtctttgaacaaaattctcagagtaaatgtgtgtgaggtgaaaactttgctttgttctggtctcttttttaattgtgaaagtaatacatggtcattacagaaaacactgctgacagctaacttctattccaggggtatattccagaggtaacttcctcaccccatccttgcctctttacagtcatatgatttattgaaaattaatagcatttaaaaacttatgttattggcatcaacagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccaggtaaggctaaaactgcccaagccagttacacagtgtgtctcataactgttgctgtaggttcctaagctgggaggaaaatgtcaaggcactcattttgattagaaccaaaatacctttctctactttccccactttgatagacctgatgcccattctatcatgtttcactttctaagtgattccatggcatttctacaagagtcaggcggcttgattttgcttccctaaccttaaggcaagaacagaaatgaactcctagtctccttgggggattatccatacgttcaccactcactgctgtattctcaaatgtgactgatcgtggaccattttacaacataacttttactctattttaagaccagagtgggtgttgaattttatggattagggaaaatgaaggctcatttgtatttagattatgttgatttctttccttctttctctatttcattctttctttttattttttgagacagagacactctgtcacccagggtggactcaagtagtcctcctacctcagcctctcaagtagctgagactccaggtgcataccaccacacctggctaattttatattttttgtagagattgggtctcactatgttgcacaggctggtctcaaactcctggactcaaaacaatccacccgccttggcctcccaaagtgccaggattacaggcatgaaccactatacctggccgatatttctttcataagcagaaaaatctaaaagacaattctacatgaggaaaaataaacaaatcaaaagaaggtgtttagggcccattcaaatcttttttttttttttttttttttttgagacggagtctcactctatcgctaggatagagtgctgtggcgcgatcttggctcactgcaacctccaactccctggttcaagggattctcctgcctctgcctcccgagtagctgggattacaggcatgcgccaccatgcccagctaatttttgtatttttagtaaagatggggtttcactatgttggccaggatggtcttgatctcctgacctcgtgatccgcccgcctcaacctcccaaagtgctgggattacaggcgtaagccaccgtgcccagcctcaaatcttaaagaagagaagaaaggtgtgagattatgttttcttaataactaaatcatggtacatggtttgatcagtgtggggatttgcggaacaacagcatatgtgccttgacaatgcctctggtgacatattgtttctgtagatataacgctgccaaacctgagtcttttccctaggcagaaatgtttgatttttatgtctcaactcttgtctcataacagtgggtggtcggcccttcttactttgtggaatacttaattaaagaatcaccatgtactaaatcccaggccagcagctgttcacttcagtcctccgactctgtggtgagttttcctgaatgtcttcataatttgagtgttcacagatcatctctaagtgtttgtggagcataaattacatatgaggtgtcataaggcatgagatgcttttcttcccctcaaggagcatctgactagttagagattagacagatccagactgcattcaattgtaagtgcaactttcatcagtagttgcaaaagtgattatatagagctgtaaaatatagacatctcagtgatgggtaatggccctgcttcagtctaacacaatccaattacgtttgtaatatagcatggtgttccattccttggaccactctttaagaaggacaaagtcaaataggccttcattcaaagaggcatccaagagggaaagtatgccttgaagtcatctgaaatacacctggtgggaatttaacttggcacaatgtgttggagtgcaactgggcaaaatgcaccaaaatacttttcctctcatttacttacagtaacagctttattaagaaataattcatacgttgtaaaattcatccatttaaggtgtacagttcagtagtttttagtatgttcacagagttgtgccaccatcaccactttcttattttaggatattttcatcagcctcagaagaaacctcatgcccactaacagtcattccccattgccaccttaccaagcccctggaaaccacttacctactttctgtttctatggctttgcctattctggacatttcatataaatagaatcatacagcatatggtcttttgtatctggcttctttcacttagcatagtgttctcaaagcttctccatctataaataaatgtagttttacctctttgcataatttattatgcaaataatattttattgcatagatattgtttattgtttatccatctatcagttgataaacatttgagttgtttcctgctatgaacaagtgtacaagtttttatgtacacatatgtttccatttctctcgagtatatacctcagagtggagtttttgtcatatgaaaaacaacaaaaaaatgctccatgtttaaccctttcactgctatactgttttccactgtgaatgcatcagttttgcaatcccatcagcaatgtatgagggtttcaatttctccacatctttgccaacacctattatgatctttcttttggttatagccatcctactgggcatgaattggtacctcatcatgatttttatttgcattttcctaataactaatgatgctgagcgtcttttaatgtgtttattatccattagtatgttttctttggaaaaatgtctacataaatcatttgcctacctaaaatccagttgcttatcttttcattgttgaataataagagtctttacatattctagatacaatgtccttatcagatatatatttttaagtatttttctgtcattctctgggttgtctattcactttcttgacaacgttctttgaaatacagaagttttaaattttgatgaagttctatttatatatattttttcttattttgaatatgcttttaatgtcatatctaagaaaccattgcctaatccataatcaccaagatttacatgtgtaaaaatgcaagggatccagaatgccaaaataatcttgaacaacaacaacaacaaaaaaataggaagacatacttcccaaactcaaaacttactacaaaggtacagtacttaagacagtgtcttggtggtataagaatgatatgtagatcaatagaataaaattgaaagtaaagaaataagcccctatatgtaggcctatgacacattttgagtttttgtacacggtgtgaggcagggagttcaacttcattcttttgcatgtgaacttccactgtttccagcactatttgttaaaaagactattctttcccccatgtagttgccttggcatacttcttgaagatcaattgatcataaatgtaagagtttatttctttaatctcaattttattccattgatctacacttctaagcttatactggtataacactgtcttgaatactatataactttgtagtaagttttgagattggaacatttaaatcctcctattttgttcttcttgttcaagattgctttgggtatcctggatgccttgaattctcatgctgattttaggaccagtttgtcaatttctatttttaaaaaggcagttggaaatttgatacatttgattgcattgaatctgtacatcaacgttgaaagtactgtcatcttaacaatattaagttttcaattccatgaatatgtggtatctttccatttgtttagaactcatttaatttctttcaacaaagttttgtagttttcagtgtacaaaactttcatttattttggtcaatttactcttcaaatattttgttctctttgatgcttatgtaatgaaactgtcttcttaatttcatttttggattgttcattgaaagtgtgtagaaagacgattgattttttatattgatcttatatattataaccttgatgaactcatttattagttttaatagtttgctagtggatttcttaggattttctatatgatcatgtcacctgaaaagagatagctttttacttctcccttttaaatctggatgccacatgtgttcccagcctctagggctcacatgttcagcacacttataaagtccctttgtgatccactccagtgtcagcgccaggtaggcctatgaactttggtagctcagcaaatcctagctagggtgggagtggccagatctccttggtgcaagtacctgcagtttctccagaaggttctctgagagcccctcctctttgtgacttggtgatgaagagaaggaaaaggctgaagcaccattccccagacacttcatactttaatggcttttcccactttaaggaatttctagtctttttttcatatgctctggagctgagtgacaaagtaatatttaggcaatctgtttagacactttttttctttttgtagatttagggatacaagtgcagttttcttacattaatatattgcatagcggtgaagtctgggcttttagtgtatccatcacccaaatagtgtacattgtattcagggtggtttttgttttttgtttttttttctctttttgagacagaattttgctctgtcgcccaggctggagtacagtggcgcaatctcagcttcctgcaaacctccacctcctgggttcaagcgattctcctgcctcaacaacccaagtatctgggactacaggcacctgccacctcacctggctaatttttgtatttttggtagagacagggtttcaccctgttgaccaggctggtctcgaactcctaacctcaagtgatcctcctgcctcagcctccaaaagtgctgggattacaggcgtgagccactgcgcccagctcaggatgatatttcatccctcaccaccctctcaccttttggagtcttcagtgtctgttactccactttgtgtccatgtataccctttctttagcttccacttttaagtgagaacatgtggtttttggctttctgtttctgagtcatttcacttagaataacggcctccagttccatccatgttgatgcaacggacatggtattattcttttttatagctgagtggtattccatgggtgtgtgtgtgtgtgcacacacacacatgcacatcacattttaatctaaccatccattgatggacacaacatcggcttcacatatttgctattatgaatagtgctgtgataaatatacaagtgcagttgtctttttcttatagtagtttctttgttggcgggggtggggggggggggtaaatcaccagctgtgggattgctggatcaaatggtagttctatttttagtttatttttagataaatttagtaaattttatgtggatatacttaagagctcttctttagaaattgaggcaacattttattataacattctatttatgcttgaaaatgtacatacagtatgactctaaaattcctcttctaggaatttattctaaggaagtaactaggaatacatgaaaagatatagcttcaatgtttaaacaacagaaaaattagattcaatctagctgtccaacaaaagagagcttgttaaacatcacagaggaatactatgtagccattattttaaaaaccctagaagatcattcaatgccataagagggtttttacaatatattgttaagtgacaaaatagagttataaagtaatatatatataatatgactctattttgtagaagaaaaatgtatatgcatagaaaaaaagactggaaggaaggaaatcaaatcactgcaggtaacaaatatatttcatgcaatttacaggtctttattttcttttgtttatctatattctaactattacatttgtaataaggaaacaaagctactttacttttaagtaaagagaaatttaaggagctgagagtggttttgtctgagaagagaaatgtcaggtggaacgcacttaaagggctgctatataaaagatgaaaacacgttttctaattgacccaagggtagaactaaggccaagaggtagaagttgtatggacataactttccactcaacacaaagaatttttttaacaaacagagtttcattcctcaagaaatactgagtttctcattattggaggcaatttagcctaatttggatgatttcttggtaggggtgatctagaaagaattgactcagagtctacctgttacatagtagaagcataaaaatgttgattggctgtgtatctacacaagtagaaagctagttgatttccatctgtgatcactggtaatactcacatgacattgtattttctcttttagcctgttggtctttgcaaaggttctctgactcgaacacactgggaaaagtttgtctctgtgacttgtgacttctttgaatcacaggtatttttcaatctaattgcctgtctttctgtgaagaagagcagattatcgatagttacctgccactaccttaccccctcctttgattttcccaaccaccttgctcaccactttgcgcaggctagcctgagtccacatccacaggatagccagtcaaagacctgttatgccttgtttcagtcgcaatatggtcctgcagaataagcaagacaaattcagaaacagggaactgctggcttggatgtgattcaagcctctgagacattaaattcagcgtcccaaagaaaccttacctcaagccacagggagaagttatttccatgaaaatattcaatccctttccagaagtgtttattgcgcacttattataaggtagcctggtatatttgagaggcagtttatatttgaggtgtatttgtgcctggtatatttgaagcagttgaaacaggacacttgggatccagttttgctctggtacctgtgagctgtgtaacaggcacacacttacctgttcgagttttggttgcctcatttataaaatgggattgcgacactgcatcattcagatccctgtgagaagcaagtgaaaggacctgaatgaagggtgctgtacaaggcctggtgcagaataaacaagcaaggaaaggcacctgctgcttccactactgggaacagaaagagagcttgctggagacttcgagtgagtcattgaacctctctgggccattattcagctctgaaattgtgagacttacagtctcacagtcaagcttctacaggtcctggttccccctggcccttatctgttttgttttttaaccctttcaccaggaggcccatccctctacctagtctccctttgaaatgttccaacagaaaggcacagatcagcttaggctggtactaggcatgggaggactttccctgtggaactctacattcaaaaatgttctcattccaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaccgggaggcgtgagcaactaatgcccagcacagtttcagtccctaaattccctttaattccaggacaggtattagctgcgtagggcccataccatttccaaccctctacctcttttcatctgtctggaagtctccaggtctcaacagtggggtaattcacttagagctggaggcacatagaagggaagtgcacatgtggcctgtgctagacactgtgggagcagcagaccgtgacagttctcatcactgttacaatttctctaggacagttagaggagggctcatcacagcattcaattacagtctacgttttccttctttcaaacactgcagggccaatttcccctcattcagtgatacctatgtgcacacgcacacatgcacagcagataagactttggacattttgacagagaatttgcagatgcagctattgtcctctatcttggtggctgttagaagaggcacacaggcctcagcataatttgcataagagacgtagacaatgttcacactctgttcctcttatctgcttctcataagaaggaagtgattatgtgggggtgtcatgtggggtcttacaccgtgttggtcagggtctgaaagaagcagaattgtactcaggtggctcaactaaaaagacttcagttggctcagcgtgctggctcatgcttgtaatcccagcactttgggaggctgaggcggccagatcaccggaggtcaggagtttgagaccagcctggccaacatggtgaaaccctgtctctactaaaaatacaaaaattagccgggcatggtggtacatatctgtaatcccagtcactcgggaggctgaggcaggagaatcgcttgaacctgggaggtggaggctgcagtgagctgagataatgccactgttcgccaccagcatgggtaacagagctagacgccatctcaaaaaaagaaaaagacttcagtgaagggacctttagtgaaggcttgttgcccaggctaagggaaggccaagggatgctgaggcacctggacagcctttgccacccgaggctgagcaggagcaggagtggctagcttccccgctctgttggaactatcctgtggagaagccgccctgcagaagccgccctggtggagggatgcagcccctgcagaacccggtgctggaacgagaaggagcagggaataagcaccctcccctctccctcccttcctgtttccttccaatctcctcctcccaatggctctttgaactcaatggtaaactagccagcagggagagcctgggttattcaattccctggagccagcctgggagacaagaccaggcagagaaaatcaaaggatgggcctgaggcaaacagagagaaaccattaggagccttagctggggtttcccaaggggtgttctataaggcccttctctactggtaaaaggatggggaagggcctcagactttgtttctccttctatctaccacctcctttgtctttccatggcttaattcgtgaaaaactagattgttcccatgcttgccacttccccaccacctcttcattccttaggtcacagtaatgtgaatctatctcttttcccataacccactgacttggtgttccctaacaatcttttattttaaattaaaaaaaaaatttct

SEQ ID NO: 17213 - DNA, 47883 bp, Human; identical to SEQ ID NO: 11886
  misc_feature (1)...(47883): n = A,T,C or G

SEQ ID NO: 17214 - DNA, 17972 bp, Human
gttaatttttataaccagtaatttttatgttgattaccatgctaaaagataatattttgaggccgggcgcagtggctcatgcctgtaatcccagcactttgggaggttgaggcgggcagatcacgaggtgaggagttcaagaccagcctggccaacatggtgaaatcctatctccattaaaaatacaaatataagccaggcatggtggcacgtgcctgtaatcccagctacttgggagactgaggcaggagaatcatttgaacccaggaggcggaggttgcagtgagcagagaccgcgccactgcagtccagcctggtgacagagcgagactccatctccaaaaaaaaaaaaaaaaaaaaaaaaaagataatactttggctatggctaagtcaaatatagttaaaattcatttcgtttctttttactttttttgaaatgtcattaatagacagttttaaattacttatgtggttcctatttatttttttaaaaatataagtaggctgggtgtggtggctgacgcctgtaatctcagcactttgggaggccaaggcaggtggatcaactgagatcagtagttcgagaccagcgtggccaacagggtgaaaccccgtccctactagaaatacgaaaattagccgggtgtggtgacatgcacctgtaaccccagctactcgagagactgaggcaggataactgcatgaacctgggaggcagagattgcagtgagccgagatcgtgccactgcaccccagcctgggtgacatcgtgagactgtcaaaaaatatgtgtgtgtttgtgtttatagagacaaggtttcaccatctctgtaattacaggcagacgccaccgcgccagactcttagggtatgatatttttaaaagatatttgtttagtgtttgagatacgcattgacaacaggtcttttacacccattctcatgttatcttcaaaactacggggtgaaatataattattctattttaccaaagacagatttgaggctcagaaaggttaagctatttattcctggaatcaatccgtttatttgaaaagcttctggaagacagggatcctgtcttaaacgctgtgtttcttcacagcacctagcacttagctctctccacgtggtaggcgctcagaaactttgtgctgaacgaaggatatggattctcaagtcaaagctccgagcgcaaagccagggagcgaagcaccagagggcgcccatgagcccgcccacccgcgggtcgccggggcccaagctggacctcaggcctgggtgcggctcttcagccccaagcagctgcgcgccccagcagaacagggggcgagggggcgagggaagccccaagtcctccgtccgccccgccccctccccagagccaggcctcgcagggctgcacggtgctgaatgacgactcgacatcctgtttttggggcccgcggctccgcctgcgcctctgctgatcttgtctttcccttgggtgctgacgccagctcctcttccccccgagtctccccaccctccccaggggtctggggccttcccactgctgaatcaccaccacctcgcactcccccggggctcagggcaggggcggggactgccccagcctcggccaccactctatccctggggttgactgaaggcaccaggcccaggggcgcctttctcagcatcttcccgcggaggctggtgggggcgggatggggggaagaggacgaacgcctagcgcccagggtagggcctccaggggtagggtggccaggaggaggcggagagacttgaccttgggaggcctgacttactgaccgcaggggcagcggactgggaggggaacgtggcaagcccgggactgggccgggggcgaggctgggggcgggccggggctggagagggggagatcggccctcggacttcctggtcgggccccgccccggcccgccccgcctcgccggcccgccccccccacttcctccggcctcccgctctcacttccttctcgagcccggagccgctgccgccgcccccagctcccccgcctcggggagggcaccaggtgaggcccggccggggctggcgggtaggggtccgggggaggagagcccggccggcccaggactcggcgcgggcgccggctcatgagtttgctggcggaggccgcgggcgggagcttctcggttcagtccaagtagggcgggcgcggccggccgggcggggcgggaacggggccactgcgagccggcggaggctcggcgagggtggcttcccggcggctgtaccgcctctagggagccgagagggacccctgaggtcggagggtcccgggctccaagataagtgtctctgaagtggaagagctcagagctgggagatcggacgcaggtggggtgtcctcagaagttggtggggggggtgttgagaagtgcgtgaggggagagggcttctgggctggaaaaggcgctccctctgctctggcagttgtgacacttggggtgagaggggcggtgtctggggcctccgaaagctctctccctgtcagatggatgctaatacagacccacactcggtctgcagccccaaggccctctgcactcaggaggacccgggttgggtgggggagccccgccgaccccagtcgttgtctgtatgtctgttttcctgagtcccgaccttacctggagccaagcagtaggtatttagtgagcagacgctgttcctagctgaccagagcctggccttgctcttttgggagtaacttggtcttgccctgtaactggaagtggaaggactctcattcagaggtactgatagtccctgacaagtttttgttgtgtcttttggggacaattgagaaccatctcctagtgttcctcttcattcttagtccctgaattatacacatgctcctgtcgtctccctccacaccttctttagtttctacccacaaatccgccatcactctcttctcatcccttccagtctcttttcctccaaacatacggtcatacctaggccttgacctgtcttcacctaccctgccccatgttcgtcttggtcctctgcaacctgccccatcccttcccttcccagctctggcacccacacacatgcacctcctggtttcttccatcacccctcattccttttgaaccctcagcctgtcaccctctctgtatccttccctcccacccacttatctccagctttggaatcagttgttgaagacttagtgagttctagagtcttttcaaacctccctagcttggagaggcagtctgcagcctcccagtgatagagacggattaaagagctggaaagcctgtgtgtgtgtgtgtgtgtgtgtgtgtttgcgtgtgtgttcgcacgcgcgtgtctgtgtatctacatcttcatctcttagagatggattaaagagatggaaagcctgtgtgtgtgtgtgtgtgtgtgtgtgtgtgtgtgttcgcgcgcgcgtgtctgtgtgactacatctttatctcttacagacaaaataactgccctcagccttgagagggcccagagcaagggaagccagcagaatgaagggaacctgcagtgagtgaggttgtggttaggcaggaggaagccgtttgtagcagtcagggtagggtgacacaggaataagacttgtaagagaggccgtgggaaatcaaaatcaccccaacccgtggtgcttgaccaagaggccaggcctagaagccggaagacagcctgaaggtccctgactccattacctactagttccagcatcacctggtggaaagaatgggaccagcttgggtgtgatggaaataaagggaggaggcaaatgcaggattctggaggaaagactgcagctggtctaacttcggacttaagaagcggcggaggcaaaagtgtctgctcctttcctgctaccttctggggcctgcctaggctgggtacccgcatgccctgatctgcatcagggccttagtgaccaggaagccctctggagttctactgacccctctgccttcaggcatccttaatactccccatctcacctaggaccctattccttctcaggaattcctcccaaatttaacttcagtccatcctggctatggaggctcttgtttccactctagagctccatcctcaagcttttggggtgcatctgaggatcttgctcctgtctacctcctctagtcatctgtattcatttctctccactagaaaaaaagagaagtagaggggagtaagtgctacagctaaatttaagggctctccctgttccccattctgtcatctttcccatgtcacagtcgtccctctcccatgaattgttcttcttccagtcctgcccttccaaccacttgtctctcttcccatttcttggaggtacagaagtttgggtccgggaagaaatcccagggacctacataagagcccaggttagagaaggatgtgcatacaaggcactttcccagcatcacagcttaataaaaaccccaggagtcccagttcctaggctggcaaaccagtagttactttagtattctgcgtaactgagcaaacccacagggctctgatggtaaagacaagatgggtgagacagggattctcccaggtgagatctggccccattggaagtttgagctaattgcaaaaaaggcatcattggaaaaaatgtgaccagggcgggagagattttaatgggaaaatattggggggtaaagggaggtggtggctacaacctaggaggctgccgctgaagtcttggctaaacaggtatggtcaaggttgtgacatgaagaagggggctcaggcccacactgaagactccttctatatactgtagacccattagtggtgaggtcagtaggggtccgtgacaagagctgaggagggaaaccaaagacaaagcctgggccacctccccagatcagactggttttcctgtccagggtccagcttcctcttttgtcctcatctcatatggggggagggcatctctccaggagctagaggccagaggaggagcttctcagctagggcagggccagagtggctggctattgagtaatgtcagtgctaaatcatgaatgcaccaggatgggctaggcatgagagcctgggaacttggaagcaaaaaggctcagatgtaagtcaacccaccctttggcccattttctgaaggaataaaccatggtagcgttctcctgaatgaggttaaagagatggcccattctcaggccagagttagaatcctcaccttctctcctttgtagaagtagcataagggtggaggctagaagatccggatccttgtcgtagatttgctacctggtcaacttggtttctcttggctctattttagcattaaggagttgcatatcagtacctccaaaggcaacagtgaacatcatggctctgactcttcctcccccaagagactgctcatagcagtgcccctcactctgggcccttgtgtcttaccagcctcaatttgacaggtccgagtagtctgtacatacatatctgtccagggatagtactgccctttccccaagcacaaggactgttagagcttgagagataagaaggcagagaatgttggggattttgccagggggtagtaagatgggggagtaccctgtctcctactccagctctgcctcactgacagtggaaaatagatgccggagtttcctccctggtgttattttcccttgtggaaaccccctcaggcctcgggcggggctaaagggactgggcagccctgggtctctctgtgggtattttcaggtgggggtgccaggatttgcaggatggcacttctgtacagcctcatgtgaaattagcaaaggcaaaggaagtgccacttcacaggcctttggtggggcccagggactgctgagctgctgctaggcggggaggaggaagccagtgtgcacccttcctctgtgctgcgtgggggagggggcagcttccttggctcccccagccagagctgtcctggtcctgaggctcagctttttttttttttttttttttttttttttgagatggagtcttgctctgtcacccaggctggagtgcaatggcgcgatctcagctcaccacaacctccacctcccgggttcaagccattctcctgtgtcagcctcccaggtagcggggactaccggcatgcaccaccaggcccagctaattttttttgtattttttagtagagatggggtttcaccatgctggccaggctggtctcgaattcctgacctcaagtgatctgccagcctcagcctcccaaagtgctgggattacagatgtgagccaccatgcccagctgaggctcaccttttatggaacacttagggtgctgggacagtgagggaagaaggttgggaactaggacttagtgaaagggtcctagactgcccccagccttcccagctaccactgtctcgtttcctagtgggtggcatcaactcttctcttttcctacctgctgctgcaatgtaggatcctctccaaaggctgaaggatgaatgacaagaggtggagagtcctccagcatggattttttctttcttttttttttttttttggagatggagtcttgctctgtggcccaggctggaatgcagtagcatgatctctgctcactgcaacctctgcctcctgggttcaagtgattgtcctccctcagcctcctgagtagctgggattacaggcgtaatcccaccactacgcccagctaatttttgtatttttagtagagacggggtttcaccatgttggccaggctggtttcgaactcctgatctcaagtggtctgcctgccttggcctcccaaagtgctgggattacagacgtgagccacggcacccgggggattttttttttttttttaaggctaggaactgggctctcttgggttcttccctgctgatggggagaaagggaagaaagagactcagcccttggcctggtcccagtcccacactgacctcatgtctcccccagcttcctcctcccagcccagctgcagccagctgcagcccctttgagcctctttatatcacctctcctctattcctcccttcaaaacaaacaaacaaacaaacttgtagagctttggaagtgtttccaacagtgcccctgtcccttgccatgtctttgaccaagggtcctcggatattcccagtctgtagcctgtcgggaccacttttccttcccatcttcctcatcatctctgagctagatctgccagcttcacctctcacccttccagttgaagacaagacagtatagcttatgtgtttattaccccaactttgggctcttcagggtgaatgagaaagaagttggttacttatgtcttgtgtcttctggtcctagaggttcttccttgttcccagcatcagagtctgtggattgatgggggaggaggggtatgtcattctacagcttttgctcagcccttccctgggcttctggaaataaacagaaggtcagactacccttcccctgaagcatccagttagttcagcacaatgaaaagtacggtcaatgctgggaaaggtaaggcagaagaggggattgctgtgatgtcctggagaagctggggaacagtactggacctgaaggacaggaaggatctgaaggggggtgagtcgcattccaggaagaggaactcccatatgcaaagacatgattgcatcgacttcattcagtcatttactgacagctactacatggtgtgctcagcttagggtgctcagcaaggtccagtcaaccaggaccttgccctctagacactcccattctaataacaagagataagattcacatcagcctctccaagcctgtgagagagacagggaccagactttggataggataagtcacttctgacttggataatttacgctttcctggaagaggcagcaatggtgcatggttccatattactacttggtgtattttacggaagagaatatggaggcccctttgtagaggatcaggattggaatggccagagatggattgtagttataatgaggttcagggagggctgcagaaagggagccccatgttagggaggcaggttatagaaggctgaggtaagttcccatcacctccatactcgcctatcttttaagagtccgttcctcccctcccccactcccagttgggacacttcccctgctgtaacagccacagagatctggcaatcaggctgcttcctttccctcccccattctgggcctgcctgggccacaccccaaggccaggccccactgggtacaagccgggctccagggaccacattcagatagggttagacccccatgggctatacttcctgccggagccaggtcagcctggtactgggaagagagatttttgcctatttcaggcatagcttttgcctgtcattgctgtccgatgagattcagcattgcagtcttgtctgttggggggtgggcagggagtgtccgatactgggcttcagagaagtctctccatatctcagtgatgagggctggtacaagcagatcaaaaggcaatggttgtacagtcctgtgtgcctagccctatacttagaggtttttttttgtcatttagtccagagaagccaaggcttcagtactgaagggcatctacagctgggaaacttacgtatgactgttggaaaaggagaatcacacagagccaaagcagggttaaaaggggtggccatgggtgcagtggcttactcctgtaatcccagcactttcagaggccaaggcaggtggatcacttgaggccaggtgttcaagaccagcctggccaacatgatgaaatcctgtctctactaaaaatacaaaaattagctgggcatgatggcacatgcatgtaatcccaataactcaggaggctgaggcaggagaatcacttgaacccgggaggtggagattgcagtgagctgagatcgcgacactgcactctaacctgggcgacaggtagccatgcaatggatatccaaagaagaattcagtaaccttatgcaactgtgagacttaagttaggccttaaggagtaaggaagattagagaagggagagggaatggcagcagagggaaaaacaaagagtaaaagttcagaggcaagaatgatcctggcttgtttgcagaggacattgaaaatccctctggaacagggagctgggaactcacacttgcaaagtacctacattgtgcacatattatacattaatgcacttagtccttataacagtgctatgtggtaggtactgtacgttgccactgcatttgaaagataaggaaattgaagcttagagaggcaaatcatcagaagctcagggtcacacagctggtaagaggcagaactaggattcaaacccaagtctacgtaactctaataccccttatcaaattgtgaagaactctgaatgccagtatgagggaccaggcatgatctgaattgggactaaaaagccagaataagtcattgtaatttgtctaataacatacagatctggccaggcatggtggcccacgcccataatcccagcactttgggagggctagtcaggaggatcacttgagaccaggagttcaagaccagcctgggcaacatggcaagaccctgtctctacaaacaaacaaaaagatgcattaaaaatacaaaaattagccaggtgtggtggtgcctgcctgtagtcccagctactcaggaggctgaggtaggatgccttgagcctgggaggttgagactacagtgagctgtgatggcaccactgcatttcagcctgggcaacagaacaagaccttgctccaaaagaaaaaacaaaacaaaacagattggcaaccattgatttactaaataactttttttttttttgagacatggggtcttgctgtgttgctcaggctggagtgcagtggctactcacagggacgataaccttgactagtgtacacactacaacccttcactcctgggcccagcctccctagtagctgggactgcaggtgcaccactgagctgggcttaatgattcttttgaaaaagccacttagtgaataagtcattgttgaaccccgctccagataggtcacactcctggtttggtgtcctgcagcactgacatcccttcttcctgtttggcacagtttagactctatatgccctcctgaaatgggctatggtaacttattcaacccagttcaggccagaggatttcagaaagaagagttgttttgggagagaggataaaggtctgaactagacctgagtagggaggactgggctgatcccctaccacagatacaggcatactcagtgcttcctgccttctgggatgaaaggctttgctcctgtcacctcctgtgtgtacagcacttcagtttacaaagtgtattcattcccatggtcaggttccttgatgctgcccttgaggctgggaggggtactattattacttctactgtacagataaagaaacagaggctccaggaagggcagtaacttacctgatcaaggtcacacagttagctggtaaggggtaacttgaagactgtatgatgcaccaaggaaaacacaggactttgggtcacaaaactgggtttgtgttctggctcccacactaactagctgtgtgatgttgagttacttttactgttctgaatttgtttcctcatctgtagaataggcatagtactaacaggttgttataaaggtcaaatgacataataacatgtgacctataaaggcttataccatatgagggcttttttatcaagggtcaaggtcggcagataaactcaagacatcagagtcaggtatccagtactcttggccctataccacactgcctttgctctgcttgtttctggacactaccatactcatcatccttttccagtgtcggtcctcgttcccttcccagcccggaagctaccctgtccttcccctctcctttgagagctgatttactgattgctagttgataaccacctctttagagagctgtacttccactctcttgggccttgtgacagccagccggagttccctccttgccttcctgcctgggccagcccagtgctgggcttttcagtcatactgtcaacacccactctcctgctctgtgtggaactgaagattacaggcccaggagttctgctttgaatgtcaaggcttcccacgtaatccgctgggcacaaataatgccacctgcctccaaggagctttaagtcttagttcatccacctagtgctcttgtaacaaccattttaatctctaattcctggataggaaaactgaggcccagcaagcgtaaatgcctcatgcttggttatagtgagtcagcagagctggggttagaacttaggtctctcaacttccagtctgaggtctctatttgactctccactggcctagagggtccttatgcccttccctgacccactgtctgagggtctctatctgaatgtcctgacgttgcatgcacacgtgcacgcgcacaaacacacacacacactctctctcattcatgcaaataggatggaaatattttttaatgtgaaccagagacacaacttcatagagtgaaaccattcctctcccagctgattccaaggcaaactgtagcctgggagggaggtgggaccaagccctgggtcctttgcagcccccacatgacgaaagtttcttttccacttcccagtggggattttcttccccacttgtcattgatttttgaagcttctgaaccagtggtgagagcccaggctgggggggtaaggggttcccagaccagggtgcagccttgcagtatagcaagtgaaatggagaaaatgggctagtgttgatggtgcttgggtggagccagggataaggaatactcagggatttggttgtgtttaaaacagggctgccccctctcagggagcaggccctggttgtgggagacagtcagggaaaggaagtcacatattgaccaccaagagtcccccatggccaagaggaagtagctgatgagagaaggatccttgccatagcagtgtaaataatcacagggtttctggaagctgtgttccagaactcagaaaagcagttcatctccccgaggccctgtgacctgcagaggtaaccagatgttggctggagctgggactcctcatacttaccccactcataaatacagcagtccatttattgggcacttgctatgtgccatacctcatgctggacatcttctatacattattaactcttactttttatttttttttttttgagacagggtcttgctctgtcgcacaggctggagtgcagtggtgtgatcatagcccactgcagccttgaccaccctgggatcaagtgatgctcccacctcagcctcccgagtagctgggactacaggtgtgtaccaccacaccctggtaattttttcattttttgtagagtcagggttttgccatgttgcccaggctagtctcaaactcctgggctcaagcgatctacctgcctcattctcccaaagtgctaagattacaggcatgagtcaccgtgcctggcctcatttcatattctgagcaattgtaatgcaataggcaagattatccccattttacagatgagaaaattgaggctcagggaacaaatatattgccaagatcacatataactagttggtggagctgtgattagaatacctgcgagtcttactctagcatctatgttcttaatgatggtattttctatccaagagtctggaagtctctaaaatctttcagaggcacatgccaggatctcaggaaatggacagaagattgaggggaaagtcaagtttttgtcttactcttgacttcatccttcctagttgggcctgaaagatttgctccaggccgggcatggtggctcatgcctgtaatcccagcactttttggaaggccaaggcgggcagatcacaaggtcaggagttcaagactagcctgactaacatggtgaaaccccgtctctactaaaaatacaaaaattagctggacgtggtggcatgcgcctgtaatcccagccactcgggagggtgaggcaggagaatcgcttgaacccgggaggtggaggttgcagtgagtcaagattgcgccactacactccagcctgggcgacagagcaagactccgtctcaaaaaagaaaaaaatttgctccaccccaccaagggccttgagagaagatactaatgtctgggagcctcagcctctacctcattcatcataacatacccagaccccagtccaaatcccaggtccaactgaatctccagtattcccctgcattgaattggcaatctgagtgtacatggccagatagggttttcagtacttacaagaatgatggggtggccaggtgtggtggttcacgcctgtaatcccagcactttggaaggctgaggcaggtagatcacctgaggtcaggagcttgagaccagcatggctaacacggcgaaactccatctctactaaaaatataaaaattagccggatgcagtggcacctgcctgtagtcccagccactcgggaggctgaggcaggagacacttgaacccaggaggcggaggttgcagtgagctgagatcacgccactgcactccagcctggacgacagagtgagactccatctcaaaaaaaaaaaaaaaaaaaaatttccccattgccagaataccctggattgggatagggcagctctctaaagaattgagccccttactcagcaggtttcttaactgtgcctttgggtttgtactcagtagccaagataccaggtttggagagggcagggtgggccctgagttgagagaggttctacttatggctgcatcacagagtgacctgggacagctgtcctgtgccaaaacactttccagtctcctggtggaaagggtccatatttagtagaggatctagtagatccctaaatttgtgcactctccttttgtgtctgtatagcctggaaaaaaaaaatagctaatactggccaggcgcagtggctcacgcctgtaatcccagcactttaggaggccaaggcgggcggatcacgaggtcaggagatcgagaccatcctggctaacacggtgaaaccccgtctctactaaaaatacaaaaaattagccgggcgtggtggtgggtgcctgtagtcccagctactcgagaggctgaggcagaatggcgtgaacccaggaggcggagcttgcagtaagccgagatgacgccactgcactccagcctgggtgacagagtgagactctgtctcaaaaaaaaaaaaaaaaaaatagctaatacttgtggacgaggcactgttttaaatgctttacatgtattatataatgctcacaatgacccagtgaggtagatattattttatcctcattttactggtaagaaaacttaggcatacagaggttaagcaattttttcagggttacacagctaggaaatagcaaaatcaggatttgaccttagtttgtctggcgccagagtttatgtgctttctaccacattatactgcctctttgcttggcctcagggcctttcattgtgtgtctttctgatgaccgtcttgatgggactttgggatagtgtcaggttaagggaacaggagccggtttccctttgtgtgcccccatcttttcttcccaataggcagaggcctccctaaccaagaatgtcccctttcatctgtccacaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtggccccggctcctccctgtgtgctgggcattagcgggtgggcatgggctagggctccccagagactgggagccttttgtttcttctagtagacaataggcttcattgtggtcccctcacccctcaatttccctaacaaagctctaggctcccttggagggggcagtcttgctctggggcccagtcacagatgctgtagtggactcagacacaaaacctgaggaaagacttcttgatcttagggctcagaaagggagaggttcagagccattagtctaaaggcagatgctcccacagtcatgcatgtgacagctgtacctcacatccccaagaggacagctttaacaacaagagttggaatttgaacccaggtctctgtctcaactgaagacttccaggtaccctagcttgcagtcctagaatcattacagatagctcactcactcctgctcaccaaaataaaggcttagaccagctttaggagactccagacctaagggggactggggggttctgctaggaatcataccctgccgtggacttactccctccccattcttgagcctgtttctctcccagttcctatcaaacaagatgagccccaagactagcaagcctaggcaactgttggcccaaaaaaaaaatttattttcctttcaaataaaatgtacaaccaaaatttagggtttggagcagtagggaagacaggagataccagggagcccattttacagtagagatctgcatctgacccctctatcccatacctttgcaaaggaggggaggggtctacaagccagaactttcagaagagaagaaaatacatgctgtgctggtgctgtttctggagcaggtcatcctttaggtatagaacaccacctccacccgatgacatcagaaccactgactggtagagtccttggaaatcatacagtccacccatcccccgccagacacatggacacaccgaggctcagatggggaagggtacataccctagggcacacaccaaatcaaaaaggtgaagtcaggactagaacacctgagcaactttagcaggggactgtggccacaggcctggatgtgcacagtagatcatgaaatacattagtcctatgaatgacccccgtgcagagaaatggctgtggttgtcagggagcagccactgctcaggggctcctgacctcagtgaaaggtgactgtgtaaaggccagaaactggatggtggtcatgaacctcaggacgtttttttttttagcaccaaatggtggagctctctgccagctcagcttcttggggcctctcaggtaaaggtgatgtttgaggaccccacgcccatatgaggggtggagaggagaagccagcagcactggggtgagccttggcctacacccttccttcttacccttcccccatcttcagtaaggccaagagaggatgtggggtggggaaggccagaatggtatcgtgtttcttgtttctgggcagtgggctgcgtcctcccaagcaggactgaagggttcagaatcgcttttcctcaggctgagaggttatgagcagctccttgttcccgaagtcccaccaggccgtcatgtggaacgccatgttggttaagacaacagtgtactccaggatggcaaagatggtgtacactgttgtgaggacacaaggaacaggacatggtgaacttccagctacccgctcagaggcctcttgataaatcacaccaccattggtctgccacagagaacacaatggcagccagtccccaagaccattgcccattatcaaaaacatcattgctgccccgcagccactcatgaccgcctgtggatcctatcctggcctcacctccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgg

SEQ ID NO: 17215 - DNA, 23193 bp, Human
  misc_feature (1)...(23193): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattttcacaggtttttttttttttttttaatggagtttcgctcttgtcgcccatgcttgagtgcagtggtacgatctcagctcactgcaacctctgcctcccgggttcaagcgattctcctgcctcagcctcccaagtagctgggattacgggcgcccgccaccgtgcccggctaatttttgtatttttagtagagacggggtttcgccatgttggccaggctggtgtcaaactcctgacctcaggtgatccgcccgcctcggcctcctaaagtgctgggattacaggcgtgagctaccgcgcctggccctcacagggtttttatgaggattaaataaatgagataagaagtaagagtgcctgggatatactgggtgttcagaatgtgttattgctgtgaggatttaagtggaaaagtgcgatgttaggtatggctaacttagaggtcctccacccgctgcagatgctctgactacccaccagtgtgcttgcaggaggaattcttggtcccttcaccctccttccctgttgggctgggatggtctttgcaaagggagccaggggtccccctcaagttctttcatgggtcagtcatggtcagggtagggagggaactctggcagctggttttgggggatcaatcctctcattgtggggagacccaaggctggtggctggaaatcctttctgcgctacgtaggacagggcgccctctcctgaacaaaggcgggaacagctctaggccagagtttctgggatgtgcctcaccgggtctcactgcctgcaaaggtgctcttcccattgctgaaatgtccccaaccgccctgacgagcaaagtttgggggaggggcgccagggctgggaggaaactggcttaatgtttcagaagggcgaggctggatagttcggttagaatggaggtgcgaggcaggagagacgggcggatgagaaagaaatccggcccctgttgaattaattttgtgttctttcaacaggtagatggaacgcagctgagaggtaaggcgacaaggtggcttatccaacatgctcaaactcaggtatccagagctcttccggctgccctcacgcagccgaaattagtgggggcagacccgggctgtaaagcatggtttgaggacacgccagattgaggaggagagccaggggtcggggtctccagaagcggggaggagccagcggaggatctgggcgcagtttcctctctaagttccgccccgagagcgccggccccgcccccgccgttcgcgctctgaccagcccgcagagccagcccccgaccccgggccacctgggcccccgggttccgccggcactctcgccaccaccgcgtgggtgagtatgggcatggatgtgctgggctgccgggcagccccactcgggagcttggccgcgcggtctggcctctgcagggccgggccccacgctgtgggagtcctggtacctgccgtcctatcgcacacactctgtttcccaggaactgctgctctctggacttgccgagctggcccccttcttctccctccccagcgtggggccgggtgtgcaggggttgagctctccctttattccgcggggcctcctggtcaggagtcctaggtggggaggatggggccccggggttggaaccccatagagtagttttgaatggcagctgtgccatttattagccttggccttgagtaagtgttttgaacctccctgagcctcagtttcctcatctgtaaaatggaaatatacaggctgtagcacctacctcatagaattatggtgagattaaaagagacaatgtatatcaagtacagagcagggggcctagtattccgtaggcactcagtaaatgtgggttcagactcgaggctgaggagatctctagggactttggagctgaggtagctccaaagaaagcaattttcagctaagtagtacctgtgaggaatgtagaactatctgcaggctgaacaattgcccttcagctccaccctgaggtgtggagtagaatgaccaagttggaaggaccttagaggtaatctaaaccatgtgattcccatgttgcagaactgtggaaacagatctagagtgcttaagtggcttgccaaaggtcacacagctaaatgggaggccaggcatacctccaagaattggaatggattatcccttgaacctcctcatcaactcctgatttgggcagtgcctcttcattccctgaagatctagtcttcaatttgggaatcctagtggttcctcagggatctagagctgcagccttcagggagggatactgggagggaagactagtgctactgcaactgcagagtctaggtttgggctgggtgaggaaaatgttccccatctagggccctaagggacttagagtccatttagggatgatccagggaatgtgttttttttctgggagggtcaccagagccacttccagctccctgggatccctgatgctcctaaaagggagagaggaacttgagcaattggagcaggctgcctgatcaggtctggcagctgggggaaaatgggtgagaatgtggaggcgtagccacctggcttgttctggaatgccaggatggcaacctaactgagatcagggttctttttgagggtgggactaaagggagagtcttgtgggtggggtcaggaagagttgggacttgatttgacaaggtctttgagcccagaagggtatattctttatgtgtctggagccagccctagcttggcaacaacaagccaacgttccagggatggctttcccttcagctcagcacagggctttgaggaagagccagcccttctctctctctgagtgtcttggtttctctatctttacaatgggaatagggctaactgcctcatctatgtagattttggtttttccttttcttcctcctgtgaacaggtgcctcttctgcctctctcactccagtcctaacctgacctttctcaagttcagacacagagaggaaggggtcaaggaaggccagagttgcagtgtgtaactcttcgtgggtcccacatgtatctctttgttatgtgatcctgagcagattcctgctccaactttcccttctgtatactgtgcggagctgggctaggattgttggtatacacttatttgttatagttcctgaccttagctacccttatctaagggggaaatcacagcccccaggaaccctcatctgttcacaggagggtgatgtggacagccccctgggcactgggaagcctccagaagctgaccaagcagctctctccagcaaacagcaatcccaggctagcaccaggcctgattctgcaaagcctttcaccctgggggcacgtgagggagcaggctgggacaagcagggggcttggggttctgtcagcttccatggaatccctgccactgtggactgcggtgcaggcacacagagcctgggaagggactgaaggtgcaggagggccctgggccagtggggaagcaaatgagagctgatgagaggccttgaagcctggaggctgggccgaggctcaaaggcctgggggaggagatgggccatgccatccactggtaggttttagggttggttcttgaaataaagagagacacttatttaaagcagcttctctagtcctaggcctgtcaagctaggcagagaggagtgaggagaagctctcccagtccattcaagctttatcctagcacagatttgtttcattgtcttccctctgaaattgaggtggaatgttgtcttgggattctgagtcagtcttcctcatccagggcaagagctatccaagtttaggtgccttcctcctcagactccccaccccacagcacacagctaattttaggactgagcacaagggctgactttatcactgagtgccagcctggctgcctggggccctgacagcatgccactccatccccaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtagggcatggggacactgatacctcatattcaggccgatctggatcttctttagatcttgaatatcttttaacaagattagccagctctccactggggcccatcaaacatacggggctgctggggggatgcctgcaaattgaaatctcaagggttagtctccctctgccttctgtgaggttctggaggctggagtcactgaagtgtaatatagagtcagtaaatgaattacaagtataacagagtttgacacatgtcccaccccatttactttgatatcctagagaaagtggtcttacatctttcttcctggccccgcgccccatatccctgtccagagggcagacctagagccaaatccttacttcatagaagagcagattctggaaccccagggtttctgggaagtggagagagaacaggattgggctagagggtattttgggcctcttaatgtagcactatgggcttgtgcctgtctctgtaggaatgtgactcagtatatgtgtgtgtgattgtgagggtcatgactgtatataatgggtttgagtgggtcgtgtgtgagagagactatatctgtgcctgtctgtatggagatctgattatgtacgtgtgtatgtgtcctggggtgagtcccgtggcctctaagattccatagatgtctgtgtaccctctggacagggatatggggtgcggggccaggaagaaagatgtaagaccactttctctaggatatcaaagtaagtggggtgggacatatgtcaaactctgttatacttgtaattcatttactgactctatattacctgagacagagacccagcctcagtttcctcatgtctgaaatagaattgattagctgggcatgggggtatgcacctgtagtcctagctcctcaggagcctgaggtgggaggattgcttgagcctagaagtctgaggctggagtgagctatggttttctcactgtacttcagcctgatgacatagtgagacccccatttctaaaaaataaaatagggttgataattcctgtcctgctccttcccagggctagtgtagagctctaggtagaagaaggataggaaggtagtttagggaggatgatgaaatgtgaggagcagaaggaggaggaggaagagactgtcaggttggaaggcagggcaggaaatgaacttaacctaggggctttaggtggagaagaggcagattctgcgcatggaccattggggtccctcagagttctgaaggccccagccagctggatccccacttcatgtaaagagcatctgcttcagagaaatggctaggattagcagtggggtctagctgtgagtatggggtggagccccacttctttacttcatgtgactggagtttcctctcctcctgatttgtcagtgggtagacatgggtgttgaggtatggacacccaatctgatgagacctggggctgggagctattagaaagaactggacgaaaagggcgaacaggcgatctgaagggaaggagtacccttttgtgacctagtacatgacctagtacctattatctcagataatgcatcagatattcctgttacgctagccactcctgatcatcccgcaaaaccctgccccgctagctctaaaatgtcttccctatcctccttggggctaatgtaatcactccctcctctgggtgcccacagttccctgtgttatctatcacatcatatttgtgtctgtcttcccaaccagatggggatctccttgaaggcaggcactgcatttgagtgagaaagtatttgggtttttttatttgttttagaggcagggtctcatttccgtcacccaggccagagtgtagtggcatgatcatagctcactgcagcctcaaactcctgggatcaagcagtcttcctaacctcagactcctgagtagttaggactacagatgtgagccactacacccagcttaattaaaaaaaaaattgtggagatggggtctcgccatgttgcctaggctggagtgcagtggcatgatcatagctcactgcagcctcaaccaccagggcacaagtaatcctcctgcctcagcctcctgagtagctaggacaataggtatgcacaaccatgcccagctaatttttgtgtatgtgtgtggagacggggtctcacactgttgcccaggctggtcttgaactcctgacctcaagtgatcctcccacctcgactcccaaagcactgggattataggcgtgagccactgtgcctggccagaaagtgttggttgaataaatgattaagactccctagcccagtgccctggggaaaggaaggcatggtataagtcaatcatagtccaagcaaaattataatatttgtatagtatatggagttaaacagactaggctgtttgctctgccccttatggctgaccccaagggctgatggcatcaataccctattagctaggttattgcataccttgcatacctattacctgttctgggcataccagttagggaattaagatatagatagttgctggagtacttggtccctctggagcagtactaggtctgtgaccctgagggtatgttgtccccactgcctgagcctacggtgttggttccaccttggaatttttatatttgctctgaatttcccactcagagtatcccagaaatggccagccctaggaataaaagaagcaagctagtccatcatatctgtaattgattactttgcctctgctcgcatatccccagtgatggggagcttccttcctccccaggtagcctgttctaaggaagcttaataactaataattagcctttttcttttattttctttctttatttttatttagatgtagtctcactctgtcgcctaggctggagtgcagtgttgtgatctcagctcactgcaacctccgcctcttgggttcaagcaattctcctgcctcagcctcctgagtagctgggattacaggtgcccgccaccacacccggctaatttttgtatttttggtattgacggggtttcgtcatgttggccaggctcgtctcgaactcctgacctcaggtgatccacctgccttggcctcccaaagtgctaggattaaaggcgtgagccaccatgcccagcctcttttttttttctttcttcttcttttttttcttttaacagagatagtttctcactatgttgcccaggctggtcttcaactcctgagctcaagtgatcctcctgcctcagccttccagagtgctaggattacaggcttgagccactgtgcctagcccaagctttttctttccttctttccttctttccttcttttctttctttctttctttctttctttctttctttctttctttctttctttctttctttctttctctttctttttttctttttttccttctttctttccttctttctttcttttctttcttttcttcctttccttccctttccctttcccttgccctttccctttccctttccctttcctttcctttcttttcttttctttttgaggcagggtcttgctgtgttgcccaggctggagtgcagtggcacaatcttggctcactgcgacctctgcctcctgggttcaagccattcttatgcctcagcctcccgagtagctgagattacaggcatgcaccaccgtgcctggctcattttttgtatttttaggagagatggggtttcactatgctggccaggctgaagcttttacttatagtgagtatgtacttactttccggtgagtctctgccttggccctggctctgctttgccgtagaactattctctcctcgtggcttcaggtcagccctgtagagacaagaagacagtaatgaggggccttgagtctgtcttcttctttttttttttttcttgagatggaatctcgctttgtcacccaggctggagtgcaatggcacgatctcggcttactgcaacctccgcctcccaggttcaagcgattctcctgtctcagcctcctgagtagctgggattacaggcacaccgccaccatgactggctaactttttgtattttagtagtgacggggtttcactgtgttacccaggctggtctcgaactcctgacctcaggcaatccagttccttcaggcaaccttccaaggaaatggtttccaggctcttccctatcctgaatgtaccgttgaacttggcccagtttgtcactgttctctgctgggccttgatttgggtatagaactccaggtggcctgggcagtacaggcaaaagcaggactattcattcttattcctggctgttagacctctgttgaggcagcctgagctgctattagctgtttctgcacaggtacaggctgaacatcgatatctcatattcaggcttgttgagatctcttttgtatcctgcttctgtcatcataggatttagccatttctccagtgaggcccaacaagccctctcagtcctgctctaacaaaaaacggccagacccctttttgctttctctctttcccttattggaaacctgcctatgaccctggatacaactctcaggaaggtccctgcccccatcactggcaaagaagctactgccagctgacctcagccactatcacttcttccctttgcagagtgttctaggatttatgacatatgcttgttgatcctgggaaggatgtgtgcctgggcaggcgtggagaattgggtactgtgggcgggagggcaggccctgaggagcagggggtgggatcctccagtcttagaatagtcccagtctggctacaaccttcaacccaagacccggattcttcagcaccgagtgtgagtgttccttcatgaggcccccaccccattcctgggtctccttagtggagggaagtatgagtgccgaggggagattgggtcctaggccttttaatatcaagccatctctgtctgcctcagcttgatccagagggaagcccagcttgaggggtcaaggtgtttgggcagtggggttgtgagggggagttgtcggccaggagggagaagagattggaagaagctcagttccctgggtctgggtctgacctggacagagatctcctgggtctggcccaggacagcaggctcaagctcagtggagaaggtttccatgaccctcagattcccccaaaccttggattgggtgacattgcatctcctcagagagggaggagatgtaggtctgggcttccacagggacctggtattttaggatcagggtaccgctggcctgaggcttggatcattcagagcctgggggtggaatggctggcagcctgtggccccattgaaataggctctggggcactccctctgttcctagttgaacttgggtaaggaacaggaatgtggtcagacagggtcagtgggagggctttggccattctgagccaacggtcctttgttagttggcctgaaagaagccatgacttagaacctgaagctgtcaggtggcaagaggccttagtcctggtgtttgatcctggcatagttctgggcctcagtctccccttctgtgaaatgggaataataacctttctacctctgacccttctcctgagtggctatgagggttgtgagagtgaggtgggccaccagagctccctgtccaagccaccgggagcctctcttctgtaggctcttcaagaggtggacctagagtatcactgtgccagggggattcctaagctctgaccctgcctgtctctgctgctcctgccccatctccctctgatccttctcctctgcactgtcttccttttccccttatgccttttctaccctttctgctctggcttttccttatactctgaggagccatctctggaaaaggccccactttcccagacccaggtgtcctaccaggccccaagttgtatccctcgtgctgcttaggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgagtgccagctccccagcccctgggtcagggccaggtcaggaggtggcagttagggtagaattagatagtggagaggaagtggaggatcagagagagggaaagggacaaggggatgggggaagggtaggtaagtcagagtcacagataattcatggggggagactcagagagaatagaatcacagccctccctgagttggaagatgatgatagaaatgcaagggagatgacgggcgcagtggctcatacctgtaatctcagcacctcgggagggcgaagccagtggatcactcgagttcagttcgagaccagcctgggcaacatggtgaaaccccgtctgtacaaaaaatgcaaaaaaattagctgggtgccctggcatgcccctgtagtcccagctacttgggaggctaaggcaggagaattgcttgaggctgggaggtggacatttcagtgagctgagttcacaccattatactccagcctgggtgacaggagtaaaaccctgtctcaaaaacaaaacaaaaaaaaaaaaaaaaaaaacagcaggctgtgcactgtggctcatgcctgtaatcccagcactttgagaggccgaggtgggaggatcacctgaggtcaggagtttgagaccagcctggccaacatggtaaaaccctgtctctactaaaaaatacaaaaaaattagctgggcatggtgatgtgtgcctgtaatcccagctactcaggaggcttgaggcaagagaattgcttgaacccgggaggcagaggttgcagtgagccaagatcgtgccaaaaaaaaaaaaaaaacaataacagtgcaagggagttgggggttagagggaggtgataggggaagagaagggattggaatgggcaggagagatcatgagaggaaggaggcagattggaaaggaagccaggactgaggaggtaaaatgaggccagaagatgggagatgtaacaagtggctttggcccagactcggggactgaccttggaggatccatcctcagctctgatctggatcctcaagctttgtttctcctactggcagccccaggccccaccacctgtatccactcagggatctgccagccagaaacctggatggacttctgtctcccacaatcagtccactaggcctttcctgggggcccagggataaaggttctgttgtgctaggggcatggaattagatatggacttgcccttaacatctcaatgttacaagaatcaatccttagacacagactgtcacaacacagtggtctggggttcctattatgattaaaaaaagagtacagtgactgtggggctcagaggaggcacttcacgcagcttggacattggggatcactttcttcttggaggaggggacattgttgctctgtggtaaagaaggctctttgtgaatgccaggccggcaacttttgatattatccagagggcaatttttatcaagagctttggaaagattttaggcaggaaagggacatgatcagatttgtgctttacatatttatttatttagagacaggatctcactctgtctcccaggcgggagtacagtgacctgatcttggctcattgcagccttgacctcctgggctcaggtgattcctcgcctcagcctcagccttgggtagctgggactacaggtgcatgccaccatgcctggctaattcttatattttttttgtagagatggggttttgccatgttgtgtaggctggagatttgtgcttcagaagaccactctagcttctgagtggagaacagctttaaggtcaggggcaagagtagggtataaggaggctggtgcagtagctcatgctcctgggggaaccagagccaagatgcggactgtgagcgtagagaggagggatggagtctagagaggtgtagaaagtgggattgacagcaaatggagtttttgtgcagttggcatggggcgggggacagtacggtagctagagaaggcatctataatgtggggggacttttacctgaggccaaaggaatgaatcttatggtgaaatctgaggtgccgtgcaaggggattttggggaaccctgctttataccatatgagtttctgatctactgtcctatcagaaagggcttatcctcccgtctctcagtactcttagctctgggcacatggggaagtttggggtgagctgtgtacccagtttctcatagctcctgatgttgcttgttgctggtgcagtcgatgagtggggaacttgtgtgctggaatggggctggcggtaggagtacatgtacctgattgtgtgtatgtgtctgtgtgtatatgtgcgtgtgtgtgtacatgatggaagagacagtccctgctcttagaatcccacccccatccctaatctgagagaagctcatgaagacaggaccagcagccacaatgccctaactctctcttcctcctgaggccttccccaaactctgtatcatttctccccagtacctgttcccaacagtggtcagggttcagggcccttgaatcctttaggctctcccagtcaagctttagatggtggtcctgttttccttaaagtagctgagactggggagtagttttcagattgaatattccaggaagcagaggcaatgctctgactaactcaactcagagtaacagcaaggcagaaaaatcaagtaaggagacttggaggttcctgcatctctcccataagcagaccttcccatgctctgtggccatgtagctcacagcgtttttgcattctttacaggaaattttgtcttctgaaagccatcacttattgtacttaactgcatgccagatactgcagatgttttatacacgttatatttagaattcatatggcttggcatgttggctcacgcctgtaatcccagcactttggcaggtgaatcacttaaggtcaggagttcaagaccagcctggccaacatggtgaaaccccatctctactaaaaatacaaaaattagaggccaggcgtctgtaatcccagctactcgggagactgaggcaggagaattgcttgaacctgggaggtggagtttgcaatgagttgagaccgcaccattgcactccagcctaggcaacaagagtgaaactccatctcaaaaaaaaaaagaaaaattagctgcgtgtggtggcacctctagtcccagctactcagcaggctgaagcacgagaatcacttgaacctgggaggcggaggttgcaatgagccaagattatgccactgtactccagcctgggtgacagagcgagaccctgtctcaaataaataaataaataaagagaattcataaacaccctgcaaggtaggtggtgttatacccattttaccaatgaggaaattggagctcagagaggtgaagtgacttgctcaaggtcacccagctaataaaggcagagctgggatgcagactcagctttgtgcagttcctgagcctctatgctgccccttcacattactcagagtgcatgtctgagcctggtctcaagctatgatatctcaagctatggtatctcaagctatggctttgagaccagcatcttctctcccagagctctacatttagcttcctctgacagtgcagaagggaatccatctccttttttgtggaggctgtgaagccccatggctagtcttgccccaggcctacctgtgggctgccctatgagccgcctgcagcattgctcaccttctcagcagtctggcatctcattgaaagaaaggaatgatggtccttaagaactccacttccgaagactgtccctccatagttagagcaaattcattcccttgctgggttgctgggctctggcactgcgctggccctcgttggaggtctgcagaagtgcacagaaagtgtgggcaatggactggccatttccacagttttggaaacttttaaaaatccatattcttgctgggggtggtggctcacgcctgtaatcccagcactttgggaggccgaggcaggcagatcaccagaggtcaggagttctgagacgagcctgcccaacatggtgaaaccccatctctactaaaaatacaaaattagctgggcgtggcagcaggcgcctgtaatcccagttacttgggaggctgaggcaggagaattgcttgaccgcaggaagcggaggttgcagtgagccaaaattgcgccactgcactccaacctgagcaacacagcgagactccatctcaaaaaaaaaaaaatgcatattctggcttggcgtggtggcttatgcctgtaatcccagcagtttgagaggccgaggggggtggattgtttgagtccaggagttttagaccagcctgggcaacatggcaaaaccctgttgctactaaaaaaaaaaaaaaatccaaaaaattagccaggcatggtggtggctacttgggaggctaaggtgggagaatcacctgagcccagaaagtagaggctgcagtgagccgagatcgggctatggcactccagcctgggcaaccgaagtgagaccctgtctccaaaaacaaaagcaaaaacaaaacggccgggcgcggtggctcacgtctgtaattccagcactttgggaggccgaggtgggcggatcacgaggtcaggagattgagaccatcctggctaacacggtgaaaccccgtctctactaaaaatacaaaaaattagccgggcatggtgacgggcgcctgtagtcccagctactcgggaggctgaggcaggagaatggcgtgaacccgggaggcggaggttgcagtgagccaagatcgcgccactgcactccagcctaggcgacagtgtgagactccgtctcaaaaagagaaaaaaaagcagattctggccaagcgaggtggctcatgcctgtagtgccagcactttgggaggccaaggcagatggatagcttaaacccaggagtttgagaccagcatgggacacatgacgaaaccctgtctctacaaaaattagcctgctactcaggaggctgaagtgagaggatcacctgagcccaggaggtcaaggctgcagtgagtcatgatcatgctattgcactccagcctaggcgacagagtgagaccctgtctcaaaaagggggaaaacaaaattaaaaaattaaaaaatgcagatcctcaggttccaagccttctgcattttcaaacaattcccccagtgagttgtatgggtaattaaagtttgtgaagcactgctctaggccctggagtctaagagagcctcttcccatctttggctttcctgtccccatctaaacccttgttcagtcatcccccatcctttcacctctcaaacaagcaagacaccagtccctgcagctgtgtattatcttctcctttttccttaaggactgaagcttcaataggagttccaggcattaagatggatggtggagatgcacaagaacatggtcatttccttagactaccccaggttaggagcacccactttcttttttcttttcttttttttttttttttttttttttttttttgagacagagtctcactctgttgcccaggctggagtgcagtggcacaatctcggctcactgcaagctccgcttcccaggttcacacagttcttctgatcagcctcctgagtagctgggactacgggcgctggccaccacgcctggctaattttttttttttaagtagggacagagttttgccatgttggccaggctggtctttaactcctgacctcgggtgatccacccacctcggcctcccaaagtgctgggattacagatgtgagccatcgtgcccagcccacccactttgttaatcatgatcagagcaggggtgccattctaccaccttggcacacctgcctagaggagtgagtggcgctgggagcagactgaggaacatcttagctgagcagtgaatccagcactgttctaaggaagctcagatggtctgtgactcatccctgtcctctggactgaatctgaggccttggaactcacccagggtcttagtggaggcacagctctgagctatgggtgtagagcatctgaacccatctacacattgaccaaacacaggcaggttccagtctgcgggggagatggagaaggtgccaccatgctgctgcacaaatcccaggatagctggggaatgagaatccagcactttgggcctaggacctggaaggagaggtcttttgggagaggtatggggacatctgaaggaggacttcttggaaggggaggggctggagcagaggcaagagtgattttgtcagatggagagaaggttctccacatgggcggggctggcagaggcagatgcccagacaggtcacaactctctaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcagtgggtgcctggatgagggaggagtggggaagtgttccctgaggggacgggcctgcccctaccacattcggaccttcctacttcgtggtgtgggcactccctgcaatgtggctcccaatcctctttccctccagccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgcaaatggggatagaatgaggagtcgcatctaggcggcagtgagttaggaacagtgtcagaggactggtctgtcataattccagcgccccacccatgtacatgggtttcttttcccccacagtatttggaggtggggttggtgggtgactccatgtaactttcatactccatccccctgaagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggaggtgaggccaggataggatccacaggcggtcatgagtggctgcggggcagcaatgatgtttttgataatgggcaatggtcttggggactggctgccattgtgttctctgtggcagaccaatggtggtgtgatttatcaagaggcctctgagcgggtagctggaagttcaccatgtcctgttccttgtgtcctcacaacagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctagtcttggggctcatcttgtttgataggaactgggagagaaacaggctcaagaatggggagggagtaagtccacggcagggtatgattcctagcagaaccccccagtcccccttaggtctggagtctcctaaagctggtctaagcctttattttggtgagcaggagtgagtgagctatctgtaatgattctaggactgcaagctagggtacctggaagtcttcagttgagacagagacctgggttcaaattccaactcttgttgttaaagctgtcctcttggggatgtgaggtacagctgtcacatgcatgactgtgggagcatctgcctttagactaatggctctgaacctctccctttctgagccctaagatcaagaagtctttcctcaggttttgtgtctgagtccactacagcatctgtgactgggccccagagcaagactgccccctccaagggagcctagagctttgttagggaaattgaggggtgaggggaccacaatgaagcctattgtctactagaagaaacaaaaggctcccagtctctggggagccctagcccatgcccacccgctaatgcccagcacacagggaggagccggggccactggagacaggaggttttattgatgctgatgggggtaggaaaggtccccagaagcatgggggctgagtcagtcagcaaatgcgtaaggcctaggcacagaggagcaggttagggcacattcaccttctcaggattctgtggctccctcattggagaagggagagagcatcttgggggcgcaattccaagagcagcgagggcagaggttagagatggctgagagcccctaacctgaggcggcaccacaataggcagcaacaactgtgtggaaagctggatgaactggtcagtagcggaaaatgggagggggcactgggttggcctcttggggaggggtccaaccttggcttggatgagctcatgagaatacccagtgttcccaagcagaggggggcagagcccaaagcccctttctctgcaggcctccttaaggagaaaaaggcactcagagaaaaaggcattcagggaaccccctggaaaggggtgccagaattagtccttaaggcacagctgaggcggacaaggcaccaaggcacaactggtggggggagggcaggggcagcctccaagccaagtgccagggtcacaagaggatgcaggaccgcccacgcttgatcggcgtggggttgagcacagcccggacagcctcggcgaacacttccttgacaccatcctgttgcagggctgagcattcgaggtagcgcacagcgtggatctgcttggccagtgcctggccctgctgcggtgtgatgggcgcctggccctgctccttgaggcgccgtagggtgtcaggctgggctctcaggtccttcttggtgcccaccagcaggatgggcacatcagggcagtggtggcacacctctggatgccacttgtgccgcacgttctcataggacggcggactggcaatggagaaacagatgacgaaaacgttggtctgagggtaggagagtgtacggaggcggtcatactcctcctggcccgcagtgtcccacaggttcaggttcactgtgcgcccgtcaactgcgctctgcgcgctgtaattgtcgaacacggtggggatgtactctttggggaaagcgttagttgtgtagcagatgagcaggcacgtcttgcccacagccccatcacccaccaccacgcacttgatgctctgcatcgtgggtgcagttgctgtagtggaggcagtgcctcctctctcttctggacccctctggctgcagtgacctgtggacagatgaaaggggacattcttggttagggaggcctctgcctattgggaagaaaagatgggggcacacaaagggaaaccggctcctgttcccttaacctgacactatcccaaagtcccatcaagacggtcatcagaaagacacacaatgaaaggccctgaggccaagcaaagaggcagtataatgtggtagaaagcacataaactctggcgccagacaaactaaggtcaaatcctgattttgctatttcctagctgtgtaaccctgaaaaaattgcttaacctctgtatgcctaagttttcttaccagtaaaatgaggataaaataatatctacctcactgggtcattgtgagcattatataatacatgtaaagcatttaaaacagtgcctcgtccacaagtattagctatttttttttttttttttttgagacagagtctcactctgtcacccaggctggagtgcagtggcgtcatctcggcttactgcaagctccgcctcctgggttcacgccattctgcctcagcctctcgagtagctgggactacaggcacccaccaccacgcccggctaattttttgtatttttagtagagacggggtttcaccgtgttagccaggatggtctcgatctcctgacctcgtgatccgcccgccttggcctcctaaagtgctgggattacaggcgtgagccactgcgcctggccagtattagctattttttttttccaggctatacagacacaaaaggagagtgcacaaatttagggatctactagatcctctactaaatatggaccctttccaccaggagactggaaagtgttttggcacaggacagctgtcccaggtcactctgtgatgcagccataagtagaacctctctcaactcagggcccaccctgccctctccaaacctggtatcttggctactgagtacaaacccaaaggcacagttaagaaacctgctgagtaaggggctcaattctttagagagctgccctatcccaatccagggtattctggcaatggggaaatttttttttttttttttttttgagatggagtctcactctgtcgtccaggctggagtgcagtggcgtgatctcagctcactgcaacctccgcctcctgggttcaagtgtctcctgcctcagcctcccgagtggctgggactacaggcaggtgccactgcatccggctaatttttatatttttagtagagatggagtttcgccgtgttagccatgctggtctcaagctcctgacctcaggtgatctacctgcctcagccttccaaagtgctgggattacaggcgtgaaccaccacacctggccaccccatcattcttgtaagtactgaaaaccctatctggccatgtacactcagattgccaattcaatgcaggggaatactggagattcagttggacctgggatttggactggggtctgggtatgttatgatgaatgaggtagaggctgaggctcccagacattagtatcttctctcaaggcccttggtggggtgga

SEQ ID NO: 17216 - DNA, 121970 bp, Human
  misc_feature (1)...(121970): n = A,T,C or G
gatctccactcactgtaatctccgcctccctggttcaagccattctcgtgcctcagcaaaccgagaagcagctgggattataggtgcccaccaccatgcttgaccaatttttgtattcttagtagagacagggtttcatcatgttggccaggctggtctcgaactcctggcctcaaataatctgcccgcctcagcatcccaaagtgctgggattacaggcatgagccaccagcccggccagtatacgctttgctttctgcgcacagttcctgctatgagactctcagtcactaaacaggtctagtttctagaaaatgcccacctttcactcttgtaatatcagttttctgctaatgggctaggccccagaaggacttccaagaagagcccaaggcacagaaaaccgagggtaaataataggatacaaagtgacaaggctttaacagaggcctgcccaagcattagctcaactcgctgtgaaagcttggcaaatgtatcactgagaagatgggaacatttgaaatacccgtcctttaagaataagtaggggttcggctgggcgcggtggctcacgcctgtaaggccagcactgtgggaggccgaggcgggcggatcacctgagttccggagttcgagaccagcctggccaacatggtgaaaccccatctctactaaaaatacaaaatcagctgggcgcggcggcgagtgcctgtaatcccagctactcgggaggctacgacaggagactctcttgtacctgggaggcggagattgcagtgagccgagatcgtgccactgcactccagcctgggagaaagaggagacagagcaagactccatctcaaaaaaaaaaaaaaaaattagttcatgggcgaggtggctcacgtctgtaatcccagcactttgggaggccgaggcgggtggatcacttgagatcaggagttcgagaccagcctgaccaacacagtgaaatccccgtctctactataaatacaaaaattagctgggcctggtggcggacgcctgtaatcccagctacttgggaggctaaggcgggagaatcgcttgaacccgggaggcagaggttgcagtgagccgagattgcgccaatgcactccaccctaggcgacaacgcgagacttcatctcaaaagaaaaagaaaaaaaaagaattaggggttctccacgtgcagctgggaaagacgttccaacaatcctcatttgtaccaggccctttggtgggccagtcccttagggcatctctaatgctcctaatgtccatcctagaaattcagggagggaaagaaagtgctggggcgagcatgggtcaggagagaatagggtcaggatttagggccctgaagaagcctcgggcaaactctttggacagacagaccttccaagagggccctcaggctccgcacgtggtctgggcgggaagtgcgggcagagagactaggaagccttcccagcagcgccggcggaccggggcaaggaaagggtcgaatagttaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgttgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcggtaagtcgggagcccgagctgcagcggccgagaccggcaggtttctccccccttccgggcgggcggacgcgcggggcgtctcagggcctctccgcttcgaagtctagcgccgctgcgcgcaccttctggcctgagagaggggcggtgctgaggacccgggggcccggagcccgggaggcccggctttggaggccctgggagagaatggacatcagtggggtctaggcctggaggtctccagttgctgcccacgcgagtgggtgtctgtctggttgtactcattcattcagtggtgtaaggaccccacggtgggctggcctttccggggtcagcgccttgaaaccctgaatacggtctgccccgcacttccttgaccgtcatgtgggactgggctttatttgccttggcttctccataagggaagtgggcaccccgaggattagggtgagtccgaagtttgggagatttttaagataatatctgagaataggagtcggttcggtggagcaaaaggttcttttctattttcccacgtgttcagtgtaaagccagatgaggagacagattgagtttctggattactatagccataaggactttagaaattgtttaagtcaatccccctaccttacatcagttttgtagatggggaaaccgaggcccggagtaacaggcaggattagccaatgccagatttttgacagtctaaacagttttctactacctcaccctccctggatatttcagtctcccattattaagaattccctttaggaggtcggtgcggcatggacattaggtagctaaacgtagatgtagtcttcacagcgttttccgtttagttgctaccagctctgttcacgggtaaggtggaagcttcgttagtggtaccctaacctagagcttgagaactaaacttagaagatggttaaagaacgtcagcgttgttatgtatcggaaacaaatcggtaaaactacaagccattgtttccctttctaaatctgaattttttgacttgtgtcagctgatgaggactcggagtcagttagggatttataacagtactggaatagaaagcaggaaatattgataagacttagaaagccaggtaggagtccgtttgtagtagttgtacctcggaactcatggctcctttcaggtacagaattcaaagtgaagtattatagtagaataaggtgaggaaataaaactccgttttggaggaagaagctaactggaataaagagcaaaaagagagcagtgatcattccctgtgacggtcttacaaattcgaaaagaaactcgagttaactgggttacagtatgtttacctggtggaggaagttagggtatttaaaaaccaaaactagaggttggacaggataaaggtactgggaaatacttgggtaaaattattatttttgactcttcagatttgatgaaattgaattagttgacacttggttctgtacacatcagtaagattgttactttgttcttgtatagatgacaaagcataaactcagaactagtagtgcagaagagaaccgtagtctaaatagtaaagcgtgaacagggtatgttttccgtgacattttctcagttcaggcatcaccctcttctgggaagcttttcttggcattctcttctctgcaagcttccataacacttatttgatatttctatttatagcacatatcatttttattttagctgtttttttaattaggctggtaaaatattttcatcttatctttgttgtccagttgcttgccacatagtaggccctcagtaagtgtgtttacttgaatgaatagacaaatatggaggagttatacctaacagtagtcaatagagaggctcctgaaatatggggcccagataagatagttcctgctgtttatatgttatgtgatactttggtccctgacatttatttgtttatttatttatgagatagggtctcactccatcacccaggctagagtgcagtggcgcaatctcggttcacagtagcctctacctcctgggctcaagcaatcttcccacctcagcctcccaagtagctgagaccacaggtgtgcaccaccatacccagctaatatttttttgtatattttgggtagagacagggtttcgctatgttgcccaggctggtatcgaattcctgggctcaagccatcccccacctcggcctcccaaagtgctgggattacaggtatgagccactgtgcccagccagtacctgactttatgtctactaggtcctagataactaagtgcaagtagaatttttaaggaactaaatttacggctttgaaaaaattatattattttcttgtaatatgatttatgtggtggtagttaacctggaaagtaaagaatgatggtactaatgtttaatttccaataatgagactatgcagttatgtaatttgttgaaaggttagggaactaagaaactcagagatttaaggataagtattggctgagcatggtgactgactactgtaatcccagcacttcaaaggtcaaggcaggtggatttcctgagcccagaagttcaagactagcctgggcaacatggggaaaccctgtctctacgaaaaatacaaaaattaggcaggtatggtggcatgcacctgtactccagctacttaggaggctgaaatcaaagaaacatcagagcctggaagattgagactgcagtgctgtgattgcaccactgctttccagcctgggaaactgcgtgaggccctgtcttaaaacaaaggcgtggtgtggtggttcacgcctgtaatcctagcactttgggaggccgaggcgggtggattgcctgagctcaggagtttgagaccagcctgggcaacatggtgaaaccccatctgtacttaaaaaaaaatatgaaaaattagctgggcgtggcagcatgcgcccattgccccagctactcgggaggctgagggaggagaattgcttgaactcgggaggcggaggttgcagtgagccaagattgtgccactgcactccagcctgggcgacagcgagactctgactcaagaaaaaaagaaaagaaacaaaacaaaacagtatgtattagaggcaaggtaggtaaacatttcctgagaacttggtgcattctttttgtttgaaattgaccgtaagtatttggcacagtatggctctagagaaaggtttctcagctttggaactttgagactttgggccagataattatcgtgggggctctgttgtatattgtaggatatttagcaacattcctacctctacccattagatacccataacacatcctctgcaggttgtaacgatcaggaatgtctgaagaaattgtcagaattgcccttgattgagactactactttagtgaaaatatttcacatgtatttatttatttatttattttttgagacagagtttcgctcttgttgccccggctggagtgcaatgatgtgatcttggctcaccgcaacctccgcctcgtgggttcaagcaattctcttgcctcagcctcccgagtagctggattacaggtgcgtgccaccacacccagctaattttgtatttttagtagagacaggctttcaccatgttggccaggctgatctggaactcgtgacctcaagcaatccacccgctttggcctcccaaagtgctgggattacaggcgtgagccaccatgcccagccataattaccacattgaggaatttgtacttaattcagtgtaatgggaaatacttgcagttttttttagtaaggaaagaaaaattcttaaaaatatagtggtagctggccgggtgtggtggctcacacctgtaatccagcactttgggaggctgaagcgggtggatcacaaggttaggagtttgagaccatcctggctaatatggtgaaaccctgaatctactaaaaatagaaaaattagttgggcacagtgacacgcacctgtagtcccagctactgggaggctgaggcagagaatcgcttgaacccaggaggcagaggttgcagtgagcgcagattgcaccactgtgcttcatcctgggtgacagagcaagactccatatcataaaaagaagacctctaaatgtaccagtctttgcattctgacatatattatgttgttttctttgaagtatgtgaagaaaatctagcctcatacagatacatagttggaaaagagaggagtattttaatggccttttcagataattctaactgctctttgacactacagtcaaacctttttatttgtttgtttttttgagacggagtcgtgctctgtcgcccaagtcggagtgcagtggcgctatctcagcgtactccaacctccgcctcccaggttcaagcaattctcctgcctcagcctcctgagttgctgggactacaggtgcacatcaccacgctgggctaattttttgtatttttagtagagacggggtttcgccatgttgggtttgaactcctggcctcaagtgatccgcctgccttggcctcccaaagtgctgggatttcagacgtgagccaccgtgcccggcctcaaacctttttaaaggttcattacagtatggaatctgaaactgtgtcattgaacttttgtattctgttgtattaaaaaccattggtctgtgttgtactttgaatagacctttacacttctgtgattttataacatgatgcatgttgattttgaaattattgatttactgagttatgcagatcttctttttttgttgtttttttgtttgtttgtttctttgtttttgagacagagtcttgctttgtcacccaggctggagtgttgtggcacaatcttggctcactgtaacctctgcattccgggttcaggtgattctcatgcctcagcctcctgagtagctgggactacaggtgtgtaccaccacatctggctaatttttgtattttttgtagagacggggtttcaacatgttgaccatggctggtctggaactcctgacatcaagtgatcttcccgtctcggcctcctaaagagctggcattacaggcatgagccccataggcctggcccagatattccagatgttgacaaatttaattatacagttgtttctgtttccacccatctcatcagataagtctttttaagaattgagaagcttatgacctgatagtggtgaatacatgtttttttttttttttttttttttttttttttgagatggagtttcactctgtcacctgggctggagtgcagtggcacgatctcggcttattgcaagctccacttcccgggttcacgccattctcctgcctcatcctcccgagtagctgggaatacaggggcgtgccaccatgcccggctaattttttgtatttttagtagagatggggtttcaccgtgttagccaggaaggtctcgatctcctgacctcgtgatccgctcacctccgcctcccaaagtcctgggattacaggcatgagccgctgcgcccagccgaatgcatgtttttgtagttgtaatttttgtatcaaaatttttttttttttttttttagatgtagtctcactctgtcgcctaggctggagtgcagtgtcgtgatctcggctcactgtaacctcgcctcctgggttcaagcaattctcctgcctcagcctcctgagtagctgggattacaggcaggtgccaccacacatggctaatttttgtatttttagcagagacagggtttcatcatgttggtcaggctggtcttcaactcctgacctcgtgatctgtctgcctcggtctcccgaaatgctgggattataggcatgagccaccatgcccagcctttctttttttttttttttttttttttgagacgaggtctcggtctttcccccaggctggagtacaatggtgggatctcaactcactgcaacctccgccttctgggttccactgattctcctgtctccgcctcccaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagccccatgcccagccgtaccaaatcttaataacctagtttgtcaatcattctttgaaattaaaatggtgggcggggcgcagtggctcacgcctgtaatcccagcactttgggaggctgaggggggcggatcacaaggtcaggagatcaagaccatcctggctaacacggtgaaaacccgtctctactaaaaatacaaaaaattagctgggcgtggtggcgggcgcctgtaatcccagttactcggaaggctgacgcaggagaatgtcgtgaacctgggaggcagagcttgcagtcagccgagattgcgtcacttcactccagcctgggtgacagagccagactctgtctcaaaaaaaaaaaaaaattaaaatggtgttccatgagaaaaacaactacatttagctttcaaaagtaattacaggtggtttgccccttgatatcctttgtatttcagtaagcagaagtttttgagtatttcccaatactgaattaaaaagaattgtgctgtagtgttgagaaataatacaactaataatttttgctgcttcattaaggacccttttaagtgaaagtggaattttttatattgtaaatgggtgacagtgaagaattcagtgagtgttagttcagcaccatttggggttgttgctttgattcatgctgagttcccagcatttttgcacaccattgattttgcacgtcagcacagaggtcagaacagtaaagaaaaagggcaaagtgtcttagttttattgtgaaaatggttttgatttcattgaacccctggaagaagtgttggggacttttaggggtctttgggtcacactttgagaaccactaatctagaacaatatttcacattggttcatagagccctaagctgcttcatagggcagagctggtggggttctactgtacctactccctcttcacttcagccagagcagcttctgcttatgtctgttttatatgtcgggtttcatggctaaaaaatatttgaaaatcattagtcaaggggaaaagaattgagcacctgaattagggctggtctgttcgtgaagggaacagttcatcctcagtaaatgttacagtcactcatcacttcacatctttaattttacttcgtttgacacagagcttactagtatttgcacactcaaccttcttgataggtaaatggggctgtgtgccgtggctcacgcctgtaatgctagcactttgggaggctgaggtgggcggatcacgaggtcggaagatcgagaccatcctggccaacttggtgaaaccccatgtctactaaaatacaaaaaattaacccggtatagtggtgggtgcctgtagtcccatcttctcgagaggctgaggcagggaaatcgcttgaacccaggaggcagaggttgcagtgagctgagatcatgccactgcactgcactccagcctggcaacagagcaagactgtctcaaaaaaataaataaataaaaaataagtaaatgggcctggcacaggggctcacctataatccctgcactttaggaggccaaagcaggaagatggcttgagtccaggagttagagaccagcctgggcaacatagtggcacatgcctgtggtctcagctttttgggaggctaaagtgggaggatcagttgaacccaggaggtccaggctgcagtgagccatgatcatgccactgcattccagcctgggcaacagagtgagaccttgtctcaaaacaaaaaccaaaaaaaaaaaaaaaaaaaagaaataggtaaatgaatttgtaaattaaaaagatggatagttgggaataaagacagagatgtgagatagatggaagaggttgaatgatcatagtaatctcaatatattgtgtttgtgcagggatgggatttgtttttgtttgcagtggtgctttatgcttgtgctgagtgatcagtggatgacacttaagcattgagaaataagaaattatggcattctagctagccattgaaccaaagtttagagtgaggggacatttattatgctttttaaattataaatacctgtaaaatacctgttgaaaaataaacaaaatgctgcttttgaggagctctagtttgaggcagctttgtcctcctaccagtcttttggtgtaggctgtacaatccctattgttcagatgtagaaattgaggtctgagagattgaatattatgacttacagtagcaagtggcagaggaattttttatttttttaactttttattttgaattaactttagattttaagagtcaatgatggtaactgacaggtttttttttggttgtttttttgagatggagtttcactgttgttatccaggctggagtgcagtggcacgatctcggctcactgcaatctctgcctcctgggttcaagcgattctcctgcctcagcctcccgaatagctgggatgacaggcatgcgtcacgacaactggctaattatgtattttttagtagagacggggtttctccttgcttctcaggctggtcttgaactcccgacctcaggtgatccgcccactttgggcctcccaaaatggtgcgattacatgcgtgagccaccgtgcccagccttatacagtgattcttaatagttaggtatatatcctttcacttttagaaatttatttatttatttatttttggagacagaatttcactcttgtcacccaggctgtagtgcagtggcgcaatctgggctcacagcaacctccacctcccaggttcaagcagttctcctgcctcagcctcctgagtagctgggattacaggcatgtaggctaatttttgtattagtagagacagggggtttcaccatgtaggccaggctgggctcgaactcctgagctcaggtgatccaccagccttggcctcccaaagtgttgggattgcaggtgtgagccaccgcgcctagccgagtgacagttttaaatacagatgtctcacaccaaagctaatatactcttcactctaaaatgattagggttatgttaaggggatgaaaaaaatgctgctcagtgctattaggaaggagcttatgtaagatgctatggactatttaaaattaatttacacccagtgagcaaagtcaagacattttttttacccagagcagcagacaggtaaaacactcaggtggcaggtataataacaaatatattgcataactaaaagcagctgagagacactagtttacgtaatcggggttggaaaggaagaggggaagtaaagtgttttattttttttgagatggactctggctccgtcgccaggctggagtgcagtggcccgatctcggctcactgcaacctccgcctcctggattcaagtgattctcctgcctcagcctcccaagtagctgggactagaggcacacaccaccatgcccagctaatttttgtattttcagtagagacggggtttcaccatgttggccaggatggtctcgatctcttgacctcgtgatctgcccgcctctgcttcccggagtgctgggattacagacatgagccaccgtgcccggcctttaaagtgtttttatactaataaagagtttaagggtgtgcggcagtcttgtgaaagcaggtgaggcttgagcaacaatttttaggaagaaaaggagatacgatttttagagagggtatgatgttctttttttttgtttgagacagcgtcttgctctgttacccaggctggaatgatcttggctcactgcaacctccgccttccgggttcgagcgactctcctgcctcagtctctcgagtagctgggattacaggcatgcgccaccgcttctggctaatgtttgtatttttattagagacgggggtttcaccctattggccagtctggtctcgaactcctgaccttagttgatctgcccaccttggccttccaaagtgccgggattacagaccttgagccaccgtgcccggccttagagaggatatgatgttctaaccaagggaatggcttgatcaaagatctatcctagggaggatactgtaaaacagaaggttccagatagttttgttgggatatgttattaggttacactaggctaatgaatctcttcttcctggaattccacccagcctcgtttcccagccctcttttcttatctagggcaaaaattttcattcagtttaactgtgtgtgataatccctggctcttctagtatttttgtgaaggttagatgagaggatgtatgaaaaaatgctttgtaaagtaggaagtactatacagtccattcatctaacaaatatttattgtttttgctgtttgctggctttgatacaaaggagtttaatgaagtggaaaggaaaaaactacttcccatttacgtctggagttagcagcaaattggaaatgtcttgggaagcttgcatagtctttcagatagtcttaaagttgacagttgcctggagttgtaaacgttttgaccacatttcaggatatccactacttttctgggtagaaaactaagttttgtcattgtacccagagttcacagagatcacaaaagttaagatatgtaaaacagtatatcagtgtatagaacttcagtttggacagtgtcagaatatatgtctgtccattgattggactactgggtgtattataaggctacttcttgtatctgagaatctgaattattaattaggagatttttgagcatagaggacagagtaaaattaaggataaagttaaaggtttcttttctatataacactatttcatttttctttttaaatatatcaaaaagaaaaacctgcagtgggtataaataagtccattcataaagaaaaaaaggagaaaggttaatctttgttgtaaatttcatctttgccatgggtataccttataaattatccttactccataaaagagattatttctgatgactagaactcccatatttgccagagaagtgtctttccctgatagtgctggatctgtagtaccaattgttggttttgtaggttccccatttatagtgaatgcaaggtcattttcctttaattggcaatgttctttctctaggagctctaggctctagactctagaagcattggccgctggggtcaacgatagctttgtcttgggcaaatagattcttgtgccttaatttcttccttgtaaaatagagataaaaatacctacatcgttggattcttgggaggtttacatgagataattcataagcagcattagaacagtgcctgggacatagtaaaaactcaaatgttatcttgtattcttggtgggggtttcagcttgggccagtttaacatatttgaaaggataaaggctcaagtgtgatatgcctttaaactttaatgggtttatttctgtctctaggattactttttttttttaatggattttactacatttttggagtaaaatccaaatggaatggaaaatagttaatgcaaatatctgtattatctagatcttttgttatttgtttgttgagacagagtctcactgtgttgcccagactggagtgcagtggcacgatctcaactaactgcaacgtctgcttcctgagttcaagtgattctcctgccttagccacccgagtagctggaatcacaggtgtgcaccaccgctatcagctgatttgtgtttttttagtagaggcggggttttgccatgttggccaagctggtctcaaactcttggcctcaagtgatctgcccaccttggcctcccaaagtgctgggattacaggcatgagccaccgcatccagccttgttattgttaatagaggaagtaaagtgttacatgttctttctctgattatgtcagtagtcacaaactgaaaacccacaggaaccagacagttgatgtaaatgagtgatggtgggtattgtggcactttggagagtgcatgctctcacagaagagagatagatagagggaattgctactaagcttcagcctgtcattgccgtgaagtgattacagtcatggtttggttaattatcaggttcttcatgagaagccaaaaatccgttggttttttggttgtttttttttgtttgtttttgccataactgtattttttttttttattcatttatattttttgagacagagtctcgctgtgttgcccaggctggagtgcagtggcacgatctcagctcactgcaggctccacctctggggttcaagcaattctcctgtctcagcctcctgagtagctgggacggcaggcgcctgccaccacacctggctaatttttgtatttttagtagagacgggggtttcaccatgttggccaggctggtctcgaactcctggtctcaggtgatctgcccgcctctgcctcccaaagtgttggaattacaggtgtgagccaccgcgcccggccaagggtgtgctttagagtaacttgaactttttctgaatgcaaatgtctgtaccccagccctagacatttttgttcaatatttctagaatggagcctgggggtttgtatttttgtttgtttgcttgcttgctggagtgcagtggcaccattgtaccttgctgcaggcctgaactcctgggctaaagtgattctctagcttcaacctcactagtagctggagcttcgtacaggtgtgcaccatgttttttggttttttttgttttttttgttttttttaatagagacagagtcttgctgtgttgtccaagcttgtctggctttaagcagatcatcctgcctcagcttcccaaagcattgggatctacagatgtgagccagtgtaaccagccagagtttgtattttgaaaagcttgccacctaattctgatgtggccctctagaaccactggttttagtgagctttgtttaatcaaaggagttactcagtttttggatattgagataaagaacttaagtatttgattttttttcctaggaaatttcaggagagagaatatttctgtaaagcatttatttaagggacagccttatctttttcagtgttgcacaaaatgtttggttattagaatgactggaagtgttagtgggatactagaatttggggaagacctcaaaatgcaatatttaattctattatatgaacacggcctgagtttcctagaagaaaagactactctttacatacattgtgtggctataatagaaaaatcatcatctctgtcacagaatccagatgagcatgattgactgttttcagagtttttatgctgaaagtagtttacttattaatttattgtctgctagcagaaaagaggtagcaggcatctaaatttaaggaaaatttgtggagggggaaagctctgagtaaactatgaagctattttttatttttattttatttatttttttttaattgatcattcttgggtgtttcactatgaagctattcttattcagacagggggaaccaaacttttctgtgtaggcgttcttggaacagtttggttcagttccttaaatgaccgggtgcatagtttggatacaggagtaaaataatttatgtgaggtgagcgtttttgtttttgtttttgtttttgagacagagtttcattcttgtcacccatgctggagtacaatggtgcgatctcagctcactgcaacctctgcctcccaggttcaagcagttctcctgcctcagcctcccaaatagctgagattacaggcatgcaccaccacgcctggctaatttttgtatttttagtagagacagggtttcaccatgttgaccaggctggtcttgaactcctgagctcaggtgatccacccgccttggcctcccaaagtgctgggattacaggcgtgagccaccgcgcccagccaaggtgagcagttttttttatttgtttttgagacattgtctcaccctatcacctttgctggagggaagtggcatgataatggctcacagcaacctccaccttctgggctcaagcgctcctcccacctcagccaacagagtagctgggactacagtcccgtgtcaccacaccagtccaactttgattttttgtagacagggtttcaccatgttgcccaggctggtctcgaactcctgggctcaagcaatcagcccgcttcagcctcccaagctgtcaggattagaggtgtgagcccactgtgcctggccagaggtgagggattttcatcaaaggtttttctgtaatcttagaagtagaagatagataagtaggggaccatagagaatagtcttaaaacgtaatctcaaagagaatgtcagggcaccagaatctctgggatttagagatagaaggcggggcatgcataatttgaaaaacatttactattaccatgttttatatccctcgaaggtaggggagaaagaaactttataatgcaaactatggaaaataaagccttggccgggtgcggtggtttgcgcctgtaatcccagcactttggtggtgtaatctcagcacccaggtgggtggatcactcgatcaggagtttttttaagaccagcctggccaacatggtgaaaccctgtctctactaaaaatacaaataattagacaggcatggtgacacacgcttgtaatcccaggtactctgagactgaggcaggagaataacttgaaccaaggaggaggaggttgcagtgagccactgcacgtccttctgtctcaaaaaaaaaaaaaaaaaaaaatgttagctttttaggtggttgggttagcagactgtgttttaatttttgatggatatgattcataacctcctatgaggatcatataaacatcttgccttgtagacctgaaatatttattgattaaaaaggggacttaggttaaaaaaaaaaaaagattgaaaacattgttttaaatggatggttaatgttgggatctgaagtttaacctcacattatgaagtttaaccttactgttcagctcaggaacattgtagattataaagatcattttacaaggtttattttatcatacagtttgaggattttgaatgagagtatatactatagttcgaataggcctaagtttgtggaatgatagattttctaaaacaattatattccattttgtggtctttaagagagtgataatgttttctttttcccagctttctgaaacaaagactcattttgaagatgtttaacaaatcatttggaacaccctttgggggtggcacaggtggctttggcacaacttcaacatttggacagagtaagtttttaaaaaggacaaaagagggagaaaccttaatctcccttactaagaacaaatccactctgataagctttaggtgggaattttatttttactttcatatttataacaaagtcgtcttgaaaaaataattaggataagatctctttaacagtttttaagaaagtagaaataaattctaagttttcatggccttcttctgattgtcagtagaagatacttaaaatatttatattattttggttgacagaaagttataatttgttactaattttcagaccagaaaataattctcttaatgttgaagtctaaaatgcagttatgaaataactgccctggaatttaccctgtgaacatgatgtgacattcatgtcacagaaatgttaaaatgtggaagtgtctaattcccatcaaccctccggagatctacctcccttcctacccagtatcgtgtatgactaattgcctgaagcaatccttatttacatttaaactttttgttaaaaatttttgtggaggtgttttttttttttttttttttttttaaccagaaagtccaccccctctgcaaaaaaaaaattttgtttcctggtgaaaaccagaaaccctgctagacaaattctaaaagagctgtgacactttgttaaaaatgtttatactcatccaagtctggaaagaatggtataatgaactctcatgtacttatatcccaactttaacaatcagcattttcccagacttgtttttatctctttctttccaggaggaggagagcatcttaacagaataaattaaatcccagaaacttttctctaattgatgaaaatttttttttttttttttttttttttgagataggatcctgcactgtcaccgaggctggagtgcattggctctattatggttcactacagcctcaacctcccagacccaagcactcctcatacctcagcctcctaagtagctaggaccacagttgcacaccaccacgcctggctcatttttctcagctcgctgtaacttctgcctcctgggttcaagcagttctcctgcctcagccccccgagtagctgggatgacaggtgtatggcaccatgcccggctaatttttatatttttaatagggatggggtttcaccatgttggccagggtggtctcaaactcctgacctcaagcaatctgcccgcctcggcctcccaaagtgctgggattacaggtgtgagccactgcgcctggcctcctggctcatgtttaaaattttttgtagaggtgagatcttgccgtgttgcccaggctagtctccatctccagagctcaagcagttctcccacctaagcctgccaaagcgaggggattacaagcataagccacggcactgggctaaggattctttaagaagcatgactaacaaacctctatcatacctaataaaattaataatagaggaagtttttctttttctttttctttttcttttttttttttttttttgagatggagtctcgctctgtcacccaggatggagtgcggtggtgcgatctcagctcacggcgacttccgcctcctgggttcaagcaattctcctgcctcagcctccccggtagctgggactacaggcaccctccaccaggcccggctaattttttttttttttttttgtattttaagtggagacagggtttcaccgtgttagccaggatggtcttgatctcctgacctcatgatctgcttgcctcggcctcccaaagtgctggggttacaggcgtgagcctgtaacttccccgcacctggcagggaagttttcttaagtggctcctgatctcctttttaaagaattctacgtccatgtctgtggtttttaactaaaagtgcccatcacagtcacctttggaagtttttattcaaaatatgtatctctcatcaaaaactatggaattagaatctctggagttgaaacctgaacatgtatattttgaaaaagcttcccaggttgttctgatgtgttccgctaatgaaagaccatttatctcagtgactacggagtgtcactaatttttctgaatttttagtagaggcgggatttcaccatgttggttaggctggtcttgaactcctgacctcaaatgattcgcccacctcggcctcccaaagtgctgggattacaggtgtgagccaccgtgcccggccagcacttttttttaacctatgaacatctgtaacttttattgaaaagtcactccttttgactttaaattttcatacttcccctggggcgatgaataaaatgtctgtggcttggtttttactctgtaattcatactctgatgggattttgaaaaaatgtttttaattagactagtagttcaaatgcagaatttttttttttttttgagacggcgtttcacacttgttgccccggctggagtgcagtggcacgatcttggctcaccgaaacctctgcctcccagattcaagcagttctcctgcctcagcctccctagtagctgggattataggcatgtgccaccacgcccttctaattttgtatttttagtagaaacggggtttctccatgttggtcaggctggtcttgaactcccgacctcaggtgatccgcccgcctcggcctcccaaagtgctgggattacaggcgtgagccaccatgcacagcctcaaatgcagaattttaagaaatattaaaatgccttttcatttggtcatcttacgtagattttattctaaattctaatttactctggattttgctttttcagatactggctttggcactactagtggaggggcatttggaacatctgcatttggttctagcaacaatactggaggcctctttggaaattcacagactaaaccaggtaggggctttatttgtgatataactggtttgtttgtagctagtataggaattgacttagtggctctgatgtacttaactttttccctccttctccatctcctcaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcagtaagtgggacatcactggagttctgcatctaataatttggtttgcttattgaatgtgttgtcttttctccgtttttctgtgttcatctaccttcttttcctactaaatggcaaaaataagggaagaggaaaacttcaatatgtactgaaaaggttaataggctggaaaggaagagagtatgtacatttctataaggatagaaatttgaagcactgttatttaagggatatgcagaggaagagcttcctgatgcaaaatggctagagaaaggatgaaaagccaggtcagagtagtgtagttcatgttaagatgggagaatttcaaggaggagtgtgttacagtcagccatattgtgctgcagaggcaccttcttcttgtctctgttttatatttggtatgaagagactagagcaggaatgacataatggacgtgacatggttactcctccattctttgtccatggcagatgtttttagttgatgacttttttcactttaagtccaaacatgacttggggatacttctccacacagcactgtactttgagccaaccactgctagttcatcaggtatgctttatcaagtgattccattcctggcacaagagtatggaagaatgaatagccagccatcagtattttctttctttcttttttttttttttttttttttgagatggagtctcgctctgtcacccaggctggagtgtagtggcgcaatctcggctcattgcgagctgtgcctcctgggttcatgccattctcctgcctcagcctcccgagtagctgggactacaggcgcctgccaccatgcccggctaatttttttgtattttttgtagagacggggtttcaccatgttagccaggatggtctcgatctcctgacctcgtgttccatctgcctcggcctcccaaagtgctaggattacaggtgtgagccaccgcgcctggcctgccatcagtattttccagagggaaagttgtttgtataacattgaaatatttagccataacagtatataatgcagtctgaagtactaattcaaaagaaatgtgcctgtttgctttaaactatatattaagacatgttttagaaagaagtaatagcagtttgccagtgataaatcatagtactctttaacctggtaattaggatgttactaattctaaatattggcatataaatttctttgcttagtgacatttctggcaccatatgtataacttctttttttttttttttttttttgagacggagtcttgatctgttacccgggctggagtgcagtggcgcaatctctgctcactgcaacctccgcctccccagtttaagcgagtctcctgcctcagcctcccgagtagttgggcctacaggcgcccgccatcacgcctggctaatttttgtatttttagtagagatggggtttcaccatattggccaggctggtctcgaactcctgaccttgtgatccacccgccttggcctcccaaagtgctgggattacaggcgtgagccaccgcacctggcataacttctttagaagtagtgtctctcatactttcagcaatatattccttagcaacaattaaattcatttatgtgtaatttttttttaaactcagctttttggaaaagtaaagtaatccaaggatttgctatttctttattagtttctgtaaagtaattgacagtggctgctaatttttctgaaattttggggggtgaaattttacattaacctatatttgatttctctaataggaccacttgtatattctaaagtttttggttatgtgtaggtatatgttataatgtatgtaaataaaatgtactgtgaccactcttgaagtctgtgacaagatgttttcagaaagacaagttcattcagcatgtagttaaatgagaaagggagaaatgagataaaatttatgatgaaacaaagtatttcttttaagttgtcttccaagtgtgaccttagggctttatggacacttagctgaccaaaggattcagactttgtttcacttgaaagttgtgagcctggaagtacgtatctttctgtatgaaatttctatttgggccgggcactgtggctcacacctgtaatcccagcactttgggaggcataggtggatggatcacgaggtcaagagatcgagaccatcctggctaacacagtgaaaccccatctctacttaaaaaaaaaaaatacaaaaaattagccgggtttggtggcgggcacctgtagtcccagctactcaggaggctgaggcaggagaaatggcgtcaacctgggaggtggaggttgcagtgagctgagatcacgccactgcactccagcctgggctacacagcgagactccgtctcaaaaaaaaaaaaaaagaaatttctatttgaatatatttgcttgggagacttgaaaggtgaaaaatttcaggatatgagatcaggtgcagtggctcacacctgtaatcccaacactttaggatttcgaggtaggaggattgcttgagcccaggagtttgagactagcccgagcaacatggcaaaaggcagtctctacaaaaattaaaaaaaaaattagctgggtgtggtggcgcatgcctgtggtcccagctacttgggaggctgaggcaggagtattgcttgagcctgtgaggtcaaggctgcagtgagctgtgattgcaccactgcactccatcctaggagacagagcaagaccctgtctcaaaaaaaaaaaaaaaaaatgaagtactgtgatgctagtgccatagcccaattccaatgcatcttatacattcttaaatttcttactgttatcgtctcatttttctttcttatttttagattttggaaccagtactagcagtggaggactctttggaaccacaaataccacctctaatccttttggcagcacatctggctccctctttgggccaagtagttttacagctgctcctactgggactactattaaatttaacgtatgtattttcttccaatctttgtggaatgttttttcccgcatgtatatttctttgcaggatgaattgtaaaattgcttctctttccagcttagcttgacactgcctgaacgatgtgttaaaaacaaaatctataaatagttgtatagtagacaggaacacttgtgaaatgtaaatctagattacgatgtatatttgaattaggctcatcccaataaaatttgtattcataaaactttattataatctggtgtaaggtagaatttgaatttactgtgttaagaatttgcttctgaatggtcaactgttcaattttcttttttttttttgttattttgtttttttaagatggagtttcgctcttgttgcccaggctggagtgtggtggtgcaatctcagctcactgcaacctctacctcctgggttcaagtgattctcctgcctccgcctcctgagtagctgtgattacaagagtccaccaccatacccagctaatttttttgtagttttttgtagtagagatggcgtttcaccatggtggccaggctggtctcgaactgctgacctcaggtgatctgcccacctctgcctcccaaagtgttgggattacaggcatgagccaccatgcccggcctggtcaactaatctttatgggaataaagaatagggggcaaataagagtaactcatcagcattctgtacccaatgaaaaatacaggttttgttgatgaaatggctaaatggggctgtaaagtttattgtgtatgtgttctttttttgagagggattgggtggagggctagagtggaggattttgtttacagaaacatgtggaatgccacttgatgtaaatgtttgggggattcttagggtatgctggaggtgcagttagcctaatggaaatctttggcagaaataaaacttgttaaaatatactccagaaaatgaagaatttgtcaggtaaattggttaattcatagtactaaatttacaaccccgaatttgaagttaaaacataaaatgatagtgaagaatactgtgtgatgccctttggaaagtgcagtagttgagaaaactggcaataccagcaggaatcgttagttttacttattgtgcctttttccttgtaatgttatcggggaaaaacaggtttccatatttcttttttttttttggagacagagtcagccagacgggagcgcagtggtgcaatcttggctcactgcaacctctgcctcctggttcaagcgattctgctgcctcagcctcccaagtagctgggattacaggcacccacccaagctaatttttgtatttttagtagagatggggtttcaccatgttggccaggctggtcttcaactcctgacctcaagtgatccacccgcctcggcctcccaaagtgctgggactgcaggtgtgagccactgcgcctggccagtttctgtttttttgttgttgctgttttttgagatggagtctcactctgtcgcccaggccagagtgcagtggcacggtcttggctcactgcaacctccgcttctcggattcaagcgattctcctgcctcagcctcctgagtagctgggactacaggtgcacgctaccacgcctggctcatttttattttttatttttttattttttagtagagacggggtttcaccatattagccaggctggtctcgaactcctgacctcatgatccacccgcctcggcctcccagagtgctaggattacaggcgtgagccaccgctcctggccctccgtatttttttaatgcagcattacagggcggagtagaaaggagaacttagatatagaggtttaaaggtatatattgggtaaagctttctttatgcataatattacatgtattttaccatgtaattggatggcttgggttatgggattaatccctgcgtttgtgattactttgttactaagatcgatttattcagataaccttgatgtagggagagatcagaaatggcagtatatttaatcaagcacccttgaaaccatctcagtataaaagacctggggggactagttttagagttcagtggttgagaaattgtatctgagagagtaggaatgtaaaacttggacctacaaatttgcctttatttaactttgcagcctccaactggtacagatactatggtcaaagctggagttagcactaacataagtaccaagcaccagtgtattactgctatgaaagaatatgaaagcaagtcactagaggtcagtaaaatacaatacagaatgtcagtctaaccttttgattttattggaatgcagcttttaaaaatggttttgattttctttaggatagagtggttcagtttgggtttatgtaaaaaattaacattaaccaaattatttttaaaaatcaagtattatttatagatatctacttgtttaggcagggataatattcaggggtatgtgaaggtctagcacccctaatggtctttttttttttttgagatgggcttttttgcccaggctggaatgcagtgacacaatcacagctcactgcagtctcagcttcccaggcttcatgtccttagcctccgaagtaggtgggaccactggcatgtgccccacgcccagctaatttttaaaaatttttttgtagaggtgaggtctcactatgttgctcaggccggtctcagactcctgagctcaagcgatttttcttcctcagcctcccaatgtgctgggataacaggcatgagccactgagcccagtctaatcatctgttctgattggatgttgcttctgttacactgggcaatgtgtatgcatgcatatgaaggtgtttttagtaaaattatgcaaagtacagcttaataaaagttggtttttttttgttttttttgtttgtttgtttttgagacagcatctcactccgtcacccagtctggtgtgcagtggcacatcttggctcactacaacctccacctcctaggttcaagcaattctcgtgcctcagcctccctagtagcttggattacaggtgtgggccaccacacacagctaatttttttttttttttttgagacgagtcttgctctgttgcctaggctggagtgcagtggcgtgatctcagctcactacaatctctgcctcctggatttaagcagtctcctgcctcagcctcctgagtagctgggattgcagctgcacgccactatgcccagctaatttttgtatttttagtagagatgggattttgctacgttggccgggctgttcttgaaccctggccttgtgatccgtccacctcagcctcccaaagtgctgggattacaggcatgagctgcagcacccaggcacattatgtactttttaatggctgtctttgaacattgagatagtcatccatgttgttgcatgaagttagtttgttcattcttattgcttatgtagtaggttgttgtacattttgatagtcattcatgattatagtgattgcttctttctacataccaaactatgcttactttattgggctgtgccaggaacatccggacttgagacaaaattgataaactttattttctaaattttttgccccacagaatctacatatgttaattcactataatttttatttttattttatttttatattttagggctggggagagttaggattattttatgacattttaccaaaagagtgtattgtttgtgaaagaaaactgagattaagatattgactctttggcttgtagttttatgataattatggtatggattttagtgtctattggaaatgtttttctgtaatgatataatgtcattccttagttttctcttttttagttatggttcctatgtgaacatagaacttgaatactaaattcaagtatttagcctcctaaataattatttttagctgcatgttaagattagaaatatgttttccctcccttcaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtaagcacttgatatcatgttagattatactgaggagagacagataactaaaactaaaacataattgccattttgggataagtgctatggagaaaaataataattcagggataccataggaatagggaggaatgcctggatgtatgtggggaaagggagaaagacagtttaagatgaagacgactaaggaatgcttcagaggagaaggtgatgtttgagcagtgacgtatctgaagaagatgaaggagcaagttgtacagatttctgggggaagaacattccagctggtggaaactgagtctaaaaactctgagtttttgccatttgaagagagggcaagggaaaatactgggggatataggggccatattttatacgactttgtaggccaatatcaagacttgaatttttatttgatttaggaaatcctgaaagttgttttgaaagagaagtcatgtgattgtgagtgaaggatgattctgaagtctcctatattgacagtagattgtaagagtagaaacaaattacttagaaagctattatcaacataagaggtgttagtgtcttggacaaggatggaaaagaggccaagtgtggtggctcacgcctgcagtcctagcactttgggaggccaaggcaggtgggttgcttgaggtcaggagttcaagactagcctggccaacatggtaaaaccctgcctctactaaaaatatgaaaattagccaggcgtggtgacaagcacctgtaatcccaactacttgggaggctgaggcaggagaatcgcttgaacctgggaggcagaggttgcagtgatctgagatcacaccattgcactccagcctgggtgacagcaagactccatctctaaataaaaaggacggaaaagaaaaaagatgaggttctggacccagtttgattatagaactgatggaatttgccgatgcattggtttaatgtgggatgtgaaagaggagttaaagatgatgattacttgacaaaaatactacttttgcaaaagtaatgcacatatgtgatacaaagttcacaaaatacagaaaactaaataaccagaggttatatacttgccttatacactttccccagccaccagtttgcctctgtagagaaaagcaaaaattatagcttttcatagccttctaaagagatgtacatacacacacacacacacacacacacacaaatacgtatttatctaagttatatttaacctactttttcttttcttttcttttcttttcttgagacagggttttagggtcttactcccgtcactcatgctggagtgcagtgatgtgatcagggctcactacagccctgatttcctgggctcaggtgattctcctacctcagccaccctacaggcatgtgccaccacacccgactaattttattttatttttttgagacggagtctcactgttgcccaagctggagtgcagtgcaacctccaattcccaggttcaagcgattcttctgcctcagcctcccaaggagttgggattacaggcacccgccaccatgcctggccaattttttatatttttaatagagttggggtttcaccatgttggccaggctggtctcgaacccctgacctcaggcgattaaccagcctcggcctcccaaagcgctgggattataggcgtgagccatggtgccagccctaattgtttttttttttttttgagatggagtttcgctctgtcacccaggctggagtgcagtggtgtgatctcggctcactgcatcctccacctcctgggttcaagcgattctctgcctcagcatctgaagtagctgggattacagatgcccaccaccatgcctggctgatttttttgtatttttagtacagatggggttttaccgtcttggccaggctgatctgaactccagaccttatgatccacccgcctcggcctctcaaagtgctgggattacaggcatgagccaccatggctggccgtccagccctaatttttagcagggacggggtttcaccatattggccatgctggtctcgaactcctgatctcaggtgatcacccgtctcagcctcccagtgtgaaccaccatgtccagcctaacgtacttttcaatcttgatattccatgatttagtttagtatgcttttttttttttttttttttttgagacagaatcccactttgttgaccaggctggagtgcagtggagcaatcatagctcactgcagccttgaactcttgggcccaagtaatattcccaccattctgcctggctaatgtttcataattttttctgtttttttggtgggggttggaggacactgtctagctctgtcacccaggctgtcgtgcagtggctccatcacagctccccgctgcctcaaactcccaggctcaagccatatacccacctcggtctcccaagtagctaagaccacaggcaagtgccattagcctgactaatttttaaaatttttttgtagagatggggtcccattgtgttgcctaggctgttcaggaactcctgtcctcaagtgatcctcctgccttggcctcccaaaatgttgttattacaggtgtgagccactgtgcctggcccatattcattattgaatattacatatcagactctgggctggatatattcatgtaaagaagaagcctttgttctcattaacctagactagcaaggttaaaatacacatgctgacttctagtgtattatcttgtaaaacagaaggaagctgtggacttacaagggaagatcatttagcctagttaagcttcttggggtaaggatgttattacagaagttaaagtttaaatctagagttaagtgaaggatggaaaacgaaaagatgatcaagtagtgaatgaagggtagtagataacataaagactattacaacaactggataatggaaggttttgtatttttgggtgtttacattttttttattatttcttttttctttttcctaaaaggtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatggtaaggaaacagacccttacttacctccatgtcttatttttagagttaagtaatgaggattctaatcatgtcaaactagcaaattctacctgtactgcaaatcttaagagttgagggtatttaatgaagggaagagaacaaagtttttttttttttttttgagatggagtctcgctctgtcacccaggctgtagtgcagtggcccagtctcagctcactgcaagctccgcctcccaggttcatgccattctcctgcctcagcctcccgagtagctgggactacaggtgtccaccaccatgtccagctaattttttgtgtttttagtacagatggggtttcaccgtgtttgccaggatggtctcgatctcctgacctcgtgatccgcccacctcggcctcccaaagtgctgggattataggcatgagccaccgtgcccggccgagaacaaagtcttagaataattaagacctagattctagcctgggctctactctttacttgttgagatgctattgaggcgatcacttatcctttctgaaagtatttttctcattactaagtaggaactacttagtgggctggacttggccctcttaaagctataccttggaaaattgactacagccattctatagggtataggagaaaatacttattcattactgactatatttcagaatatagccaacaacaggaactaagggaacgttcacctagttcccttgggaatcatacaaagaagtttttttgttttttttttttaaagggagacctacgacttagagccatactgtgtccaaagaaaaggtcctcatggtcattactagtttatttctagggacattttttagggaagtatgaaattaaagaaggaagtgatgtatgagtaattgatcaggacttggaatttacctcgtcttaaaattagagatacttttactgattaaaaaacaagtatgggctgggcacagtagcttatgcctgtaatcccagcactttgggaggccaaggtgtgagatcaggagtttgagactagcctggccaacatggtgaaaccccgtctctgctaaaaatacaaaacttagccaggcacagtggttggtgcctgtaatcctgactacttgggaggctgaggcacaagaatagccttgaacccagggggagacagaggttgcagtgagctgagattgctccatggcactccaacctgggcgacgaagagagacttcatcccaaaaaaaataaaaaaaaaagtatgcttgtaccgccatgtcttcaaaatactagatgactgatttcagtaacatatgaaaaggatcagccgggcatgctggctcctgcctgtaatcccagcactttgggaggctgaggtgggcggatcatgaggtcaggagttcgagaccagcctggcaaacatggtgaaaccccgtctctaccaaaaatacaaaaattagctgggctgggtggcgggtgactaatccaagctacgcaggaggctgaggcaggagaattgcttaaacccaggaggcagaagttgcggtgagccgagattttgccactgcactccagcctaggtgacagagcgggactctgtctcaaaacaaacaaacaaacaaaaaaggatcataatccatgactaagtgggatttatccgaggaaggttggttcaacatatgatcattaatcattgtaatacactgtggtaatataatttaaacaacagaaaaccacatgatcacctttgtaaatacagaaaaaacatttgacactttttcatgataaaaacactgaagaaagaataagaaggaacccggaatagccaaaacaatcttgaaaaacaacaagttggaggaccctcaggcttctctctttttttttttttttttttttgagacggagtttcactgttgtcgcccaggctggagtgtaatggcacgatctcagctcactgcagcctctgcctcctgggttcaagggattctccggcgttagcctcccacatagctgggattgcaggcatgcaccaccatacccagctaattttgtatttttagtagagccggggtttcactatgttggtcaggctggtctcaaactcctgacctcaggtgatccacccacctctgcctcacaaagtgctgggtttacaggcatgagccactgcgcctggccttcatgtttctcaattttattttattaatttttttgagacaggcctcgctgcagtcacccaggctggagtgcagtggcatgatctcagttcactgcgtcctccgcctcctgggctaagcgatcctctcacctcacctcccaagtagctgggactacaggcgtgcaccaccatgtccagctaatttttgtagtttttgtagagatgggttttcatcgagttatccaggctggtctcgagcttctgggctcgaacaatctgctctccttggactcccaaagtgctgagattacaggtgtgagcagctgtacctggctttacttctcaattttaaaacttactataaagcaatagtaattgtgttactggcacaaggagagacatagaccaattgaatagaagtgagagtccagaaataaaccctcacatttgtagacaattgattttcaacaaggataccaaaacaattcagtgaggaaagaatagtcttttcaacatatggtgctgggacaactggttattcacatgcaaaataatgaggttggattcttcacagcattttttaactgcaaaagttaaaattgatcaattttttttttttttttttttgagacagagtcttgttctaattgcccaggctggagtgcagtggcacgatcttggctcactgcaacctctgcctcctgggttcaagcgattctcctgccttggtctcctgagtaactgggattacaggtgtgcgccaccgtgcccggctaatttttttatattttagtggagacagggtttcaccatgttaggcaggctgatcttgaacacctgacctcaaatgatccgactgcctcagcctctcaaagtgctgggattacaggtgtgagccactatgcctggccacaaattgatcagatttctaagtgcaagacctaaaattataaaactgttagaagaaacctagttagacagtaatatcttagataggacaccaaaagcaaaagcagaaaagaaaaaatagataagttgggctttttcaaaattaaaaccttttagccaggccttttagtacatgcttgtcatcccagctactcaggaggctgaggtcggggaatcattgaggtcatgagttagaagctgtggtgcactatgatcgtggctatgaataggccactgcactctagcctgagcgacataatgagaccctatctctaaacaaacaaagatggcagaaaaacatttatatatcaaagggatatcatcaaagtgaaaagacctgtaagtggaagaaaatacttgaaaatcatacatgtgatataggacttgtatccaggatgtataaataactcttataattcagtagtaagacaataactcatttaaaaagggccaaggatttgaattgacatttctccagagaagatatgtaagtggtgtgataatatgcttaacatcataagtcatcagggaaaggcaaatgaaaaccaaaatgagataaccactttatacctatttgaaagatacaataaaaaaagactaacaggctgggcgcggtggctcacgcctttaatcccagcactttgggaagccgaggcaggcagatcacgaggtcaggagttcgagattagcctggacaacatggtgaaaccccgtctctactaaaaatacaaaaaattagccgggcatggtggtgcccacctgtagttccagctactcagggggctgaggcaggagaatctcttgaacccgggaggcggaggttgtggtgagccgagattgtgctactgcactccagcctgggtgacagtgtgagactcaacaaaaacaacaaaaaaatacagtagtaagtattgaacctggagaagttggaaccctcatacattgctggtacagcccctttagaaaacagtttggtggttcctcaaaatgttaaacagagttacgatatgacccagcaattgcacatcttgggatttaccgaagaaaaataagacatagacttgtacacaagtgaacataacagcattattcataatgactaaaatgtagaaataacctaaagatctattaacaatgaatgggtaaccaattgtggtatatgcatacaatggaatattgttcaaccataaattggaatgaagtactaatatatgctacaacacagatgaaccttgaaaatgtgctaactgaaagaagcccgtcaccaaagaccacattttttatgactccattcacattaaatgttcagaataaaaaaaaaatccatagaaaaagatgaatggttccctagggatggggagtaatcactgatgggtctgggatttctttggggggtgtaagaatttagatagtagggatggttgcagaacatcacggaatagtccactgtaaatgagtgaattttatgatgtttgaattgtgtctcaataaaactttaaaaagtgaattccctattcagcaagtctattagcacaatatttttcctttattaatgcataagtaaaatacattgttaaacataggatgatgcagactgctcattggaaatgagtatagtttctcatttagaattaaggcttttggctgggtgcagtggctcacgccagcattttgggaggctgaggcaggtggatcccctgaggtcaggagttcgtgaccagcctgggcacattgtgaaaccccatctctactaaaaatgcaaaaattagccaggcctggtggcgtgcccttgtagtcccagctacttgggaggctgaggcgagagaatcacttgaacagaggctgcagtgagccgagattgtgccactgtacttcagcctgggcaacagaacgaaactccgtatcaaaaaaaggaattaaggctctttaacataacactcgtacctcggtccgtgttgatttattttcgctgattatttttggttacttgattctaagttcactccccagcttgatactgattagttcttttcacctaaatcgttgaaaatgaaggacctagacatactattttgcttctcagtgttgcaaccctgacatctcttagagcacaagagttaaagtcttattatttaatagacgcctaagaccttggagttcatcatcctgggaagaacaggggcttaaatataggtttgaacttctgttcctaccattcaggagctgtggcaccttgggcaagttttaaaatgctctgagctttttgaaaaatatactccctgcttttcagggttgttttgaaggaaataatctatataagttatttagcctaatatctgtcatataagcttgaaaaaatggtaactttttttttattactctgagattcgttacggaaactattacaggatatcttttaatctatataaacttctttgcagggattatttggagtaacccaagcctcacagcctggaggtctttttgggacagctacaaacaccagcactgggacagcatttggaacaggaacaggtctctttgggcagaccaatactggatttggtgctgttggttcggtaggtttctgcagttgactgtaatttgaagatgtgtgtaaatttgttaaaaggaattttcttctaaggatttgactgttttgcaggtatttttattgggtgtattattgcaccagcctaatatgatttgattctgagaacaaaaaattatttgatataaaatgaaatttcaggttaacttcaggtttgttttcaattagtaaattctttcccttttaaaatttctttgcctcagtgcttatgtgcatcatacttctgatagcattggttaaattgttgagtctaaattgaaattcttttgctttatttgaatcagataatttttaactcctagttcttccctcttttgtaggtgataaattggtatgatgtttgggaatgaaatgtttttggggttgatcaaattgttgaaattgttgaggtactcatggaagaaactttgaacttgctattgtgagtaggttaaaaaaattaaaaaagagccaggcgcggtggctcacgcctgtaatcccagcactctgggaggccgaggtgggtggatcacctgaggtcaggaattcgagaccaatctggccaacatggtgaaaccccgtctctcctaaaaatacaaaaaaaaaaacaaccactagctgggtgtggtggtgggtgcctgtaataccagctacttgagatgctgaggcaagagaatcacttgaacccaggaagtggaggttgcagtgacccgagatcgcgctattgcactctagcctgggcaacaagagcaaaactctgtcttaaaaaataaaaaaggaacacaaagtccctaaaacatatggtcctgttttcatggagattgaaatttctcttttctttttttaaactttggacagataattgaggtaagaaattgagaaaattatataatgcttcaagacattctagtacttctgttgttgttgttgttgttgttgttgtttttgaaaccgagtctcgttctgttgtccaggctgtactgcagtggcatgatctcggctcactgcaacctctccctcccaggctcaagcgattctcgtgcctcagcctcccaagtagctgggattacaggcgtgtgacaccatgccaggcttttgttttgttttttgttttgttttgttttgtttttttgagacggagtctcgcctgttgcccaggctggagtacagtggcgtgcgatctcggctcactgcaacctctgcctcccgggttcaagcagttctctgcctcagcctcccgagtagctgggattacaggcgcccgccactgcgcccagctgatttttgtatttttagtagagaatggggtttcaccatggtggccaggctggtctcgaactcctgacctcgtgatccacctgccttggactccgaaagtgctgggattacagacgtgagccaccactcctggccttaatttttgtattttttagtagaggtgggattttgccacgttggctaggctggtaactcctggcctcaaggatccttccgccttggcctttcagaatgctgggattacaggcgtgagctactgtgcccggcttctagtactttctagtgacagatttattgatgtatagtccacatgccatacaatttgtctctttaaagtgtatagctaggtgatttttagtatatcaacaaagtgtgcaactatcaccatatttaattttagaacatactcattatgccaaaaagaaatgccatagtcattggcagtcactcctgattttcctgtaatcatcttaagcctactttctctctatggatttgaccattttgaacacttcatgtaaatggaatcataatatgtggtcttttgtgattgatgtctttcacttagcatagcattttcaaggaacatccatgtagcatgttcaaagtttttcttgtagtgatttcttctggcaaagcaagtatttgctacatttctcttaacaggtaaaaagatatttgatggccttgttatttttttctttgcctcactgaaatctggtttcattggattcattgtgtttcagtcgtaatccttaggggttaccattaacttttcaggccagaagcattccgtgtttataaagttaatcttgcccagattattttttgatagcctttattcatcttttttctaccttttttatgaatgttaggacatctttctcccaccccatacccaacccagtatacctgaggtaacctgtatttagtttggtgtgtgtcttaatattattttaaattttcctgtattctattctttttagaccctgtttggcaataacaagcttactacatttggaagcagcacaaccagtgcaccttcatttggtacaaccagtggcgggctctttggtaacaaaccaaccctgactttaggaaccaatacaaacacttctaattttggtacatataaaaagcaggtttggctctcttaaagttacactgactataccacacgttattctcctgattcgtatgattggaaatatttaaaagttctcaggtaagcggtagcttgatgtgaagtaccagagggaaaggtttaaagtcctggatatggcttgagataattagtaggcatgtaaattgcctttcatttactttggattacttcagcaatagctgagaaaccataaaggaaacacatttggttaagtaacacattgtatgaggccaggtttcaaacctgtggtagcatacagaagataattggttattcttatttttgtcgttgttggtttgttgtgttgttttgtttttgtttttttttttttttttggtggagaacagggtctttatatcgccttagcctcccaaagtgctgagattacaggtgtgagccattgcacctggcctggttattcttagtgaaagtcaaaatatgccaggcatcatggtgagcacctgtagtcccagccattatggaggctgagtcaggagtatcacttaggagttcaaggctgcagtgtgctatgatcacacttgtgaattgccactgcattccagcctaggcaacatagtgaaagtaggtctctaaaaaaaataataaaataagaaaaataatagaagaaagttgaaacctttctgatttgggggattattcagtagtttattttttacggtttcaaaaattttgaatgcatgttcatagtatgtatattcattgttgaaaatctggaaaatacagaaaagattgaacaataattttcaaaaccttaacctactgggaaaaatgtaaaccagttttatggaacatgatgatattattttatttatttatttatttatttttgaggtgtagtctctgtcacccaggctggagtgcagtggcatgatctcgatcttggctcactgcaaactctgcctcccgggttcaagcgattctcctgcctcagcctcccgagtcgctgggaatacaggcacgcaccactgtgcctggctaatttttgtgtttttagtagagacaaggtttcaccatgtaggccaggctcgtcttgaactcctgagctcaaatgatctgcctgcctcggcctcccaaagtgctgggattataggcatgagccaccacacccagtcaatattttcaatatatcttataactacctaattatgttttcaaaattcagcatctgtcagatcagatatgggaagtttattctgtttgtcgagggaaatagtggttcaagtatttcttgaggattttgtgtgccagatacatcactaggcactgatagattctttttaggagttgagtacaaagacatggttatttggtgtaggtcagcagttaacagttttttaatgagcttttgaacgatcctgtactggagaaagagatcatattaaacatctattggaagattaatatgtttatcaactacaggaagaaggtagatagttcattgataggtaccaattcctaaattgatgtgtttggtttgatttttataatcccttttagtcattttgctcattcactgccagaaatgattatagttcctataaactctgtttgaaacaaccgttttgaggcagtggacttggttaccatgggtaagatacttggtgtctgtctctctctgtctctgtctctgtctctctgtctctctctgtctctctcccctccctcccaggctggagtgcaatggcacaatcttggctcactgcaacctccacctccctggttggagtgattttcctgtctcggcctcctgagtaggtgggattacaggcgcctgccaccatgcccagctaatttttgtatttaaagtagagatggggtttcaccgtgttggcgaggctggttttgaactcctgacctcaggcgatctgccctcctcggcctcccaaagtgctgggattacaggcgtgagccactgcacccatccctacttatttctttcctataaaattaaaatggaaagatagttaagggtcaattagcgtttctcaaccttttctattatcacttacccttccccatggaccgtttgtagactattttttcatttttaagttgtacctgctgtaatgggactgttttttcttttttctttctttttttttttttgagacggagtctcgctctgtctcccaggcgggagtgcagtggccagatatgggctcactgcaagccctgcctcctgggttcacgccattctcctgcctcagcctcccgagtagctgggactacgggcacccaccaccacccccggctaattttttctttgtatttttagtagagacggggtttctccatgttagccaggatggtctcgatgttgtgacctcatggtctgccggcattggcctcccaaagtgctgggattacaggcgtgagccaccacgcctggcctgttttttcttaatcatcatctcccttcccctgagattttcataccacgcatatactgtgtatctgcttatgttgtgtgactctctggagggccacaaactatcataatctgtgatattttagtccctcaagaaccaatttccactccctttgaaaatgtgtgtttttaataaagctcttttttttgtagcatgcttcatgttcaaaattaaatattatttcttttctttctttttgagacggagtttcgctcttgtcacccaggctggagtacagtggcgcgatttcagctcactgcaacctctgcctcctgggttcaagcgattcttctgcctcagcctcccaagtagctgggattacaggcatgcaccaccacgcccagctaatttttgtatttttagtagaaacagggttttaccatgttggccagtctagtctggaactcctgacctcaggtgatctgccagcctcggtctcccaaagtgctgggattacaggtgtgaaccaccacgctcggcatttttgttttgttttgttttgtttgttttttggggagacaggatctctgtctcccaggctcgagtgtagtggtgtgatctcagctcactgcaacctccgcctcctgggctcaagtgatcctcccacctcagcctcctgagtagctgggactacaggcatgcaccaccacacctggctaatttttgtgtttttgtagagacagggtttgccatgtcacccaggctggcctcgaactcctgagctcaggtgatctgcctgtcttggcttcccaaagtgctgggattacaggcatgagccactgcgcccagcccgttatttttatctgaacactataagggtgtttgtataggctacacttgataaaatatatatatatatacacatatagatatagatatagatatatagatatatatatatatattttttttgagatgtagtctcgctctgtcgcccgggctggagtgcagcggcacgatctcggtttgctgcaagctccgcttcccgggttcacaccattctactgcctcagcctcccaagtagctgggactgtaggcgcatgctgccacgtctggctaatttttttgtattcttaatagagacggggtttcaccatgttagccgggatggtctcgatctcctgacctcgtgatccgctcacctcggcctcccaaaaggttgggattacaggcgtgagccactgcgcccagccgacaaaatttttttaaagatatatttgatgttatatgtgatgtatattaagatatatatgatgtctccccaaaaaacaaaaacaagccgagtgtggtgattcacgcctgtaatcccagcactttgggagaccgaggctggcagatcacctgaggtcaggagttcgagactagactggccagcatggtaaaaccccatttctactaaaaacacaaaaattagctgggcatggtggtgcatgcctgtaatcccagctactcgggaggctgaggcagaagaatcacttgaacccaggaggcagaagttgcagtgatggttgcagatttctgatttgcttagaggtttttttttggtgtgcgaatatatttacagtcatcttcagtgatatgaaaatgaaaggtgtcatctttatctgagttgtctcaccaacttgtgtgccgaatttgaattgtctttttaattgtaatttgtaaaattgaattttacaagtcgataaacttgtcagtgagaatcggaggaaatgtgtggtataaacagtgtaagttgggatttatttcccttctgtgggtttgagatagttcacgagtgtcttgttttctgctgcttatgggactgtaagatcccttttgattaaatttttattcaaaaaggaaaagaatatctccaagtacattttttgtgttttcatcaaggaaaattgatgatgcttgagtaggcagcaccccatttttgtggcatagctattagaagaattaaagaagagattcaatgaatgtctaagtcaaatatattgcgattaagtcaggttacttgattggattttatttcatgtatttatttttttcgagatggagtctttctctgtcacccaggctggagtgcagtggcgtgattttggctcactgcaaccttcgcctcccaggttcaagcagctctctgcctcagcctcccaagtagttgggattataggcgcctgccaccacacccggctaatttttgtattttttggtagatatggggtttcaccatcttggccaggctggtcttgaacacctgaccttgtgatccacctgccttggcctcccaaagtggcgggattacaggcgtgagccactgcgcccggcctgcttgcttgaattttaaaatgacatgaaatacgattgtttttaaacttttatattcttcagctttcttcttgatttttttcattgagataataatccaaatactggcacaacaaagtataatattagtgatactttcatctgttctaaaatagtctctttattctgtttgttatctttttgggctactttttcctccatgattttttttttcttttggagacggagtcttgctctgttgcccaggctggagtgcagtggtgtgatctcagctcactgtaaccctctgcctccttggttcaagcgatcttcctgcgtcagcctcccaaattgctgggattccaagcgtgcaccaccacagccagctaattttttttttttttttcgtggtagtagagaagaggtttcacatgttggccaggctagtcttaaactcctttcctcaagtgatccacctgcctctgcctcccaatgtgttgggattacaggcgtgagccatcatgcccagtgctttatgacttttaaatgacttcatatgttctacaaacagggttttctggctaatgatttcttttctctcatgagaaattaatgacatattcattaattgttttgttgatatttatttacaaaaagaataatgaaactgtgggcatagatgaagaaaagaaaagtaatggcagcagtacagaataggatctttgtttgatacctacggattttttttttttttttttttttttgagatagtgtctcgctatgtcgtctaggctggagtgcagtggtgcgatctcgacttactgcagcctctgcctcccgggtttaagcaattctcctgcttcagcctcccaagtggttgggattctgggtgtgcaccaccacacccagctaatttgtgtatttttagtagaggtggggtttctccatgttggccagactggcgttgaacttgtgaactccagtgacctgcccaccttggcctcccagagtgctgggattacagttgtgagccaccgtgcctggctgatacctgtggattttaaagggaaattataggattttgtttaaatggtgggtcatagtgaagaagacttctcacgtgtaatcagctacacgttactatcctggctaggttcatctattcaaaataaaagctactgtggaaagttttgtaagtaatttttttcttagcaaggacctttaggttcagttaaagtgtctttgttgattgttttatttttattttattttgtattttttttgaaacagagtctcactctatccatgctagagtgcagtggcacgatcttggctcactgcaacccccgtctcccgggttcaagtgatactcctgcctcagcctcccaagtagctgggtttataggcatgcgccatcatgcccggctaattttgtatattttgtagagacagagtttcaccatgttccccaggctgttctcgaactcttgacctcatgatccgcccaccttggcctcccaaagtgttgggattacaggcgtaagccaccacacctggccagttgtttcattttttttagtacaagttagggggaattaatttctcttctaaataaacttgaaacttgcattgaaagctttgggccttacaaaggcaatgttcccaaagctcaagtgtgttcactttgcttgaatattgatattatcctatattgaattgatatttctttattttattttatttatttatttatttttatttgttttcgagacagagtcctgctctgttgcccaggctggagtgcagtggcgcaatctaggctcactgcaacctttgcctcctgggttgaaacgattttcccaccttagcctcccgagtagctgggattacaggcacgcaccgtcatacctggccctttttttttttttttttttttttttttttttttttgtatttttatagagacggggtttcaccatcttggccaggcttgttttgaactcctgacttcaggtgatctgtcagcctcggcctcccaaagtgctgggattacaggcgtgagccaccgcgcatggcctttgaattgatatttcaaggctgaaatgtaattaagtaaatatgaagacttgtttgcatatgtgaaattttttttttaagttatcctacaagttaggagtcctaaatattaactgaaaggttcacaacttaaagtcagactgctttgtgttaaactcccttatagaggaaattgagagttatattaaaagtacaatccactcattcttttgtcttcctaggttttggcacaaataccagtgggaatagtatttttggaagtaaaccagcacctgggactcttggaactgggcttggtgcaggatttggaacaggtaagaaactgctaccatgagatctaggaagtgacacagcttgactttctagtttctggaacttgagagatctgtttgattatgttactggaattaagaagtctaccttttcgtttttccagttgcgtttataagacattcccagcagttatgctttaccaggctttaaaatattggcatgtttgtgttagaagctgtatgctcccttttctacaaaatgtcctctgatagtcctggtctttttgggatttttagtatttaatgtgagaattgtcatgaggacattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgtacagtaaaactaggttgtttagttaaacatagagttttgcctactttttcaattcgtttgactgcaggtgtggtcatttagttgcaaaccatttccatagtctgcttccactgtccagttaatctgttttttttttccccttctatcatctgagcattcatctgtcatttccttcttttttatttatttatttatttatttatttatttattttggagatggagtctcactctgtcgttcaggctggagtgcagtggtgcagtctcagctcactgcaatctctgcctcccaggttgaagcaattctcctccctcagccttcctagtagctgggattacaggtgtgtatcaccatccttggctaattattgtatttttagtagagatggggtgtcactatgttggtcaggctggtcttgaactcctgacctcaggtgatcctccctccttggcctccaaagtgctgggattacaggtgtgagccaccgtgcctggctgtcatttccttcttaatggaacctcattttgtactatgatctgcttttgtggtttttatttttatttttttcaatttcccttttttttttttgagatggagtcttgctccgtcccccaggctggagtgcagtggcataatctcggctcactgcaacctccacttcccgagtagctgggactacagtcgcacgccaccgtacccagctaatttttgtatttttagtagagacagggtttccccatgttggccaggctggtctcgaactcctgacgtcgtgatcctcccacctcaacctccctaagtgctgggattacagacatgagccaccgcgcccagccttcagtcttctttttaagataaaaggtgttttattttgagacaggttcttgctctgttacccagggtggagtgcattggcatgatcacagctcactgcaacctctacctcccaggctcaaaccatcctcccacctcagcctccctagtaactgggacaacaggtgcaagccaccatgcttggctagttttttaatattttggagagatgaggtcgacctgttttgcccaggctggtctcgaacccctgggctgaagccatcctcctgccttgagctcttaaagtgctgggaatataggcatgagtcagtgctctctgcttaagataaaagatgtaagtgctggtaaaaagtttttaacaattcagaaatttcatgaaaagtccagtctttttcagctgtgaaatgattagggttgtttggcatgtatcttgtcagacccgtttctgtgcatttttcggacatgtttacacacacacacgtctgtacatacatgtcttttatatttagggtttaggattatattcttgtttgttttttgagtcggagttttgctcttgttacccaggctggagtgcaatggcacaatctcggctcaccgcagcctccgcctcctggtttcaagctattctcctgcctcagcctcccgagtagctgggattactggcatgtgcccacatgcccagctaattttgtatttttaggagagacggggtttctccatgttggtcaggctggtctcaaacccctgacctcaggtgatctgcccgcctcggcctcccaaagtgctgggattacaggtgtgagccatcgtgcccggcctgggattatatttttaaatggaaactacaccctgtatgagtgacttttaagccagagactgaggtgcattagttggttataattaatatagttgcctgcaatcagcatttgaagaaaatgaagtagaattaaaaatcagtaggctgggcctaatgggttatgcttctaatcccagcactttgggaggcctaggcaggaggattgcttgacgtcaggagtttaacatcatcttgagcaacatagtaagatgctatcaaaaaaataaaataaaatagatatgcatggtggcatgtgcctgtagtcctagctactcaagcagctgaatgagatgtgctgtgggaggatcgcttcagcctgggaggtagatgctgcagtgggttacgatagtaccactgcactccagcctgggtaacagaatgagacgctgtcctaaaacaaaaaacaaaaaaaaaacatttaaaatgttaaggttagtatccttttatgaaactttgtctcagttgtgtttgtgtttatgtgtttcggatctcagtgattttcattgcatgtgctgtagttgaaaatgtttgaaagcactgtcttacatagtgttctgtgacttgtattttcatttcacataataccagtttttcttttggtcagtacatacatatcaatctcattttgaaaaacgctatttagagctggatgaggtggctcatgcctgtaatgccaggtctttgggaggctgaggtgggcggattacttgggcaatgtagggagaccctctctgtactaaaaatgcaaaaagttagctgggcttggtggcatgtgcctgtagtccaagctactcgggaggctgaggtgggagaatcacctgagctttggaagttgagactgcagtgagcggtgatcattccgctgcactccagagaaaagtctcattcctaaaaaaaattatttagtattccattaagtacacacaatttacacacatcatacatataccattatttaacatttcacctattgatggacatttatttgatgatgttggcaaaaccctcagtgaacattttttgttacataattttgcaggtgttagtttattgtaggattgatacatcaaattggaattgtagtgttggaatatacgcatatttcagattttggttgaatttgctaatttgcctttcaaaaataccagtttgtgttgctcacattatatacaatgcccatttttctgtattttccatactgggcttttttgtcttttcatacatgacagtagaaattggtacattccagtttgcacctcactgattactggcaaaggtgaatatctttgtttttttttttatttgccatttaagtcagttctctgttcatagtgttggattattgtttctttttttctgcacctaccactaacttgagattcttgttaatttatattttatttatttatttatttagagaccgagtttctctcgttgccaggctggagtacaatggtgtgatctcagctcatggcaacctccgcctcctgggttcaagtgattctcctgcctcagcctcccatgtagctgggattgcaggcatgtgccactgcacccggctaactgtatttttttagttagagatggggtttcaccatgttggccaggctggtgtcgaactcctgacctcaagtgatccaccagcctcggcctcccaaagtgctgggattacaggcgtgagcctctgtgcccggcctcttaatttatttattttttttttttttgagacggagtctcgctctgtcgcccaggccggactgcggactgcagtggtgcaatctcggctcactgcaagctccgcttcccgggttcacgccattctcctgcctcagcctcccgagtagctgggactataggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctcttaatttatttttaaggattctttgtgtattgtggatattaactctttttggttatataattgtttttttttttttaatgaaaattcctcattataccccagaaagcatttcatttgagcttttcaacttatccaacttctaccacataaattttgcaagaaataaaaacaaaagctctcattttgttgtacagtgtgatccctaaacatattcagaatatatcatctgaaatcaaataatggtttcttccaaccctgtaggaaaaaatagctttggtacgggcaaattaaggaaggcttttcttttcttttttttcttttgctcaaattcaaattaaggaaggcttttctttttttgttgttaataatttttgtaattttaatagagatggggtttcaccatgttggccaggctggtcttggacgactgacctcaggtgatctgcctgcctcagcctcccggcataagccactgtgctgggccacaagttttatttttttccaagatggactcttgctctgttgcccaggctggagtgtagtggtgtgatctcggctcactgcaacctctgcctcccaggctcaagcaattcttgtgcctcaacctaatttttgtatttttagtagaaatggggtttcaccattttggccaggctagtctggaactcctgacctcgtgatcctcctgcctcggccttccaaagtactgggattacaggcatgagccactgcgcccagccacaagttttatttttatgtgatcagaattactttggctcctggatcttgtaggttatgattagcaatgtcttcccccatattccaagactctataattctttttctgatgcttttgtctctcattccacaataatgtaatatcctaacattttattttaatatattctgtttttcttcaacagttctctctcacaataaacaaactgcattgtgttgctgttgtatattccttatacatgcctctcctataaactaaaagatgaatacaatcaattaagaattttacacccccaaccttagcagcagcatatcatgtagggaaatgagaattgtgagtcagcaagcacacacactgttgcaattccctgatgatcacatctgctgaagcaggcccttgggtttgggaggaacatttcctgagacttgcatataaacacccacgttcctgaactctgcatttcatggtttaacaggtagactagcactatagcttcaggctgtatttttgggaggcaatagctaagtgggtgtttctctgcagcttcttattttcagtgatggtgattcaaactcaagcctcctgtaatgtgggcgtttgggtacttaatgagtagttgttacacaaatattaaatgtacagatacataagatatttttgtatgcttcgatgtaagaaaccaatcttagtataaaaggttttatactgacccttggcatgtgattttctcccgccccatgtgttgagactaagaaacattcattaactcatggacataacaatttcttgttttatagtgatattaacatcattagcactatcaattgcacaccactgccttggttatttagtaataataataaacctttgttctacaggttttccttgaagtaatggctacatataggaaggttgattgtaatactaagagagacatagaaaaatctttctggtgctaatagatgcctcagataaatttaaattctaacaattttggaatatctcaaaaggaaaataaccattttcaattttttcttgattttctttggagtttctaaggccactattaccattttgccccccatatagcttctttataactgctacagctaatcataaatatagcacatttttcctatcttgacaaattaccagaactttattgtatcacacaacatcacactcagaatgtctctcaaattgtggaccattagttctttcattaaacataaaaagccatttgtgcataaaacaaggcagatctggataaaaatacctatttttccattgcaatagtcagtagtcaagtcattttatgataatccctttacagacaactcaaacctcacagtactttttttttttttttttgagactgcgttttgctcttcttgcccaggctggagtgcaatggcatgatctcggctcactgcaacctccgcctcccgggctcaagcgattctcctgcttcagccttcccgagtagctgggattacaggcatgtgccaccacgaccagctaattttgtatttttagtggagacagggtttctccatgtttgtcaggctggtctcgaactcctgacctcaggtgatctgccctcctcggcttcccacagtgctaggattacaggcgtgagccaccgcgcccagcccacagtacctttttttaattcttctgtggattactgaaatacagtacagtgattttagaatgattcatgggtcatcgtccagggatgctgtaaaggtgagggcaatacacatttagagtagaatttttcatctattttatatatttgagtttcacctaagtttttgtttggaggcaaggaggtattagactaccagaaaataaacaattctgtagtttgtgctgtaaactatttcctttgatgaagtaatataattttagtatttcttggagcttgcgttaattactaatggtttagaactttaaaagaagtcttattctttgtcccaaagctgtcctttttttttttttttttttttttttttttgagatagagttttgctcttgttgcccaggctggagtgcaatggcgtgatcttggctcaccgcaacctccacctcccgggttcaagcgattctcctgcctcagcctcccgagtagctgggttacaggcacgtgccaccacacccagctaatttttgtatttttagtagagacagggtttctccatgttggtcaggctggtcttgaactcctaactttaggtgatccacccgcctcgacctcccaaagtgctgggattacaggcgtgaggcaccgtgcccggccctgttgtcttatttttaatgaggttggacagtcagtaatttgttcagtagtcatccttactgatttatattgtgtgggttgtcttggtataaactttctgttcttttttgattgtgatctcaaagcagttcccatacaatatttttgacctgcaagtattatatctttgaagtgattttcctggtaaacggtatttgtttcaagatgcagttgatatgttaaaaagaacttcagaagccatgcatggtgatgcatgcctgtagttccagctactcagaggctaaggtgggaggattactttcgcccaggactcagcctgggtaacataatgagatcctgtctctctctctctttttttaatggaactttaaatcttatcaattgccaataattttggggaaatatggtgggaaattgaatggaattttttttaataatgccaataacttgtattcaccatattcttccccgttttacacttctaaaatcaccaccggcaacaaggtccctaagcaaaattcaacaataccagtttctacaatgggttttcctctggtgaaaatgagttcttagtccaaccactctggttcgtgctgaaatttgagtctgtttagtaacctcaccagaagacgttgagctttttgtaaaacaagtttgtctagataaaccagttttcatgagatggtataattgaaagtgttgtgttagtgaaagacgatatgttggatttagttttcctatagttgtctgtaagaaagatgacatgattgtgttagttgagtattttgatttgcaagtattgaattttaagaataattaatttttaaaaattctttggaaacctgttttattataggtggcaggcagttaagagccctggttgtcaaatacacctaggtttgaaccccatttctatcatttataacattgtgacatcgtgctaattactaaaccctaagttttctcctctgttaaaagggaataatagtttctacaccagacattttgatgagcatgtagtatgtacccgatgtcttctaaatgctttatgaatgtttatccattttaattttaggattactatctaagctatgtgttacttcatgttataattgaggaaactgaagcacagagagatttaagtattttacctatgatgtgtataatgtactgagcgcagtacttgacctgcagtaacacttaccgtattcacccctttgttgaaatgagtggtcactatgaagtttccaaatgtattatatttttaagtaactgacctctggcacaacattgaaaggatcttctgtggtgcttttttctttcctcttgtctccgtagctcttggtgctggacaggcatctttgtttgggaacaaccaacctaagattggagggcctcttggtacaggagcctttggggcccctggatttaatactacgacagccactttgggctttggagccccccaggccccagtaggtaagtgtcagtcactttagaaggcttttcttaattttttgctaatacttgctgacctgattttccatcctacacctgtcccattcctaccaaggcattgcatacatgcatgtcattaaacaattgggtagtaaagaagggcttattaatagatcctggcctactctgctttcccagctcctaggcctcctctgtcaaagaaaccacttttgttactatttttaattcatctgatatataatttagttcatatcgctaaatgtgcttatattactgtgttttggtttattaaatctaagtaaatgtaacctgttatggtagatgagaatttagctcatgtatcacctctactttatttacttcttccaatataattatgtttactaaatttactatatttcctaaatttagttttatctattgaagtgtttttctttattttatttttttgaaaaggagtctcgcgctgttgcccaagctggagtgcagtgatgtgatctcagctcactgcaacctccacctcctgggttcaagtgattcttctgcctcagcttcctgagtagctgggattacaggtgcatgccaccacacccagctaatttttttttttggtatcttgagcagagacagggtttcaccatgttcgccaggctgatctcgaattcctgacctcgtgatccgcccacctcggcctcccaaagtgcaaggattacaggtgtaagccaccacgcacagcctgaggtgtttttcatacttcattcatttgaataccaccttccacactttgccagggtccacctaccactttattatgtattttgaacttaaggaaattaacttacttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaacttacgaaagtagtgctgcccagattttttccccttggagtttctgattcctattttccctggtattaccaccgcttactgacttccatagaactgttccaaattctgaaggatggtatcagaacatttcatttaccccagttacttcattctctgctacctctgtcctcctgcagcagtgtggactctgattattctctaggccttcagcattgcttcaagatattctcgtcaagtctgctcagtgagaactgctatgtcctgcatatagggtttttctctttatttattttctgaattttctggaatgtgtcttcaagtgaagtgtaatatgaaggctaacctttgaatacttagaggtctgaaaataccttcattcattccacacaatttaatattagggacttgtgtgaaaataatttattctcagaacatcgactgtcttccttcttgcagtaaccattactgatggtctaatgctcttgtgcttcttgtgacctgtgccctctatcctcaaaagcatttaggattgtccttttgtcctgacattttactacattttgcttagatcctttctatcttaacagttgtgtctttgacctgtgtttctgctttctgggagatttttttgttgtcttctcagtctttttggatttcctttttttttgagacggagtttcgcactgtcacccaagctggagtgcagtggcgcgatctcggctcacttctatatccgcctcctggattgaagcgattctccttcctcagtctcataaatagctgggattacaggtgcctgccacacgcccagctaatttttgtagtttaagtagagatggggtttcaccatgttggccaggctggtctcgaactcctgacctcaggtgatccacctgcctcagcctcccaaagtgctgggattacaggcatgagccaccgctcctggccagatttttgtttttaatttggaagaattcattcttgttctctgaaagtttttttttaaccacaacacctgtttcttagatacagtttttttgcttaaaactcagttgggataaaatttttttagcgttcttctgttccttggattttcaggatgatttttgttttgatagtactttagtgcttggtggtccttttcattcccatttaagattaaaaataggctgggcatggtggctcatgactgtaatcccagcactttgggaggctgaggcaggcggattgcttgaggtcaagcgttcgagaccagcctggccaacatggcaaaaccccatgatgtctaccacaaatagaaaaactagccaggtatggtggcacatgcctgtaatcccagctactctggaggctgaggcgggagaatcgcttgaacctgggaggcggaagttgcaccgagccgacgtcacgccgctacactccagcctgggcgaaagtgcgagactctgtctccaaaaaaaaaaaaatatatatatatatttatatttaaaagctcactggcaactctttgtacgtgagtagggcttgtttcccagtatgttttactttagagtaagtaatctagaaaccggctattatcagagggtcctctaaatgttagaatgtcagattcttagctctgggatgattgcagtaaccacagtagttgcccttctcctttttatgtgtttacttagagaaaggcatactttgacctgtgtattgagcatcagtgattaggagaatggcaatatgtagttttctatataaacttcatttctttttttttttttgagacagagtcttgctctctccccaagactggagtgtagtggtgtgatctcgatcttggctcactgcaaccttcgcctcccaggttcaagtgattctctttcctcagcctcttgagtagctgggattgcaggcccatgtcaccacgcccggctaatttttgtatttttagtaggtattgggtttcaccatattggctaggctggtcacgaactcctgacctcaagcaatcctctcgcttcggcctcccaaagtgctggggttacaggtgtgagccaccgcgcctggcttagactttccattaattctttcctcttcctgttttcaattctacttcatcaaacctggtattctgaagtccctagacttctgggattctccaaggtagatacgcgtcatttgatcatactagtagacccttggacaacatgagggttaggggtgctgacccccacacagttgataatttgcaaataatctttgattcccaagctttactgacaacataaacagtacaaattatgtatattatatgtagtacgtactatattcttactataaagtaagctaaagaaaagaatgtattattaggaaaatcataaggtggaggaaggtgttggtcttgctctctcaggggtggcagaggaggaaatccacacataagtggatccacacagttcaaacttgtgttgttcaaaggtcagctgtaactgcttttgagtgtactctaagctatagttttctgtatcctgcttgatcagtcctctgtccacatctttcccctagaaatttgttagattttctcatgtgttcatttgccaccttcccattgtttgtcattgtgggtttatatatataaatgttaatattttttagccaaagatttaataaggtcttggagagagcggaggtgaattcgagttttcattgatctctgtgcggattttatacttagctttatcattaaaaataggcctggtgcggtgcctcacgcctgtaatctcagcactttgggaggccgaggcgggtggatcacctgaggtcaggagttcgaccatcctggccaacatggtgaaaccccgtctctactaaaaatacaaaaattagccgggcgtggcggcaggcacctgtaatcccacctactcgcaaggccgaggcaggaggattgcctagtctgggaggcagaggttgcagtgagccgagatcgcgctactgcactccagcctgagtgacacagcaagactctgtctcaaaaaaaaaattgttttaattttatttttttctcattttttattggttttagtagaaggtggtagcataaattattgtaatatgccatttttacttgtatagctttttgactggtttttaataatccatctctttttccaaagttcctgacacaagaatttagttaatattaaatttgtgtgccttaacattactgcccatttaaaggtaattgtatttacttttagaatgtacatctttataccacggaatcttagttgaaggtactttagaactatgtgagtgtgccttgtcttaaaaaaacctcaggtatggtggcttccttacaggcagtacagtctgttcttctgttctggttgtgtggaaaccaaatccttcctccatagagtttccacccagtggttctacttttatttcctaaagctaagcaaaaccagtctagtatgtatggtttcttttctttctttcctttttttttttttttttttttttgagaggagtcttactctgtcacccaggctggagtgctgtggcaccatcttggctcactgcagcctctgcctctgggttcagacaattctcctgtctcagcctcctgcgtagctgggactacaggtatgtgtcaccatgcccggctaattcttgtattttttagtagagatagaggttcaccattttggccaggctattcttgaagtcctgacctgaagtaatctgcttgctcagcttcccaaagtgctgggattactggcatgagccaccatgccttgctgtagtatatttgtggtaacccactgactttcttctggataaagtatcatcagattcttgtgtttcatcagaagacttggtttttgtacttttccctatccctttaatcatttggttatgatttagttttttggaatcttttattttgaaatttctttggaatttgttctttggaaagttttcaaattattttgaccaagattgaatgtaataccagtagttgcttaactagtgcttgtttgttttcttgtttttgctaatctatcaagatactctcttacctgtgtctttaaatactacagttaacacaaagtttatatttattcatacagatataaaatcatgctcatgcactttcttgtgtttggatttgtgaaaggaagtctttggttttttttttttttttttttgagaacgcccaggtagaatgatttgtacttgttaaacgatgggatcaactaagacaggtcagttttctaaatgagtaattgcctgtccagtaacaaaatgaccagtgaggtttggagttctctaaagtttttcttgagtctccttgcatagtccccaaaatagcagtatgctgttaatctgtagtactgtgtaccaaaaaaaaaaaaacttttctttattttttgctcttaaattggatttaggaactttctgaatacagatgatttactctgtgctcttaaaattgacatctcttggtttgagatcctgagcaaacttgtcctgtctagttaaatatcaacatgaatgtacggtgttttagtatttattgaatacatcgattttaagaaacctttgactcttctttttcattaatttagctatagcagcctgttctgtttttgtttgtttgtttgtttttgagacggaatctcgctctgtcgcctaggctagagtgaagtggcacgaccttggctcactgccagctctgtatcctgggttcacgccattctcctgcctcagcctccggagtagctgggactacaggtgcccaccaccatgcctggctaattttttctattttgttagtagagacagggtttcaccatgttagccaggatagtctcgatctcctgaccttgtgatccgcctgcctcggcctcccaaagtgctgggattacaggcatgagccaccacgcccagcctctttttttttttttttttttttgttattactgcttttgttctccacccactccccacaacattgtgagacttttcagaaagttttatgtcactcctttactgtggattattgtattatattttggcagtaactttatttgtaaatgtttataagggaaaaaggtagtatttttgtctgtaaaatgactttattatgttttgggttttgatcagtatttttggaaagagattttatcttgcaaagaggtttcttcttcagtcagggtatactgtagtggttttgcttttttcttaatgttttacttggtacaatggtagatcatgaatagtcttcattgttacttacgtctgttccctaaattctctgcaattgataacagatgttcttacactttgagaaaaaattaggcttagtgatttcttttttctttcagtttatattatttgaatgttaaataaatgtaaataataaacttataaggatagcctaagcattttcttcaggaagacacctggatttgggggaaaagaaaaaaccacatttttgtttgtatgctgccttcctctgtagccttaatgtacataatatttttattctggaaattttacttaaagataatttcatatttccacaatgaaacaaattattatttttaataactacataacctatgttgatgtgtcatgatgtttacaacttttttgtttgtttgtttgaggcagagtctcgctctttcacccaggctggagtgcagtggcgcgatctcggctcactgaaacctccacttcctgggttccagctggggttataggtgtgcgcccccacgcccagctaattttttgtatttttagtagaggtggggtttcactgtattggccaggttggtctcaaactcctcacctcaagtgatctgctcgccacgacctcccagtgctgggattacaggcatgagccactgcaccccgcctacaactattaacttaatattggacacgtaggttgtttccatatcttgactgtatatatactatgcagtgaatgcttaggaatttattttctttctagttcgagttaaattttcatgattaaaattatgaggttaaaaaatagaggccaggcatggtggctgactcctgtaatcctggcattttgggaggccaaggtgggcagatagttcaatttcaggagttcaagaccagcctgggcaacatggcgaaaccccatctctgaaaaaaaaaacaacacacacacacacacacacacaaaattagctgttgttggtgtggtgactcacccctgtagtcccagctacttgggagtctgaggttagaggatcacttgagcctggaggcagaggttgcagcaagccaagatcatgccactacactccagcctgggtgtgtgtgtgtgtgtacacgcacaaacacacagtacttgtcctgttgtatattgtcatattatttcctttggacaattacatacacgcacgcacacacacacacacagtatttgccctgtatactgtcatattatttcctttagacaattacacacacacacacacacacacacacacacacactacttgccctgtatactgtcgtattatttcctttagacaaaccagtctataatgtttctagaagtcaaagactatggctttttatgcagctatttcagtgataggtatgcataaaatatttcatcagggttgtttaaattttcctttctttgattagtagtgacagtgaacactgtgtaagtgaatttatatgagtattgtatcttatgaaatgtctcttcctaaatttgacctattagcttatttgattcttgattttctttacagtttgctctacacacattctgccccaatgataccattgatctgagcattttgaagaccacttcttcaaaaagaataccgagctctgtgttacaaatgcattgtatccttgcatttatatatatatatatattttgttttctttttttttttttaaaagctttgacagatccaaatgcttctgctgcccagcaggctgttctccagcagcacatcaatagtctaacatactcaccttttggagactctcctctcttccggaatccgatgtcagaccctaagaagaaggaagaggtaaatttaaggatacttctgtaaaatatcatatcaaagaaagagaaactgaatgtgcagaatgtaattttttgcctgtatatattaagggattaagcaaagctaggtgtaattaattttttaagatattatttcactcagccgggagtaaattatttttgctgtatctggaaggtgttgggacagtgaaatgaccactacactgaagatcaatgctgagggttttcaacagtcctgaaataaggcagatattaatgttctcatttttaattaaaacaactttttttaagtttttttcttttctttttgagatgatgtcttgctagtatcgaactcctggaaggaatcctcccgcctcggtctcccaacgtgctgggattacaggtgtaagccaccatgcccagccctattctcattttataattaagcaaactaaggcttagagaggctgactttcctcaaatcataatgctcttaagtggcataaccaaaatcttaacctcttgatttttacatagctttgtctttaatctcttataactctagtgtaaaaacatgatcttttactcacatggtgttaaaagtgtagtctttggtctgtttgatccttgttttaccgcttataatctgtgagacattggaaaatgagaaagtcattttgcctccctaaatttgtttcttctgtaaaatgggaagagtaatagtgttcaatgttgagggctaaatgagatcatgcataccaggatcatagtaaattgctcaatatacagaaactactattcagtcacttatgtgattacatgtatccctcagctttttattttgttgttttgttttgttgttttaagaaatgggatctgcccggcgcagtggctcaggcctgtaatcctagcactctgggagtccgaggcgggtggatcacctgagttcagttcacgaccagcctggtcaacacggtgaaaccccgtctctatgaaatatacaaaaattagctgggcatggtggtgggcacctgtaatcacagctacttgggaggctgaggcaggagaattgcttgtacctgggaggcagaggttgcagtgagccgagattgcgccattgcactccagcctgggcaacaagagcgaaacttcgtctcaaaaaaaaaaaagagaaatgggatcttactatgttcttaaatttaatcctgtaaactagatactagaagcaagatatgaatatgaaagtaccttttaaagtgatgtgtaaatgattagacaattatttatgcagcctaattttaggtagctgaatatgtgcaaggcattgtgttgttaagtgctgaggatacaaaatgaaaataaacaagaatttattaaggttgctatccagtgacaaacatcagacatacaagcacttaagtttacactggttcagtagagtgtatgtggtaatagaagagtgtctatcaatgacgaatggataaacaaaatgttttataagtctataatggaatatcatttagccataaataggagtaaagtactgatacatgctataacatagatgaaaccttgaaaacataagtgaaggccgggcacagtgggcatggtggctcatgcctttaatcccagcactttgggaggccgaggtggggagatcacctgagttcaggagttcaagaccagcctgaccaacatggtgaaaccccatctatactaaataaaaaaaaattagccaggcatggtggtgcgtgcccataatcccagctattcgtgaggctgaggcaggcgaatcacttgaacctgggaggtggagattgcagtgagctgagatcgcaccattgcactccagcccagatgacaagagcgaaactccgtctcaaaacaaaaagaaagaaaacgttaagtgaaaggagccagacacaaaaagtcacatgatttcatttgtatgatatacccagaataggcaaatcataagaaagaaagcagcttcatagttgcaaagggaagagggaagaaattgagaggaactgagtttctttttgaagtcatcaaagttttcaggaatcagatagtggtgatggttgcacaaccttgtaaatatactaaaaactattgaagtagatgcgttaaaacggtgaattctatgtcacatgaggtttatcttaatacaaaatttaaaatatactagtgaaaagatcatagatgcttggatgaatttgataaggctttgttttcagaagaggaacatttaacttttttgtatggatatgtagggcttggcgagtctaggtcaagcattccagccaaagaattgtgaaagatcacaacaatctgggaataacaaagattcattgttaagtgtaaacagcttgcactgggaagagaagaataaattctgacagactagatatgctagacattgttatttgaagtggttatgtaatctcatttatgctgttaggaaaacaaatatagaacatcctcaggatgttgtagaggtgccatctgaagcaccctgaaatttagttgtgtgtcctccactaacttgtagttttctcagtaatcagaggaagtaactttatttctggtacccagagtttgacttaatgtttaattattaatgtttactaaaagatggataaatacaagctagtatctgccttttttttccccagagcaacttgcattacatagaagttgaatattaattcatgacagaatctcagtttttcttgaagtataagattttgggtttaattgaaaagtaatgtctatggcttaggatttttttggtatcatgttttcatcaaatgaacataaatactgtttttcaaagcagaatgattgcaagctaaactctcataggatgaagagaatggacaagatatattaatatgttgtgttagtacattttaatttacagaacttttttcagattcatcatctttggatttttttggggaaagagtctcgctctgtcacccaggctggagtgcagtggtgcgatctcggcttactgcaacctccgcctcctgggttcaagcgattcccatgccttagcctccccagtagctgggattacaggtgcacgcttccactgtccagctaacagattcattatcttgattacattttaaaagatgtcagacaaataattttaaatgggggctggaaagatgagtaaaaatcagttctagaacaataaagacagttcggttagtattcacacatacacacagataatgcctcccaaatccaaaaattgaaaatccaaaatgctccaaaatccaaaactttgcactgacatgacattcaaaagaaatgctcattgggacattttggattttggattttcacatttgggatactcaactggtaagtataatgcaaatatttcaaaatacaaaaaaatccaaaatacttctggacccaagcattttggatgagggatactcaacatgtacaaagttgggtgttaacatccttgttttatgggaacagagacttcaacaggtatctagcaggtgaatgacaaagatgaggattgaaatctggtcttgtgatttttaaggccagtgcagtacatttaaagtaaaccaaaaatttccttgatgcttttgtttttcagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagtgagtttatttttgttaacagaaattaagtgtaaaatactgatataaactaaatatgaaataatatacaattatttaaatatattatagatgtgatacagtccactttgtttttgtttttgtttttgagacagagtcttactctgtcacccaggctggagtgcaatggcatgatctttgctcactgcaacctttgcctcccaggttcaaacgattctcttgcttcagcctcctgagtagctgggattacaggcgtgtgccatcacgcccagctaattttgtatttttagtagaaatggggtttcacaatgttggccaggctggtcttgaacccctgactgcatatgatctgccgcctggcctcccaaagtgctgggattacaggtgtgagccgctgtgcccagccagtccacttttttataatttgaaaaatacagaacatcacaaagaagaataaaagtcacccgatcactcccagggataactcatagttagcataaaaatattttgataaatatgcctcttattttacatatgcatgattttgttttgtttttgaataattaggtttttttgttgttgcttttaaaagttcaggtctcactctgtcacccaggctggaatgcagtggtgcaattactgctcactgcaacctcaacctccgcagctcaagtgatacgttaaaaacattacacacaactttctttccctaaaaatacagtaatccggccgggcatggtggctcacacctgtaatcccagcactttggctggccgaggtgggtggatcactggaggtcaggagtttgagatcagcctggctaacatggtgaaaccccgtctttactgaatatacaaaattagctgggcatggctgcgtgcgtctgtaattctgtaatcccagctgcttgggaggctgaggcaggagaatctcttgaactggggaggcagaggttgcagtgagctgggatcccaccactgtactccagcctgggtgacagagtgagactcggcctccaaaaaaaaaaagaaaatgtaactgcttcaccaaagatggaaagtctaattttatgtgtttcttagaatatcagtaaattattttgaagacagggactgtgtattatttatgtctgtcctagcattttatttatttatttttttgatacagtcgctctgttacccaggctggagtgcagtggcacgatctcggctcactgcaacctccatctcctaggttcaagcgattcttcttcctcagcttcccaagtagctgggactacaggcacgtgccaccatgcctggctaatttttgtgtagagatggggtttcgccatgttggccaggctggtcttgaactgctgacctcagataattcacctgcctcagactcccaaagtgctgggattactggtgtgagccactgtgccccgccttgtcctagcattttatatactgtttttgcgcagagtaggtaaaaaggtttacagtagtccagtcatcaggtcagtagctcgagatcagcttcaccagggcttaggattttcaaatatacaagtagaaaggattagagtgggaggacatacattttgttgttaataccatctgacctccttggcctcacttctgtggtgttgctgtcaaacgtcatccttttttttttttttttttttttttttgaggcaagagtcttatgccattgcccaggctggagtgcagtggtgcaatcatacatcactgcaccttcgacccctgggctcaggtgatcctcccacctcagttcccaagtagctgagaccacaggcccacaccaccatgcccagtaattttttttttttttttttttttttggagatacagggtctttctgtgttgcccacggtggtctcgaactcctgggctcaagcctcagcctcccaaggtgttaggattacaggcatgagctaccacgcccagctacctatcaaccgtcttaatgtaacagaagcattttacacagttgatcttgtccctcctccttgattcactttcataattgtcttccaggaccccacaatttcctagttttcttcctgccttgctggttgctgcttctcagtcccctttactggttcctcttcattccaccgtctgtaaattagaatgcccttggctcagttgttgatcacattttatctatgcttatttccaaagtgcttcaatttattctcatggctttaaatatcatctatagtctgatgattcccaaatttttatctccaacccagacctctttaccaaactaaagattcttgtatcttaccctactctacatcttcacttcgatgtctaaaagaaattgatttaaaattaacatgtccatgttttctttctcaaacctgttctacccaaaacctgtctcagatgattgcattactatcattctagttgctccggtcagaaattttggaatcttccttgactttgtcacacattcctcatctaagttatcagcaaatcctcttggttctaccctgtaaattacttagaatctgtatagttctcaccacattcattgctattaccctagtgcaagccaccactatctcttgcctgaattaccacaatatactcttcagttcttattgtttttatttttatttatttatttattttgagatggagtcttgctgtgttgcccaggctggagtgcagtggcccgatctcggctcactgcaagctctgcctcctgggttcactccactctcctgcttcagactcccaagtagctgggactacaggcgcccaccaccacgcccagctaatttttttgtattttttttagtagagacagggtttcactgtgttagccaggatggtcttgatctcctgacctcaagatctgcctgcctcggccttccaaagtgctgggattacaggcgtgagccgccgcacccagccccactcttctgtttttactcttactcttttgcatctgattctaaacattgctatcacagtggtcattttgaagcataagtcagatcatttcccttttctcctcaaaaccctaaggtagttcacatttttttactcagagtaaggaccaaagtgcttacattggcatataaagtcctcaaaggtaggatttcccattactgctctgaacacatctacgattctctccattgcttactccactctaaacttactgttccttgctcctgttaggacacgataggcatgctatttatttgggcctttgccccaattgttccctttgaaacacttctcctcatatatccatatagttaaccctgacgctctgtactcacatgtcacatcaatgaagactactcttgcgacactatttttggtttatttttttgtttttgagacggggtcttactctgtcacccaggctggagtgcggtggcgctgtcatagctcactgcacccttgaattcctgggctcgggattattctgacttggcctcccgagtagctgggactacaggtgcgtgccaccacacctggctaattttttttattttgtagagacaggatcttgctgtgttgcccaggctggtctcaaactcctagcttcaagtgatcctgccacctcagtttcctaagtagctgggactataagtgcacgccattgtccctggctgatatttaaaaaattttctgtagagtcgtgttcctactttatagtagagatggtgtttcactgtgttactcaggcttgtcttgaactcctgggctcaagcaatccccccaccttggcctcctgaagtgctgaaattacagcgaaacccaccatgccacctttatttactctctctttctacccccaaccccagttgctatgtttcagtccaatgcagttattgttttctgtgatgttcaaattgtctcatatttgggcagcaaggagccctttcagattggctcataagtcctttccacatgcctcagtagtgcttggtaactttcttgcttgtaggattaactttgtaaaattttgttcaggagttctgccctctgtgttcattaattaaattccacacactgccccccaccctcacctgggttttttgtttttgtttttgtttttgttttgagatgaggtcttcctgtgttgcccgggctggccttaagtgatcctgctcagcctctcaagtacgtgggactataggtgtgtgtgcacaactgtgttcagctaacgtttttttcttacagcgtccctacccagtttgggtataaagattatgctgacctcatgaacaaactggagagtatttcctctttctattttctagaaaagtttgtataaggtaataatttctaactgagtacaatggctcacatctgtaatctcagcactttgagagaccaaagcaggaggatcactagagaggccagtgagaccaaccttggcaacaaaatgagaccttgtctctaaaaaaaaatttttttttaattagccagacatgatggcacatgccgatagtcccagctatttgggaggctgaggtgggagcatcacaggagcccaggaattcaaggttgcagtgagctatgataccaccactgtactccagcctgtctcaaaaaaaaaaaaagaaagaaaagttggtaatctaatctgatggtaacatcagatgtttggtactggtaatgatagatgggtctgaagtagtatttataagactgtttgggggaaaaagtatttaagagttagaggattattcagctttttattttatattttgagtgacttttgatgttatatttttgtaatatgtattcatttcaataactaaaatttcaaatttattggcataaagttgtttaaaaatacccttgtctttttttttttttttaatgtcagtggcgtctatagggacacctactttttcattcccaacattgacttttattgtgccttctctttttctgtttgaccagggatctcccagtattactggtaacttcaaagaactaacttatggcattattgatgttctcgctcctgtgattgtttcctatttcatcagtttttaatttattatatcttattaatatttaattattatcttgttcctttctcctctcccctttgattttcagctttccttctttcaaatatatgcatttaaatatgtaaattttccttttagttcaactctttttttttatgtttttgttattaacttctagatgaaaagtaaaaggcgatagcaatagcaattcttagaaatttgagagttcctttaatggcccagtatactgttagtttataaatgttccatgtgtacttgaaaagagtgtgtactctgtagtgaatgagtacagtgctcttacattaggctaagttagaccagcctgggcaacctggcgaaaccttgtttcaacaaaacagtggccaggcatggtggtgggtgcctatcgtcccagctactcgggaagctgaggtgggagaatagcctgagtctgggaggtaagtcaaggctgtagtgagccatgatcagcgattgtaccactacacaccagcgtgggtgacacagtgagactctgtctaaagaaaaaagagaaaaacctgaactttttaggtatttgtgatcgatcatttgcattatttgataacaggattttttacttcaatactttcttgtcatgtttttaaaaaattctctctctttgggcaaaccaaagaaagtaaaaagaaaaaactttttagtcagcaaatgtctgtttacctttttcattcaagacagcactatgagttctatggtgagacagccatacgtttgtactgccaaaagagagagaaagcatttggagagtatacagatgattgaaatacaaacatagtgtgatgagtgaacgaagtgtctggataaagtgctcagagctgggaggaggacagttttcaaggggattttccactttgacttgaaggtgttcagctttattcttccaaacaccatagtacaatgtatttgacaccttgtgttttggctatacaatcctaggaagcgtttataaatgaaacttgttaggttattcttaggtgtacaagagttgagcagaagtgcaccattggactccagtttttaagataatgtctgggacatatctgtatgcctgagtaatttttttcttcttcttttggtttcttgtttataggaagagcattaagaagttggttttgaagaaccttaataatagcaatctcttttctcctgttaatcgtgattcagaaaatctagcttcaccatctgaatatccagaaaatggagagaggtacactgaattctgttttgagttcttcttagtagagagttatagtctcatttttaagacattcttaggaatttatgaaaatttatgaagtttgatgaatattacatagaagtattacaagcttatgagcgcctagaaatcaaatcatatttttgtcttttgaattcattaaaccttaaaattattggagttctgatttagtgcttcagaactattttggtatttgtgtatcttgttttggacagggttagcatgtatttgacaccctttagccctttaagggatattttgtctgtgatgattttctttctttttttttttttttttttttttgagacagagtctcactctgtcgcccaggctggagtgcagtggcatgagccaagatcgcctcccatgctcaagcgattctcctgcctcaccctcccatgtagctgggaatacaggcacccgccaccatgcctgattaatttttgtatttttagtagagacggcgtttcaccttgttagccaaggatggtctcgagctcctgacctcaagtgatctgcccgccttggcctcctaaaacgttggtattacatgcgtgagccaccgtgcccagccttgtacagtgattcttaatagttaggtatatattctttcatatcagaaatttatttatttattttttttttttgagatggagttttgctcttattacccaggctggagtgcagtggcacgatctcggcccactgcatcctctgatgtgaattgttcaagcaattctcctgcctcagcctcctgagtagctgggattacaggcatgcacctccacgcccagctaattttttttgtatttttagtagaaacagggtttcgccatgttggtcaagctggtcttgaactcctgacctcaagcgatccacccgcctcggcctcacaaagtgctgggattacaagcgttatccaccacacccagccgaaatttctttctttataaatatattttattatataaagattatgcacgaatgatatattctgtaacctgcttatttccatttattttattagaaatgcctttccattatctgtatgaatatatttgtcttttcttttttaatgattgcataagtcattattgtgaatgtaagataacttgaccagttccttgttagtggacatttagattatccggtattcctgtactcaaaacagtgcttcagtaaaaatccttatatactggcacaagttctcagggcctcctgagggctgtatcacgaaaaagaaaaaaaaaaaaagaaaccctttgtatagacacctttgtactcctgttttttttttcttttggataaaattctagtgttttttattattattattatttataaagcattttttaacattttgttgattgtaatcttaaaaatctaacatttttttcagtttttaatcttaaaattaaccaattatttgattccatataggagagtatacaatagagatagtaattatctgtttcacagtactgctgtagtaagtattaagtgaatttttaatacatggaactatccagaacagtgccaggcacttagtaaaggctcggtattagttagctattatcattgttattactactacaagaggctaaggtattatttcttttcctttgcagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtcaggttcagattggtgcatgtttaatctcttaccagtcattcgagatgacttgcttgttgcagatattcaacatatggaagtcagctgtttggcattttaagtattattttatgtgatcccacataggagagcttaatatttaaacagttttatgctttagttgattcagagttcacatactctttggaccttagagtatgaaaattgatacatctttaattatcctggtgtagtctaaagaacccaaattttatagccaaagagactatcctgatattttccctggctttgtaaactcggatagattgcttattgttttttgtttgtttgtttgttttttcttgagacagtgtcgctctgtcgcccaggctggagtgcagtgtcgcagtcttggctcactgcaacctcaacctccagggatcaggacctctcatctcagccacccgagtagctggcactacaggcacatgataccacaccccgttaagttttgcatcttttgttttgccatgtttcctgggctggtctcaaaatcctgggctcaagtgatcctcctatcttggcctcccaaagtgctaggattacaggcatgagccaccatgcccagcccattttgggtgttttgtggtattcttgaagtgtctccaaaatttatatttagttttcttattgccattatatatatatatatatttggttacttagtatcataaggaaagaagtttatactttgacagtaagaatcccaggtagcctgggtgtggtggctcagcactttggcaggcttaggtgggaggatcgtttgaacccagaagtttgaaatcagtctgggcaacatagcaagacctgatatctacaataaacttaaaagtaattagccaggtgtggtggcatgtacctgtagttgcagctactacggaagctgaggtgggaggatcacttgaacccaggattcaaggttgcagtgagctatgattatgccactgaactccagcctgggttgacagaccaagatcctgtctcctaaaaaaaaaaaaaaaaaaaaaaagaattccaggtgcttaatctgtatttgtgtatgtatctctacatgaatttattatgctactatatatctttttaataggaagttttatattctagttttttcatttaccttgtttgctgccacccaatttagagttcccttcccaagaagcaagtatacaagtgggtgttgctggaggctggagtttggtctgatgttggcctgaaatacttttctctcagagagcaagttagccttatatctgactacaagtaggacaaggagtgaatagagcaagcaagcacaccagtgttccactactttccttgagtttttcagcgctctgctttttttattttggtatttttttttctattttaatttattctttctttcttcttttcttccttcctccctccctcccttccttccgagtttcactcttggttgcccaggctggagtgcagtggtgtgatctcagctcacggcatcctctgcctcccaggttcaagcgattctccttcctcaacctcccgagtagctgggattacaagcacccgccaccatgcccagctaatttttgtatttttggtagataatggatttttgccatgttagccaggcttgtcttggactcctggcctcaagtgatttactcaccccggcctcccaaagtccttggattacaggcatgagccaccttgcctggctggatttttcatctttcttttagctctttatttgggagtgtaaatttgaaaaataaaagaggtttatgcaaaacaggcaatgaaacaagaagaattgggtttggagttttatatctacttctattgttaaattacagtataagccaacacaagttatttccactgtaggttttggtatccttgtgtgtaaaataaaataaaaagctgattaagcttttctcagagtattttatgagataccttttatagtccgggatgttaatgggtgtcctttgaaaataatgttctgtggttaaatctggaaaaacacgaggttaagcagagtttaataggctatttactgtaagttttagactctttgatgtatcatatgtatgttcttcaaacctatttgaccatgaagcttttcacacacacacacacacacacacacacacacacacacactcacacaccccttctcctaggaatcatgtttggtagaaaagtagtttggaaaattcttcattctgatatattttctctttatatgatgatttagttgctgattatttcaggttatttttttttctgtttttttttttttttttgtcacaggtattattctcactaaggttggttactatactattccatctatggatgaccttgctaaaattaccaatgaaaaaggagagtgcattgtctctgatttcactattggtcggaaaggtaagtgtgagtttagcacttagtgattaagccagagagttgcaccttatttttgtaattaggggaagcttttgatagctgaatcttcattttcctacatttgggcccaccttggcctgaatcttaaatactttgattgataagtaacaaaacaagaaagactggaaccatgtaaatttttttatttttatttattttattttttctgttgagatggggtcttgctacattgcctggcagatctcaactcctggggtcaagcatttctcctgcctcagcctcctgagaagcacagaaccatataatattctttgggcttaggtatacctgtttggtgctagtaactatttgggtcattttaattttctgtaattaaagaaaatactggaaataccaagaacttctgagaaaattgaataataggcaagagatgtataacacttagcatgaacttcatgttattattactgataattttcttgtgggaaatgccactgtgctatattgtattaaaaagagctcaggcattttaacccatatgccaggccaagtgcgaaggtttgtttatatagcgtcattatagataaatgggaagagatttaagaaggttgttttgaggctaatgggagttttataaaaatgcagatgttaggcctgtcgcagtgactcacacctgtaattctagcgctttgggaggctgaggtgagaggatcacttgagctcaggagttctagaccagcctgggcaacatagtgagacctcacctttaccaaaagtaaagaaaatgagccaggcctgatgatatgtgcttgtagtctcagctacttgggagggtgaggtgggaggattgtttcagtttaggaggttcaggctgcagtgagacaggaccactgcacttcagtctggtcaacagaacaagaccttgccaaaaaaaaaaagaaaagaaaagaaaagaaaaatgcagattttaaatcagataacagtgtaattgaagttactccctaagtccccattcttaccagtctaggaattgctgaattatttaaaatactaatacttaaaactgctttctccttgtgattgtttaatcactatagttgtaaagtaggtatttgccttcatacagaatgaatttttaactatttgctctgatttataggttatggttcaatctattttgaaggagatgtgaatttgacaaatctaaatttggatgatattgtgcatatccggaggaaagaagtagttgtctacttagatgataaccaaaaaccacctgtgggtgaagggctaaataggtaagagtttatgtacatacagaaaattatcagctaaatcacaatttttttttctgtaaacataaatgtgtttagatgtatgcttctgtagcttgctttccttactatagagtacatttattgtctctactttgatttaaaagtataaatggcaaagaaatgctatactgtgattttgaactccttttccctgattttattttttaattcatttttttacattccttggattcgattctattctattttatttcatttcatttcattttactattattattttttttttttgagatggagttttgctcttgttgcccaggctggagcgcagtggaatgatgtcagttcactgcaacctccgactcccgggttcaagcgattctcctgcctcagcctcccaagtagctgggattgtaggcgcccgccaccatgcctggctaatttttgtatttttagtagagacagagtttcaccatgttggccaggctggtcttgagctcctgatttcaagtgatcctcccacctcagcctcccaaagtgctgggattacaggtgtgagccacgctgcccagcctccctgattttattgggtccaactgctaatttcaaaaactctttttaatagtattttgctttattcctgtttctgctgtggctatacttaactctctattttagtgtgagatcctagcttctaatatcttagtcaagtgaaagggctgtagtgaaaattatttatcttcataacctaccaaccctgaatcaggaagaaatagaaaatctgagcagatcaatcgatcctttcctttcctttccccttccgcttcttttcttttccctttctcttctttctttcttttctttctttcttcttttgagacagagtttcactcctttgcccaagctggagtgcagtggtatagtctcagcttactgcaacctctgccccctgggttcaagcgattctcctgcctcagcctccagagtagctgggattataggtgcccgccaccatgctcagctaatttttgtatttttagtagagacagggttttgccatgttgaccaggctggtcttgaactcctgacctcaggtgatctgcccacttcgccctcccaaagtgctgggattacaagcatgagccactgtgccgggccaataattagtaaagagattgactcagtaatcacaaacttgtcaaaaaagaaaaacctagaatcagatggcctcattggtgaattctactaagcgtttaaagaaataacaccagtcctactcagactcttccaaaaaattgaagagaagggaatactttcacactcattctatgaggcaagcgttaccttattcagtaaccaaagacactgcaaggaaagaaaactacagaccacttgatgagtatattgatgaaaaagtcatcaacagagccctaggaagcagaatttaacagcgtattgaaaggattacacatcatggccaaaagatttattctggaatgcatggatggcttaacatacaaaagtcagtgaaacataccactttaacaagataaaggaatataccacatcatcatcatcatcataatacagaaaaagtatttaccaaaatccaacactctttcataataaaggcactcaaatacagaaggcttttcctgtgagacaaggcaacacaaggatgcctgcttttgccacttttcccaaatatactactgcaagtcctggtcagagcaattaggcaagaaaaataaaagttaatacagttttgaaaagtagtaaaattatctctgttctttgatgacatcttgtgtagaaatccctaaagatgccacacaaaaaaacttactagttataaacaaattcaacaaagttacaggatacagaatcaacatggaaaaatcagttgcactgctatacactaacaacaaaaattaagaaaacatttcatatatatagtagcatcaaaaagaataaaatatacacaaataaacttaaccagggaggtaaatgacttgtttatacaaaactgcaaaacatggttgaaagaaagtacaccagacacagataaatggaagacagaccatactcatgagttagaaaacttcatattgttcagctaggtgcagtggctcgtgcctgtaatcccagcacttcgggaggcctaggcgggcagatcacttgaggtcaggagttgagacaagtgagcctggccaacatggtgaaaccccacctctactaaaaatacaaaaattcgccagacgtggtggcgcatacctgtaatcccagctactccggaggctgaggctagagaatggcttgaacctgggaggcggaggttgcagattacaccactgcactccagcctgtgtgacaaagcgagaccacgtgtcaaagaaaaaaacttaatattgttaaaatgtcagtactgcctacagtgaagcataaatttaatgcagtccctatcaaaatcccagtggcatgatttgtagaaatagaaaaatccatatagaatttcagaaatctccaaatagccaaacactctcaaaaaagaacaatttggaggtctcacatgtccaaatttcaaaacttattataaatctataataatcaaaacagtatggtagtggcatacagacataaataccaatggaatgtaatagagagcccagaaataaaacttcatctatatagtcgaatgatttttgagatagggtcttgctgtgtcacccaggcttgagtgtagtggtgtgatcatgactctctgcaacctctgcccccaggttcaagctattctcctgcctcagcctcctaaatagctgggaccacagagatgcaccaccacgcccggctaatttttgtattttttgtagagatgaggttttgccttgttgcctgcccagccggtctcaaactcctgaggtgaagtgtttggcctgccttggcctcccaaagtgttgggattataggtgtaaaccaccacgcccagtcttaaatgattttcagtaaggtataaaaattactcgggggcagggtggtgtggagcacacataaaaaaaactaaaaaaaaaaaaaattatttgatcgggagaagacagtctcttcaacaaaggatgctggcaaactggatatccacatacaaaagagtgaagttatgccatatacaaagattaacccaaaatggataaaatacctaagtgtgagatccaaaaatttacaactcttagaagaaaacacagaggaaaaacttcataacattggttttggcaatgatttctcagatataacatcaaaaagtataagcaccaaaagcaaaaatagacaaatgacactatatcaaactgaaaaccttctgcacagcaaaagacaagtgaaaaggcaacctataagaataggagaaaatatatgccaatcatatttgataaggggttcatagccagaatataaagaatcctgcaattcaacagcaacaacaaaaataataacccatttaaaaaatgagcaaagaagatgggtgcagtggcttatgcctgtaatcccagcactttgggaggcagagaagtgaggattgcttgaggccaggagttcaagaaaataggaagaccctgtatctacaaaaaaaaaattttaagtagtcaagcatggttgcacacacctgtagtcctagctgctcaggaggctgaggcaggaggttcagctgaactcaggagtttcaccatgttggccaggttggtctcgaacagaggttacagtgagctgtgatcatgccacttctctcctgcctgagcgggagagggagaccctgtctctcaaaaaagaagaaaatattggcaaaggacttgaatcgacatttctccaaagatatacaaatgaccaaggagtacatgaaaagatgcccaacatcactaatcattagagaaatgcaaatcaaactacaatgagataccatacccattaggatggttactagaaaaaaaaaaaatggccgggcgtggtggctcacgcctataatcccaacactttgggaggccgaggcaggtggatagcttgagcccagtctgaccaacatggcaaaaccccgtctctactaaaagtacaaaaattagctgggtgttgtggcgggcgcctgtactctcagctacttgggaggctgaggttcgagactcacttgaacccggtaggcagagggtgaagtgagctaagaatgtgccactgcactccagcctgggtgacagagcgagactcagtctaataagaaacaaattgccatgtgtctgccaatgtggagaaattggaacctttgtgcaccattggtgggaatgtgtaacagtgcagccactgtggaagacagtatggtggttcccggaagagttaaaaatagaattactgtctgatccagcagctccacttctgggtatatatacaaaattgaaagcaggatctcaagcatttgtatacccatgttcatagcaacactattcacaacagccagtaggtaaaagtcacccaaatgttcattgataagtgaatgggtacacaaaatgtggtatatacatgcaataaaacactattcagcctacagagaagattagcatggtccctcacaaggataacacacaaatacatgaagcattccatattttttattttaaaaattaaaaaatatatgttattcagcctcaggaagaaaattctgatatatgctataacatggatgaaccttgaggacatgctaagtgaagtaagccagtcacaaaaagacaagtactatattgtgatgtatctgggataagtcaactttatagaaacaaagtagagtagtatttgccaggggctccgggaagcaggaaatggagagcagcatctacctattacatcctagtagtcactgtgtttagatgtaaggcatacaaaatgaataggatacaacacttgaactctggtattaatattagaagtggtacaccaccactcttgtagtcatcttcataccgatattcctgatacttcattttctaagcatttgtttttagtaaatgggtagtagctgttttttattattatttagtacggtagccctttaagacctgcataagacttggttcgtaccactggactgtaacttaaataagttagtgattcctagcttaagtgtgaaaatgagattggaaataattgatgtaccatggtaatttaaataaatgcagtctgactctagaaccagatattgagttgtcaatgtaggagtgactccttgctcttaagcttatggggcaaaactcaagtttatgacacatgcagaataattccaaggcagcatagttaccattattcactatttatgtgttaggtggctttctggtcttatatatgaagcgcttttactttaattggttactttaattggttatgttttacaggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtatagtcatttaacccagttcagacttttataaactatatttggagtcacataacgtttatgttggaagggatcctttgctaaattctattgattgattgatgggggtcttgctctgttgctcaggctggagtacaatggtgggatcatagctccctgcagcctcaaattcctgggctcaagcaatccttctgcctccgcctcccaagtagctgggattataggcatgcactaccatgcctggctactttttaaaatgtttgtaaagatcgagtttctcagtgttgaccaggctggtctccaactcctgggatcaagcagtcttccctccttggcctcccaaaagtactgtgattacaggtgtaagccactatacccagccaaattctctttatttttagaaatttggagagagatgtacagatacattatgattcactccaaactacaaacctagttaaaattcagcagtaatgagttcttacaaactgtgggctcgtgattcaagtcctctacccaactcctatgaggatttataaatacatttctaaggtgtagtttttctaatgtttgtcatcattagggacttcagtaattcatcaggcaggtgtctattggatcaactcttcctatgtaattgtcattcttacttttaaagatttttggagatgaagaggttgactgtccgtaatagtttaatccaatgatttcctcccattctaggctggttgaattatttaacttgttaaaggcccttgggtagatagaggataacaggcaatatatgtctgtgaaaataataacaagtctttggattaagtttcctatattaatgattacagtttaaatgacattttaatgtatattatgtaatctttattaatttactagtatgagcaactagagcatacatcaaacgtcttctaaatcttagataaaagtgtgataggtgatatattttgctttaaatacttagatatttctccccttttctttcttttttcttaaggtaatgctgcaagattgcaaaggcaggtattgggaaagcataatgtttaagttgttttgtggggttcttctcttccttaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtggtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggcatttctggagaatgtgtgtatatacatgtttgcgcgtacaggggaggggagggtatgataaatgtgggaaactggaaatatattgacttttatgtttataatctttgtagcatttagaatgcccctaagaaatctccattgacaaatgaaatgctatagacttggttttccagttatccatattcattttgtctgtcatatgctttgtatcatctccttctttcctaattttttataaccttatatatatatttattataaatatatgtatttctgagggaaagagtcagatggccttattttctgtaacaaaagtaatatgtaggatcttaaagataacctctttccagttggcccagctgaaaaagaaaagcttcatttatggacagacaggaaaatgtttgtaatgttgacagtagtttctaggttctttaattgccagaatagaaatagtagaaaaataactataaactcctatattgacacttgtgtttgtgagagctctttgaaaaattgagcacccaaaaatttcagatcaaggttctagcaaaaagaggtagtaaggatttaaaatgggcaagtagctttttttttccttgagaaagagttgtcgcccaggctgtagtgcactggtgcagtctcggctctctgtggcctctgcctcccaggttcaagcagcctcattcctcagcctcccaagcagctgggactacagggcataccaccacactcatctaattttttgtatttttagtagagaggggattttgccatgttggcctcaactcatgttgtcttgaactcctggcctcaagtgatcctcccaccttggcctcccaaagtgctgggactacaggcgtgagtcaccatggctagcctaaaatgggcaagtagctttgactgaggaagtggaaatggtctttgaccttttggttgggaagagcagaaatgagagaaatggatagaggtatttaaatgtccagactttaggttttgtttacttgcattattttctaaggccttgagcttggtatgttggagcagaaatgtaggactctagagaattctttcatatttattgctcactgacccaagtgaagctgatgggaaatgccagtggtttgttattagcaccaaagaccctacattttactttgcatggggaaactacttgtgccgtttgagtatactggaaatagcagtcttctcatctctgtgtcaagatgactgcataccatcacctcaccccttaaagaggttgattgcaaaacttcagcttctttttttcttgggggagagaggcctgtttctttaggtatttaggaagatgtgtatttttctttaatggtcacatttgttccattaccttttatataatatcgtcagtcccctgtttccagttggttcttaagcctcgcttttgctcttaaaaaaagcaagtaaatctaagcaaccagaaaacataaaggtaactaaattttcatgtgatcttctctcctgtaccttttaggttagagaaaatgttggttggcagataaaccttagtcacagagatgaattaaggtagttgcagagtattttgttctgtggttagaacattagtttcaaaatcctggtctgggatccaatttccagctggctgcatcaatgccctggtaagcttgacttagattccacagatttggcatggggctcaggcatatttatattttaatgcttctccccaggtggttgaaatgtgcaatcaggtttcaaaactatgttgaaagacctcaggcctttggcactcaggtagagatacgtgtaggtttttacctcagcctttttttttttttttgtaaacttttttttttttaaattattattgtactttaagttttagggtacatgtgcacagtgtgcaggttagttacatatgtatacatgtgccatgctgctgtgctgcacccattaactcgtcatttagcattaggtatatctcctaaagctatccctcccccctccccccaccccacaacagtccccagagtgtacctcagccttataactgaagtgtaacttgtgttcagtaacatcaaggcaggctaattggcttgctcagaaacttagcattgttcactaagtgaatttaagttaatgactttttttttttttctgaggcaaagttttcctatgttcctcaggctggttgaactcttgggaccaagcaatccttcccacctcaacctcccaagtaactgggactgcaggtgcatgccatcatgccagctaatttatttatttattgttttagagacaggatcttgctgtgttgcccaggctggtctcagattcttggccaaatgagtatcctgccttggcctcccaatgtgctgggattataggccaggagccacagcgccctgcctaaataagttttaaacttttttaaaggaaaaaagtgattattttttgtggagatggggcctcagtatgttgcccatgctggtctcgaacttctaggctcaagtgatccgcctcagcctcccaaagtgctggaattacaggtataagccaccacgtccagccaaaaacattctttacagttagaaaactagttctttttgagacaggcaataatagtagttatattggatcaaactgtttgcctgagaggacagtatgaattatttaaatatctgtttgaccttggacttgtcattcactctgttgaatgagggtgtcttgatatatcttacttttcctactgaattaagcaatgctgtatcgttaggtattggcagccttgtttcaatgaggaacagtcttttgagagatctcaagtcattgaaggtttcagttgtgaaacgttaccctccatatatttagacaatcattttacagatataatctgtgtagttagtatttgtaatgggccatgccattatttggaaataaatatgatgctgccttcaagagattatactgtaggaaagggagagttaaaatggtgtcctcgttggctgcttcttcctatacgtgccgttcttttccatcgacctcccagtaggctttctcttccctttcctcagttacttctgagccatctttttttttttttttttaagtacaccttttttttcaggactggcctaaaaagggtacctgatctgccaagatatccaggaaaataagtacacagacagctttggggagtatgttgcagttacttagatatacttcaacaaaatttacatatagggcattctaggcacttaaccatagtttcatagtaattcccttcccccttgtccacttattagatgatatcttacaggtttgaagtctgtttgtgtgaatagaataaataaaaccttgatccttagcattcttcgtaaacatatgacgagtcccttaggtctctaatctggttatttaacgaaatcctctcatgttatctgaaacagtgttcaaggtaagcatctcttgctattagcagtgttcctttgttgagtagtatagtaaattggaaccactctccccctccccattttttctttcctcccactcactctccttatctttttatagtttactgctttctctaccatgtgtcaagcactgcattaggtaatagaaataacgaaataaataagtgttgaacttagtgatgtgctagacacagaaaacagccataaaccattttatcaagccttcacgacctggcctattttatttatttttctttttgagatgggagtttaactctcacccaggctggagtgcagtggcacaatcttggctcactgcagcctccacctctcaggttcaagcaattttcctgcctcagcctcctaagtaactgggagtacaggcacacgccaccacacctggctaatttttgtatttttagtagagacagggtttcttcatgttgaccaggctggtctcgaactcctgacctcaggtgatccactcacctcagtctcccaaagtgctgggattatgggtgtgagccaccatgaccagccactgttcttaaaatttaagtgggagccctgggtgtcattaccagggctttttcctccttcaggatttttttttttttttttttttttttttttttttttttgaaacaaaatctcattttgttgcccatgctggaatgcaagggcccaatcttgggtcactacaacctccattgcctccccagtaactgggatataaggcaatgtgcctgtaatcccaggcacatgccactacattgggtaatttttatatttttagtaaaaacagtttcaccaccatgttggccagactagtcttgaactcctgacctcaagtgatctgcccacctcggcctcccaaagtgctgagattacaagcttgagccatcaaacccagtctagaattttttttggtttgaaaatatttcaaatattggcttagtcatttgctaacattttaggatataggtaattgaatttgtactgtaccaattaatttacagtgtgtttcagctttgagtgtttacccttttaaatcatagactgttagtcatagttgtctttaaaactgcttaataaatgtaaatataactcttgacatttttaaacataaagggattcttcccagattaaaattgttcctaatattattactttgttttttggaagagtagatagtgctcgtatcttacgtggtactgcacaagtagagaccagctaaccttaggattcagtaacccaaaagttaaattccagacccaagattgtgttgactagaaatttatttctaaatgtttttaagaaaaagcaaagttactggagactttgatatttgtaccttttgttctttttttccaatgtcttctggcagtgttaggaaaaggtgaccctgtgtaaatcagaaaattgtagttgctagctagatcaagtaaagcataatctttgtctctgaagaccaccatttgtttcaccatgggtgctggtttaggtcccagacaccaggtcgtaatattagaatgggatgactacatgaatccttatttggatcaaagtactggtttatcttggggtaattgattttaaatcactctagcaaatctgctaccttacctcaccatagaatgggctgaatctaataattgttgtatcatattctgaataaagtaaatctgatttagaatctatttctgtttggtataatttaatgctgctttcctgatctttctgctgtctacagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacaggtgaagttctaacccaccttttttgtaacagaaagccaaactaatattttatctccattgcataggatcaggtctcttccttggttattaagatcattgagtgctcactgtaatggggaaaaaaaatacaagaatatggccaatgtctgggcctcattctcttattcaaggagataaggctatattgagaactagtagatagggtttctggttttaactgcattagaatccagagtcctagttccaatcccaattttgttgtgttttgtttttgaggcagagtttctttgctctgtcgcccaggctggagtggagtggtgtgatcttggttcactgcaacctccacctcctgggttcaagtgattcccctgccccaacctcctgtgtaggtgagattacaggcgtgtaccaccaccacacctggctacttttttttttttttttttttgtatttttagtagagaaaggggtttctccatgttggtcagtctggtctcgaactcctgacctcaggtgatctgcccgcgttggccttccagagtgctaggattataggcatgagccactgagcccggccccaatcccaattttgtaactttattactttgtgcaagtcatataatagctgtgagtactgatttttctctataaaatattactttgtctacatcacagggtacttttaagactctgtatgtgctccacaaaatttaaaaattttagtacctagtagcacaggtttctttaagctatgtctttacttccctttatcccagtgccttttggtgtgttatgtgtttaacctttggcttatgtttgactttaaaattattttatcagcaaacatagcaactgctgtgtgccaggctctggtgagacgctatagatacaaagaagagaagtattatatgaattctgcctttcaggcacacacagtgtaatggggtccatccatcacacaaatatactagctctgtacacagccttgaggaggaacaatatttttggttgttgtaaactgcatttttttttggtatggccttttgattctgggaagcacattcattctatagatattgcctttttagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactaggtacagtataaaagatgctattttacaagaaagctgtacagtcatcaagtcctgcttttcacttttcttcttctaacccaagtggacttctctagcaagtatctgccaaacaactatacctgtgacataagggtgctaagagaaattgtacttataagtattcattaagagtagccaggttttttgtttttagagacagggtctctctctgttgcacagactggagtgcagttatgcagtcgcacttactacagccttgaactcttgggctcaagcagtcctcctgtctcagcctcctgagtagctaggactatgggcatatacccactactcaactaattatttttttaaatgtttatagagatggatcttgctatcttgccccaggctggtcttgaacttctggcctcaactgatcatcctgcctcagcttcccaaagtgctgagattacaggtatgcgtcattgcacctggcaggagtggccggtttttaagaactagaattacctctgtttgtgcagatgcagaagtgtatggagaaaaaaagcatttgtgctttgtttaggttcatgtttttgtttgcttatgaatgtggattagatagtaagctctgacttcccaatttttataacattacttagttcagcaagttgtcctgcactatacttgttttgtgcagtccttacagcactgtcttattgtcttctagggacaagtattgcttctcgtaatgcacagagcacatcagatttctacttttcactaaacctttttaaattcccagggaagtgattacatatttgattttaaagttttctcttttctagtgggcttgtaactatgtgggattggaaataaagttttaatatcagcaaagaacttaagcagatgtagtttcaacatattttgaaagccagaggaactggcagagagacatttgtttatattgctttaaaaactaaatatttttcaattcttttgagttcccttattatcaactttgctttttaaaaatatttttaacttccctttggtatagaggaaagaaagaaaatatattaaccaaaaaagtatcagttaaacattcttaataaccttttccgtaatggatactacatgaaaatctggtacttcaataatatttaactccatgctttagacaaaagccacgtaaaattgggaaacaggcactggtaataagaactgtccttcagccgggcacagtggctcatgcctataatcatagcactttaggagactgaggaaggaggatggcttgaggctaggatttggagagcagcctgggcaacatagcaagactccatccctataatagctagctagctagataaaaatttaaatgttaaaaaaatttttttttaaagaactgtccttcagaaggtcacatgtacaattgtaagatacctagtgtgtttttatttcgttgactgtagcattgtttagagtagagtaggaatttgagttttgatcttacttttatatgtgctaagaaatcgttacctttaggattctgataagggcatgaggagtggtgccagacttaaccttggcttgtctcctggtcctgtcactttgtagatttggacaagtcacttatctgagctcagttttctcatatatacaataggaatgataataatgctaatcatttaaaagtttttgaggccaagtgcagtggctcatgcctgtaattgcagcactctaggaggctgaggcaggtggatcacgaggtcaggagttcaagaccagcctggccaacatggtgaaactctgtctctactaaaaatacagaaaagttagccaggcatggtggcgggcacctgtaatcccagctactcgggaggctgaggcagagaattgcttgaacccaggaggcagaggttgcagtgagccaagatcatgccactgcactctagcctgggctacagggcgagactctgtctccaaaaaaaaaaaaaaaaagtttttgaagagtgaaatgaaataacatatacaaatgacttatacagagcctgctgcatatttttaaataatattaatagtgttgttgcttttattattgttgtagatatcatcatcatcattagaatcttgtcctgatttcctagttcaaagagtaatttctgcaaaatctgacttagcctgcttctggtcatccacatctgatataagtagtttgattaaacattgaatgatttcagccttactgatttttgttattgttcaagaaacaatagcttgtgttttgtaatagtctttctccccttcattcccgcttcatttcagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccgtgagtcacatttcttgatgctttttgagaaaggcaacatgataggtgaaaaaaactaatcaggaggatagggccctgctttgtcatctttctagagagagagagagagagagagagagagagagtgtgtgtgtgtgtgtgtgtgtgtgtgtgtgtgtgtctcagttttgctctgtttcccaggtgtgtgtgtgtgtgtttttgagtctcagttttgctctgtttcccaggctggggtgcggtggcacgatctcagcttgctgcaacctctgcctctcagtctgaggctcttctcctgcctcagcctcctgataagctgggattacatgcacacgccaccacacccagctaatgtttcctgagctcaagtgattgtcctaccttggcctcccaaagtgctgggattacagtcatgagccaccttgcccagcctatccttcatttttaaagttgactttgaaaaaataaaaaacaacctgtaatcccagcactttgggaggccaagatgggcggatcacgaggtcaggagattgagaccatcctggctaacacggtgaaactctgtctctactaaaaatacaaaaaaaattagctgggcgttgtggcaggcgcctgtagacccagctagtcaggaggctgaggcaggagaatggtgtgaacccgggaggcggagcttgcagtgagctgagatcgcgccattgcactctagcctgggcaactgaatgagactcagtctcaaaaaaaaaaaagagagaaaagaaaaagaaaaaacaacaatgtctcttgaacctcacaattaagaatactgatcctaaacttagttattctaggttaagcattatcttgtgaattttgaaggttattaatatcaatcttaaaaattagatcaaggggccgggtacggtggctcacacctgtcatcccagcactttgggaggatcacttgaggtcaggagttcgagaccagcctggccaacatggtaaaaccctgtctctactaaaattacaaaaattagcccagggtggtggtgcatgtttgtaatcccagctactcaggagactgaggcaggagaatcgcccttgaacccaggaggcagaggttgcagtaagccaagatcacgctactgcattccaacctcagcgacagtgtgaaactccatctcaaaaaaaaaaaaaaaaaaaattggaacaagcctagcttagctatatgctcattgtaatttagaatcagttctttagtatctagaagcttagcctcatgacttttgatacccaagtataatttgagaaacaggtatcccacaatagcttttggcccttgagttttagccagttctaaatctgttaggattctcatgcttgttataacctggcctaagaagcctttgtgttctgaatgcactgatcagatgattttttttccccagtatatagcagataagttcagtatagtttaagaaacaaaatttctttaaaactacagtgaaatgtttgcattccgtttgtaatcataaaaagaaacagtggtttggttgaagtaaaaatcctagcttctgtcttaggttcattttctattctattcctcatttgctcttgtagcctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaagtgagtacacactatgtttctaatgtttgatgtcccaataatagtggtggtagcgtatgttcacgggaggatgaatttcctggcaccagtctagtaggtaaatgcctgtgcttgtcattttctgaggttgagtttaactaagcagattcccaagcaagaagaaattgtcactatgttcttgtcactttgttcttttacccattaatgtacaaattcttccacaaagaactgtagcaagtcaaatccttggatttataaaattgaatttcttacctaatccagagaacatagggagagaaatacattccttcttgctttacttttttttttttttttttttttgagacggagtctcactctgtcactgtagccgggagtataggcgcgcgccaccacacccagctaatttttgtattcttagtagagacagggtttcaccatattggccaggattgtctcgatctcttgacctcgtgatctgcctgcctcgactttccaaagtgctgggattacaggcgtgagccatcgagcccggccccttcttgcttttctaaatcctatccattcttccatatccagctcaagtactgttggtcttctcaacagctttgttgtaattcctcttcctggcttctttcaagattacctttctcatctatcatgaccatgtttttctgaatcaatactttgataaaggggttatctaatttattaatatttcaaacagtagaaaaatcattttgtttagcaaatcacgtttattgaaaaatgggctgttttagaatgtcctatgccacacgttttgagatttgtttatgttccttcagttctttgtatttacttaatcgtctcattgtcttttcaaatgtgtaagttattttaccagtgcatacttgtaagtggcttaaatgataaacagtacttttgtagattgatttttatagacagaatttgatcaaagtagatatcatctgagatgacactagccataattaggcttggggaacctgtttaacggttacatttgttatgtaagtaccacagaaacatgatatgagcaagcatttatttatactatgtacttctggaaattgtaagacgaagttgagtgaggtagagacagattcagggtaatcagcttgagtggttgtttgagatgtctattaatttatgtatttttaacatcacagttagaaggatgccctctgtgaagttgttgtaagactttgtctcgtaacattgtttttctcttcctgccttagttgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggtggggaaggcatatggtccttctctgcgcctctgtcgccttcctactcactgcctcctaccgctccccgctaattgtgcatttccctttggcttctagcctatgagtattaattgcggacttcccagaaagattgctggttcccgtggaatatgtaatataacataaaatttaaattttaatcacagctgtactaacacgatcaagcacagataagctgagaaccaaaatcagccctatcccgtggctactactcaccgccaacatcttaatgtgcaacatgtactgaatgtctctacttagtgatacatacagatatgtccacgacactgtgacatatgcttgtgaaccattcaaaggtgatatcccgctgtgtactctattctgttcttctcaagtggcacattaccaatgccctgtaatacagataattatcagatacttcttagcatacttcgatgtataaatgtcccatagtagtacatttcttccctcacacagagacttgtttaaaaactatannnnnnnnnnnnnnnnnnnnttttttttttttttttttttttgagacagtttcactcttgttgcccaggctggagtacaatggtgcgatctcggctcactgcaacctcctcctcctgggttcaagcgattctcttgcctcagcctcccaagtagctgagattacaggtgcctgctaccacacctggctaatttttgtattttagtagagacagggtttcaccatgttggtcaggctggtctcgaactcctgacctcaggtgatccacccaccttggcctcccaaagtgctggaattacaggtgtgagccactgcacccagccgaactatgtcttctaattctttttttaggaccttaaacattgtttacttgattaaaatttaaattttatattacatttgtaataaaactagaaagcatagataagctatcaatcaaaatcacccaaatcctgtgactactactcactgcaaacattttaatgtgcaatttgtacttaattctttactttgtaatacatacaaatatgtccagacactgtgacatatgcttgtgaacttttcaaaggtgatatcctgctgtgtattatattctgttcttttcatgtggcacattacaaatgccctgtaatacagataattatcaaatacttcttagcattcttttatgtataaatgtaccatagtagtaaatttcttccttcacattgagactttttttaaaactataaacagtactctgaattgctataaaatatgttctatatcaattcattcaaataaatatatagaagttgaatttctgggttgaggtactcactggctttttaaaaggaatttatatgcatatatttacttctttaagttccctttcactaatgaggcaattcagcaagtacttaatgactgcctagatataaatctttttttttttttaagacagagtctgtctgtgtgtttaccagactgctggagtgcagtggaacgatctcagctcactgcaacctttacttcctgggttcaagcgattctcctgcctcagcctcctgagtagctgggattacaggtgcctgccaccatgcccagctagttgtctttttttttatttttagtagagacagggtttcgccatgttggccagggtggtctcaaactcgtgacttccagtgatccacccactttggcctcccaagtgctgggattacaggcatgagccaccgtgcctggccataaagtcttgataagaatacaggatggcatagttcagcttaatctaatatgatcagatccttattcaaaccttgattgttggaacctaatttatccaaagccaactaattggagccatcgactggatttattttgaagagttttgccacttttgggattataaggaacaaatcacaggaaaagccagaatcagtaagctatataaagggcttgttgcattccactgtcactacacatttagcctggtagcttcctgttttcttttctttttattttttaaatagagatggggtctgtatgttgaccaggctggtctcaaactcctggcgtcaagcagccctcctgcctcagcctcccaaagtgctgggattagaggcgtgagccaccacatccagcctccgtctggtactatttatggtctttgtgcatttgtacagtgagaatttatctttgggattgatcttgtatgaacttattatgaatcattaaaaaaaggttatgctcaccaggacaccaacatgtagtaggagaggatcttaaggcatgccagagtcagattcttagggctgttgattcataaactccactttcttcctgtttattttgactgtaaggctaaacctctggtaaaggtactgccttttaggttactaaaagcttttgctttactactccccccctttttttttgttttttgttttgtttttgtttttgttttcgagacagtctcgctctgtaccccaggatggagtgcagtggcataatcttggctcactacaacgtttgcctcctgggttcaagcgattctcctgcctcagcctcctgagtagctgggattacaggtaacgtgccaccacactcggctaacttttgtatatttagtagagatgccgtttcgtcatgttggccaggctggtctggaactcctgacctcaggtgatgcgcctgcctcagccttccaaagtgctgggattacaggcgtgaaccactgcctccggcctttttttttccctcccccctgcaccaagacagagtcttggtctgtcacccaggctggagtgcagtagtgcaatctctgtttactgcaacttctgccttctgggttcaagtggttctcgtgtctcagcctcttgagtagctgggactccagtcacgtgccaccacgccaggctaatttttgtatttttagtagagacaaagtttcatcatgttggcgaggttggtctcgaactcctgaccccaagtgatttgcccgccttggcttcccagagcactgggattacaggtgtgagccaccgtgcccagtgttttcctccatttttcctttttatgtttaagatagagtctcgctcttgttgcccaggctggagtgcaatggtgcgatcttggctcactgcaacctccaactcatgggttcaagtgattttcctgccttagccttccaagtagctggaattacaggtgtgcaccagcacgcccggtgatttttgtatttttagtagggacggggtttcaccatgttggtcaggctggtctcgaactcgtgacttcaagtaatccacctcccttggcctgccagagtgctgggattacaggcattagccaccatgccgggctgttttcctccattttgtagttgaggtgtcttgcctagtatcacagaagtagtggtagatctgttgttgatgtctatatgctattcagtctataggtaatttaggttaaactactttgcaaattttctatccaagcagaaaatggtaagtttttgatcaatattttggcactactgcagaaagcagttaacaatgttaaatcctcccttctgaaggctggaagaaatgaagataatgcccccaagtgtttgacgaagtccataaacccttagtaataaccaaaaaacttccatttctcttataggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtatcttctacttttaccataatatctcacattggttttttcataaattgaagctggtttgaggttgaggcaaggagtgatctttgtaaattgtgcacagttacacaaaatgttttacacattggacaattttcaaattataaaggcaggcatgcacacttttaaaaatctagttgtatagaaattaaaatgttaaaatgtatcatatcccatatcatatagtggtaaacaatataaataattttatcttcacagaaatattctagtttagttaattaatttttttgagatagggtctggctctgttgcctaggcaggagtacagtggggtgatcttggctcactgcatcctccatctcctaagttcaagtgatcctctcacctgagcctcccaagtagctgggactacaggcacacgctaccatacacagctagtttttaagtctacatccacatatatgttgttcctatttacatgtttgtatatacaaatgaaataaattatacataggagttctgtgattttttttatttatattttgttcatttaaaaaagaatttatagcaatagggtctcagtatgttgcctaggcttgtcttgaactcctggcctaaagggatcctgtcacctataggtctcccaaagtgttgagattacaggcatgagccactgcatcagccctgcagcatttttttttttttttctcttgagacagagtctcgctctgttgcccaggttggagtgcagtggcacgatctgggcttactgcaagctccgcctcccaagttcacctcattcttctgcctcagcctcctgagtagctgagactacaggcacctgccaccacgctgggctaattttttgtattttaagtagagacggggtttcaccatgttagccaggatggtctcggtctcctgacctcatgatctgcctgcctcggcctcctgaagtgctgggattacaagcgtgagccaccgcgcccggccccctgcagcttttttttttttaaacctactgtatgtgaatattttttcatgtcatgaagcgttatttttgttgttgttgttgttttttgagatagagtttcgctcttattgtccaggctggagtgagtggcacaatcttggctcactgcaacctctgtgtcccaggatcaggcgattctcctgcctcagcctcccaagtagctgggattacaggcgcctgccaccacgcctggctaatttttgtatttttagtagagacgggtttccccatgttggccaggccagtcccaaactcccgacctcaggtgatccacccacctcggcctcccaaagtgctggtattacaggcatgatccactgcacccggcctttttttttttttgtatttttaatagaaacggggtttcaccatgttggccaggctggtctggaactcctgacctcaggtaatccgaccacctcggcctcccaaagtgctgggattacaggtgtgagccacagtgcctggctggcattattcttttttatagccacttatgttccattttatggctgttgggttataattattttaagccatttctcttatcactgcctacctcttatattattatcttaaagtattttcagaaataaaaatgtagctggtcagaacttatgctcattttaaagctttatacattgacaaccatagacagtgagaagatctctctgctctcaatggctctcatctcatttgagtactgattgattgattaaatcctgggaccaggcacagtgtctgattcctgtaatcacaatgctttgggaggctgaggagggaggattgcttgacaccaggaattcaagaccagcctgggccacacagtgcaactctgtatcaatcgatcaatcagttggtcaataaaaacaagtaaataatattccctctcactagctgtgagattttattatatttgtatattttatatctgaatcatttaaaatgttccttgaataagtgaatattcacttcagtgttattgcacacacaggtaataacaaggtagaatatagccatggtgatgattttgtttcgcacaggtgtggcagctctcagaaaagaagcaaataaacgtgtgctcccagttggattggaaacgctccctggctatccatctttggtatttgcttccaccaacagcctccatttctagggcactcagcatgtatgaagaagcatttcaggtatatgtggccaatagagccaagcaaaaatcttgctgggtgttaaagtattgtcaaattgaagcggagccaggaaatctgatgggaaactatcctttactccttcctctggacaaggctacttccccaagtgtctgtttttattttatttaatatcatgagattccacagttgactttctcactgctgttttcctgcctctaaatcagagggttcttcttcatttctaatgctgtcttacttctttgggaattccctgttatacagcctgacctcagatttggtttatcttcaaacttagttctgaaatttgcctctaaatataatattttatattccttgtcagttttgaggttaatgtattgttacttttatgccatcagttcttgaattatcttactgttcatattttatacttgtctttcatattgttctctcagaattatttgtcaggagtaagagaacacttgaaacttgagtatattaagaattgtggcaagataagtatggggggttagtgatagctacctgaaatctttaccagtccattgaagacagatgaaatacatcattgaccaaaaaatgtttaaaatccctgatagatcctttgggttgtctgtttactttttttttttttgagatggagtctcgctgtgtagcccaggctggagtgcagtagcgcgatctcggctcactgcaacctctgcctcccgggtagctgggactacaggcatgtgccactacgcctggctaattttttgtatttttagtagagacgcggtttcaccatgttagccaggatggtctcgatctcctgacctcatgatctgcctgcctcggcctccctaagtgctaggattacaggcatgagccaccgtgcccaggtgtttttttttgttttttttttttcaatcgagatcaggtctcagtctgtcacccaaaacttgagtggcatgcagtggggcaattatagctcactgcagccttgacctcctgggccccagcctcctgagtagctgggaccacaggtgcataccaccatgcctggctaatttaaaaaaaaaatttttttttcttatctttttatgtcagacgggtaatatgccaatatcttcacaaggttcgagggtggcacatctcacacgcatgcatgaacacccaatcatcatgctcatgaactacaaactatataattttatttttttatttgtagagatgggatcttgctttgttgccctggcaggtcttgaactacttggctcaagcagtcctcctcccactttcaaagtgctgggattataggctcaagccactgcacatggctgtctattcattcttaatacaggtgtcttaagaatttgaaacataatggcatctaggccgggtgcggtcattcacacctctaatcccagcactttgggaggctaaggcaggcgtatcacctgatgtcaggagttcaagaccagcctggccaacatggcaaaacactgtcactactaaaaatacaaaaattagccgggtgtggtggtgtgcagctgtaatcccagctacttgggaggctgaggcaggagaattgtttgaatctgggaagcggaggttgcagtgagccgagattgtcccactgcactccagcctgggtgacagagtgagactgcctctcaaaaaaaaaaagaagaaacataatggcatctagtaaaactgattaggagctaatgtattgttttatcaaattattccttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacaggtaaatgagagccaggctttattgtcacttgagtgctccatgagccccaggggagtcctttgctgcgtcctttcccttttatatgtccccagattgctgtaagtccatataaactaccaaatataacttaaagtagttgaatggaaagagcattagaactagaattagaagtctaaaaattattttaatcaactttaatgagtatagtttacatataataaagtatgcagtgtgataagttttatagtaactatcgcattgtaactaccattacagctaagctgatatttccactaccattgaaaaatgcctgtgtgcccctttgcaatcagtcagatacctattgactagttttttgttactataagttagttttgctggtctagaattttatgtggagatcatactgtatgttccttgtgcctagcttttttgattctgcataataattgtgagattttttttcatgtttatatgtatcaaaagttagttttgggttttttttagcgggggtacatgatttatgtatctattcatttgttgatggacagttaggttttcttatttttggccattattgataaatctgctatgaacatatccagaagtgattatatcatttttatattcccaccaataatgtgtaatatctctagttgctccaaatcctctttaaaatttggtattattagttgtttaaattttaccattttattgggcatgtagtatcttggtttgtgtgtgtatatgtgaatctgtgtgtacatgtttattaaaaaatgcaggcggccgggtgcggtggctcacgcctgtaatcccagcatttttggaggccaaggtgtgcggatcacgaggtcaggagatcgagaccatcctggctaacacagtgaaaccctgtctctactaaaaatacaaaaaaattatctggacgtggtggcgggcgcccgtagtcccagctactcaggaggctgaggcaggggaatggcgtgaacccgggaggcagagcttgcagtgagcagagatcatgccactgcactccagcctgggcgacacagcaagactctgtctcaaaaataaaaaaaaaaaatgcagacagccaggcgcggtggctcacacctgtaatcccagcactttgggaggctgaggtgggtggatcacttgatgtcagggagtttgagaccagcctggccaacatggtgaaaccccatttttactaaaaatacgaaaattagctgggtgttgtggtaggcacctgtaatttcagttacctaggaaactgaggcaggagaatcacttgaacctgggagttggaggttgcagtgagccaagattgtgccactgcagtccagcctgggtgatgaaacaagactttttgtttcaaaaaaaaaaaaaaaaaaaaaaaaaaatgcaggccagccatggtggctcacacctgtaatcccaacactttggaaggccaaggccagcagatcacttgagcccaggagttcgaggccagcctgggcaatatggcaaaaccctgtttctactaaaagtaaaaaaaaattagccatgtgtggtagtgtgtagtcccagctactcaggaggctgagggtggaggatcacctgagcctgggaagtcgagcctgcagtgagacatgattgcatcactgtactccagcctgggcaataggagtgagagagaccctgtctccaaaaaagaaagaaatgcagagtggtttaggtgtccaacaataatatattaacacatgctattatttctaaccatgtaattagaactatctcagtgttggtgttttgttttttggttttttttttgagacagactctctcgctcagttgcccaggctggagtgcagtggtgcaatctcagctcactgcaagctctgccttccaggttcacgccattctcctgcctcagcctcccaagtagctgggactagaggcacccaccaccacgcccagctaatttttttgtatttttagtagagacagggtttcaccgtgttagccaagatggtctcgatctcctgacctcgtgatctgcccacctcagcctcccaaagtgctgggattacaggcgcgagccactgcacctagccttgttttgtttttagacagggttttgctctgtcacccgggctggtgtgcagtggaatgatcatggctcattgcagtctcaaccacccgggttcaggcgatcctttcacctcagcctcctgagtagctgagcgctgcaggagtgcaccaccatactcagctaattcttgtattttttgtagacaagattttgccacattgcccaggctgttctcaagctcctgagctcaagtgatccacttgcgctggcctcctaaagtactgggattacaggtgtcagccactgcacgcagcagagaagtcttcttacattaccttagaaatacttacagtttttgttttttttttctctagtcacacaaatagctcatctcatttcaaatcttcaaggtgatttcttataaatatatatatatatatatatatgtatatttaaatacatatatatattttcgagacagtctctctctgtcgcccagtctagagtgcagtggcgtgatcttgcctcactgcaacctctgccttccaggttcaagcgattctcctgcctcagcctcctgagtagctggggttacaggcatgcgccacaaagcccagctaatttttgtatttttagtagaaatggggttttgccacgttggccaggctggtctcgaactcctgacctcaagtaatcctcctgcctcggcctcccaaagtgctgggaattataggtgtgagccactgtgcctggccagtatttaactatattaattatatagaatgtagctttttattgtagtaaaatgtaactaaaatttactggtttttatttatttattttattattattattattttttgagatggagtctcgctctgtcgcccaggctggagtgcagtggcgcgaactaggctcactgcaagctctgcctcctgggttcacaccattctcctgcctcagcttcccgagtagctgggactacaggcacccaccaccacgcccggctaatttttagtagagacggggtttcaccatggtttcaccatgttagccaggatggtctggatctcctgacctcgtgatccgctcacctcagcctcccagagtgctgggattacaggcgtgagccaccgtgcccggccaaatttactgttttaaccattttaagcatactgttcagtggcattaagtccattcacattgctatacaatcatcaccaccctctccagaactttttcatcttcccatactggaaattctcattgtttcatttgcatttccctaatgtctaatgatgttgagcactttgtcatgtgcttatttaccatctgtacatctttgctaaaatgtctattacaggcatgagtcactgcacccagccttgttttgttagccaagatagtctcgatctcctgacctcgtgatccacccgccttggcttcccaaagtgctgggattacaggcgtgagccaccgcacccggcctaaagtcacaaaatttattagcatcaagttattaataacatttccttattaaccattttaaatatctgtaggatctttaacaacgtctctttctttttgatactggtcatttgtgttcaataattgcgtcctctttttttcttggttggtgtacctagagtttagcaatcatattgaccttttcaaagaaccaccttctggcctcattagttgtgtctattgtttatccagctcataatggattacaaacctaaatttcaacttaactataaaccttctagaagaaaacaaagcagaaaatttttgcaactgtaggttaggcagaagatttcttaggtggacactaaataacacaattcataagagaaaaaaattggtaaattggacttcaacaaaatttcaaaactactgctcatagaaagactgttaagagaatgaaaaggtaaaccatagattgggagaaaatacttgcaattcgtagatctgatagagaacttgtatccaggaatacatcaagaactctgaaaattcagtaataagaaaacaggccaggtatggtgcgtcatgcctataatcccagcagtttgtgacgctgaagtgggacgatcacttgaacccaggagctcaagaccaacctgggcaatataatgagaccccatctctacaaaaataaatttcttaaattgggtgggcatggtggcatgcatctgtagtcccagctacttaggaggctgaagtgagaggatcgcatgagcccaggaggttgaggttacaattgagtcatcattattattattattttgagttggagtctcaccctgtcagagtgcagtggtatgatctcacctcaccacaacctccgcctcctgggttccagcagttcttgtgccacagcctcctgagtagccgggaatacaggcatgcactaccacacctggctaatttttgtatttttagtagaggcaagagtttcaccatcttggccaggctggtctcaaactctcctgacctcaagtgatccgcccacctcagccttccaatgtgttgggattacaggcgtgagccaccgcgccttgctctatttattttcttgatcgtgatggtggttttacaggtgtctacatatgttaaagctcattaaaattgtgtactctagatacgtgcagttttaaatatgtcagagaaagaaagaaaaggatacttcaaaataccagaaatgggcaacagagcgagactctgtctcaaaaaaaagaaaaaagtaatgacattataatgaaggaatggaagggtgagaactgtgaagactccctgtatcaggatggtaaaatacatacgccaaaccattaccagcaaacctgttagatcacacaaccttagaagagaaggtgccttgtttctttgtaggatctaaagtctggctgaacccagagatagattgataaaacataggctcagagggagagaaggcctataatgctttcactctcaggttcttttattgtcttagacataagcagaacagttgacatatcagtccaggccgtctcctggctgtgtatgttgactctcaacacgttctttgcagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcagggtgagtgagaagccgttgaacccactgggtacatctagcactacagggcaattccaaaggaatcagtctttcagggttcagtttagcaagtaattgtgtagaatgtgtgttagatccagcgttgtgataaacctcaagatagttaaacccttagcctagactgtttctgtattcatgtaaaccagttaaaactgagacttcctttgattaagtgccaaattataatatttatcacaaagtctctcagcagtctgagaaaaaaagatctctgtgaactgcattgatcagagaaattcttcatagaggtaagagtcgaagaacctgtaaaattggaataggaaataatgaagtggaaatgagagaatatgcccagatgggacaatagcattatgcctgggccaaaaaactagtcatttaatttcagatcagaactattctcctcatagtgggctcttttctgaatcccagattcaggtgaatgtggcatgtttaggaattacacagaaatagtgctgtctgagctgcctcagtgactccacggcagggaagtaatgggttagcaaaaaggtccctgctttttctgtgtccactggcttgctttttctctggtcatcccttgtcaccgacccattccttaagcttgatagtattgtatttattaacacagccttgtgcttaggtatatgtgtcttgattctctgtccttaaagagaactggagaaatgccttttcactgcggtttgaacaagataaggccggagatttttgttaatgatagcagtatggtatttcagtaattacacaaaatgaacatttatgtagtacttgaagtgcttttacacatgtttatattgtataccatatatattaactgttttatgttcattatgacctgtgagatagacactgttattatctctgttttacaggtcagtaacccaagacacagagcttaacttttgtccaaggtcacacagctagtaaatggcagagtgaggtttccaactttcgtccagagtctgtgctcttatcattatgctgcactgttgtgttgcatggtatggaaggaaatagggtctaaattctagatctaccacgtactcactttgacctagggtaaagcttacttttgactttggataaagatactctcttaactctctaagcctaagccttttttttttttttttttttttttttttttttggcctgtgaaagcataacattagtttctatttaaaggtgattgtgaaattaaaaagagtaaaagtataaagcatctagcatagtcttattaagacttaagcaatttctctttctttaagcagtttctctttcttcttcccctttaacagggaatgaaatgaccccaggctatttttttaagtttatttaaacacagtcataaaggatttcacatggtaaaagactggcttgataggatggctaatgtttcggagttgactatggagaagcagatcttgtttcctgaaaaagaatataaaaaaggaggcagttgtgatgacagtggaagtcattgaaaagcttaggaattcagaaaagagtccataatgagaatagttttgatctgaaagtaaatgacttgacctcgtgatctgtccgcctcggcctgccaaagtgctgggattacaggcgtgagccactgcgccgagccaagccccaactttttgaacatgaaaatactttattttatttttaaaaattaatgctatgtgtttgttttgttttgttttgtttttgagatggagtttcggtcttgtcgcccaggctggagtgcaatggcgtgatctcggctcactgcaatttctgcctcccgggttcaagcaattctcctgcctcagcttcttgagtagctgggattacagacgcctgccaccacacccagctaatttttttaattattttttgcagagacggggtttcaccatgttggccaggctggtcttgaactcctgacctcatgtgatccacccaccttgacctcccaaagtgctgggattacaggcgtgaggcactgtgcctggccagtgctgtcatttttaaaaattaataccggtgtgagatcacctttgatttttttagtgaagcttaaagtgatcaagacccatagtttaggccaggtgtggtggctcacgcctgtaatcctggcactttgggaagctgaggcgggtggatcacctgaggttgggagttccagaccagcccaaccaacatggagaaaccctgcctctactaaaattacaaaattagcggggtgtggtggcacatgcctgtaatcccagctacttgtgaggctgaggcaggagaatcacttgaacctgggaggtggaatttgccgtgagccaagatgacaccattgcactccagcctgggcaacaagagtgaaactccatcaaaaaaaaaaaagacctgcagtttaagagactgccccaagggccactctaagctgcctggggcagccttctccatgaatgaggatgggatttattctagcttatctctccctgtagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctggtgagtgctgggttccacatctcctggaatcaccccaaattcctccaacctctgaacctccatgatggggtcagactggaaataagactcaacgtaggacatggccatcttgaatcaaatcatactttgcaaaagctctctgcagaagaggcttagccaggatgaggcgctagaggagcaggggtagatagcaatattgttatcatttcccagaaatattcttgatgtgtgctaatattattattattttaatttgtttacttatgggaattttctccagcaacaccagaaataatctccttaaggcctgaaactagaaattcttcacattttccattggagaatttcagaatacaggcatacctcattttgttgtactttgcaggtactacattttttacaaattaaaggtttggaaaactgcacagagcaagtatattagcaccatttttccaacatatgtttacttcatgtctgtctctgtttcacattttggtggttctcacattatttcagactttttcattactatatctgttatggtgatctgtgagtagcaatctttgatgttgctgttttgttttggggtgccaccaactgcatccatataagatggtcagttgataaatgtgcatattctggctgctccatcaactggtcatccccatctctttccctctctttgggccttcctatttcctaagacccaataatcacgaaattaggccagttaataaccctacaatggcctctaaatatgttcaagtgaaaggaagggtagcacaactctaactttaaacaaaagcttgaagtgattaggtgtacagagagaagcatgttgaaagccaagataggacaaaagataagcctctttgccaaacagccaagttgtgttaaaggaaagttcttgaaggaaatttaaagtgctactccagtgaacatataaatgatatgaaagtgaaacagctttctggctgatgcggagaaagtttttgtgatctggatagatgaaaccagccacaacattcccttaagcaaaagcctaacctcccttcagttctgtgaaggctgagagaggtgaggaagctacagaagaaacgtttgaagctagcagaagttgcttcatgaagtttaaggaaagaagctgtctttccattccattaaagtgcaaggtgaagcaggaagtgctgatggagaaggtacagcaagttacccagaagatctagctaagatcattgatgaagatggttacactaaacaacagattttcagtgtagatgaaactgccttctattgaaagaagatgccaccaaggactttcatagctagagaagagaagtcaatgcctggcttcaaagctgcaaaggacaagttaactctccctttagggctaattcagctggtgatggtaagcagaagctcatttaccattctaaaaatcctagggcccttaagaattatgctgaatctactctgcctgtgctctgtaaacggaaaaacaaagcctggatgacagcatatctgtttatagctcagtttactgaatactttaagcccactgttgaaacctgctcagaaaaaaaaaaaatttctttcaaaatattactgctcattgatgatgcacctagtcagccaagagttctgatgaagacgtataaggaggttaatgtttttatgcctgctaacacatctactctgcaacccatgggcaaaggagtaattcagctttcaagccttattatttaagaaatacatttcataagactatagctgccatatagatagcgattcctctgatggatctgggaaagtaaatgaaaaccttctggaaaggattcaccattgtagatgtatttgtaggccaggcacggtggctcgtacctgtaatcccagtactttgggaggccaaagcggcagattgcttgagccccaggagttcgagaccagcctgggcaacatggtgaaacccaatctctacaaaaaatacaaaaattagctgagcatggtggtgcgtgcctatattcccagctatttgggaggctgagattggcggatcacctgagcctagggaggttgaggctgtagtgagccacgaccatgccagtgaactccttcctgggcaacaccgtgagaccctgtctggggcggatggtgggagaggaacatttgtgattggccaggcatggtgttatgttcctgtaatttcagctactcaggaggctgaggcaggagtactgcatgagcccaggaggttgaggctgcagtgagccatgatcacaccactgcactccagcctgggtgacagagggagatcctgtcttaaagaaaagaaaaacaaaaaagaacatttgggtccgggcatggtggcttacacctgtaatcccagcactttggggggccaagatgagtggatctcttgagctcagtagttcgagattaggttgggcaacatggtgaaaccccatctgtaccaaaagtacaaaaaaattagtcgggcctggtggcacacacctgtggtcgcagctattcgggaggctgaggttggagggaggatcacttgagcctgcgaggcagaggttgcagtgagccaagatcgtgccactgtgctccagcctgagtgagagagtgagaccccaacaaaaaaatacacaaaaaacatttgtgattcatggaaggaggtcaaaatatcaacattaaataacaggagtatggaaggcattgaatccagccctcatggatgagtttgaagggttcaagactttagtgggggaagtacttgcagatgtgatggaaacagcaagataactagaattagaaatggagcctgaagatgtgactgaactggtgtcactcatgaggagtttgctttatagacaagcaaagaaagcagtttcttgagatggaatctactcctggtgaagatgctgtgaacattgttgaaatgccagcaaaggatatggaatattacttaagcttagttgataaagcagcagctgggtttgagagaactgacttcagttatcttattttaagaaattagcatagccatcacaaccttcagcaggcaacaccctgatcagtcagcagccatcagcatcaaggaaagaccctccaccaccagaaagatgacttgctgaaggctcaagtgattaacatttttagcaataaaatatttttaaattaaggtatgtatattggttttttagacataatgctgttgcacacttaataagtgacagtggtatagtgtaaacataacttttatatccactggaaaaccaaaaaatttgtgattttattgtgatacctgctttattgtggtggtctgaaatgaaacccacagtatctttgaggtatgcctgtatgtgcttttacttctgaagtccagccaacattatttctccttcctttctgtcttcctgccatgtcttctgtacttttggaaactatgcacttgtgcagacattgtgctcaatactttgtttcttcagatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtacctgagatcctgaaactgctgcctgattttccttttctcaggcccttaaatcttcagatacctcacaaggccttagtatacacttgagaatgcactgacagagatagcactgtcaaagcaggcatcttgctgaggctcatttgatataaccgtttctgacagctatatcgaaacttaaaaatgctattttatgttgattaccaactagtatgtgcaatagacattcctgaggcttgtccatagacagtctcttccccttgttcagtcctagtttgagtgagaagcccaaagatgagagataaaataagaatggagatttggtgagggtgaggatagctgttttacacatcatttggcatgttttaaaattgcaaatatgggttttaaagtcaatgtcttcggtcagttttttttttttttttttttttggaacagagtcttgctctgtcatccaggctggagtgcagtggtgtgatcgtggctcactgcaacctctgcctcccagtcttaagtgagtctcatgccccagcctcccaagtagctgggagtatagggtgtgtgccaccacacgcagctaacttttgtatttttagtagagatagtgtttcaccacattggccaggctggtcttgaattcctggcctcaagtgatcggcccaccttggcctcccaaattgctgggattacaggcatgagcttaccgcacgcctgcacgcagccttaaggtcagtctttgtagtcgtaaaatgagtctccactgcttgcttatggtgcaaaaaccaaactcattataataaatataggattcaagtccttttagaggcttttacctttcctgccttactcctaccactcttattccacgttccagccttgctagcctgctgtactcacactaaattacttctggtgtttctaacaaaccatattatgttccacactacctagcacacttaaactcatccttttaagatctaggttgctgttacccctacttctctctgcttttccccagagataattaattgcactttcttactaccaagatacttagtacattattctactagtgcacctgtcagaccatattgtagttacttattcatattttcaggttgctataagccccttttgggaaggtcttttacggttacaggcaatagagtgtagaggttaacagctcaagttctggaagcagacttatagattcaatttgtggcttccaaattcactggctatgtaatcttgagcaagttaactacctctctcgtctgaaagaaaaaggtgggtggggtagacagtagtacagattatagttcatattgacagattttcacaaagattaaacaaaatctacatgaagtgttttacatagtacctttcatgtactaaatgcctttttttttttttttttaggcagagttttactctgtcacccaggctggagggcagtggcacaatctcagctcactgcatctcccagcttcaaacaattctcctgcctcagcctccccagtagctgggattacaggcgtgtgccaccacacccagctttgtgtgtgtgtgtgtgtattttagtagagacggggtttcaccatgttggccaggctggtctcaaactcctgacctcggcctctactaaatgcttaataattgttatctattattatcctcatcaaagttccaactcctagtacagtgcctggcacataatagacataattcaatgtttgctgtacttttagtatgaatcaagaacatcatttctaaataatcacttgaagaaaccactttctcattgaatattgagtaattcattcacacaacctattatggagaactcactgtatgccaagcactgtagtgggtttggggaatataaaggtaaacagtatgtgttctgcccttaccaaaataatgattttgtgggggagatacatacaagtaaagcagcaattactatagcttgataagtatagggattaagcaaagggtactat

SEQ ID NO: 17217 - DNA, 22312 bp, Human
  misc_feature (1)...(22312): n = A,T,C or G
aaagtttcctccacctagaatcctgctatctcccagaatcctttctgtagaccaaacgggaagacatacggtgggtccaggcttggaggagggtggggagggaggtgcttctgagtgcttgttagaaaaacagctccagggcagggcgcagtggctcccgcctgtaatcccagcactttgggaggctgaagtgggaggatcacgaggtcaggagttcgggaccagcctggccaacaaagattagccgggcgtggtggcaggggcctgtaatcccagctacttgggtggctgaggcaggagaatcgcctgaaaccggaaggtggagattgcagtgagctgagatggagccactgcactccagcctgggcaaaagggcgaaactccatctcaaaaaaaaaaaaaaagaaaaaagaaagaaagaaaaacagctccaggacaagttcttttgcccccttctatgagtctagccatcccaaagccctcccagattctaaaataaggaatcatcctaccgtttcccatcatggtgaaaaacagcatttgcctatatatcctgcctgccccactctctggaggaagttgagtgtttgcagttgcttgaaaagataccacctgaggacagcttggcctgctgggatgacccgagaccagatgtattggaatcactgctttgtccctctccaccctctggctttgggggattgcttctcccatcccaggacctggaacccaaaataaggccccaagagatggattcaaatctagtcattgggggccgggtgcggtggctcacacctgtaatcccagcactttgggaggccgaggcaggcggatcacgaggtcaagagatcgagaccatcctggccaacatggtgaaaccccatctctactaaaaatacaaaaattagctgggcgtggtggcaggcgcctgtagtcccagctattcaggaggctgaggcaggagaatcgcttgaacccgagaggcagaggttacagtgagccaagattgcgccactgcactccagcctggtgacagagcgagactccatctaaaaaaaaaaactagtcattgggcagggatcctaagtatagcattaagaagtcctgcaagatcactggtaagtcagagctggaactgggactcagaatacagcctccttagttcgaatctctcctggcaccttagctaagtctcagtgtttgtgtgaaaggtacaaaatctaaggagacgctctctgaggtcggggtgctgaagcttcctcctctcttcctcctccttggctgaccagagtacaggaccacagccagtgaggaggcagttgtcccagcctggatccccagtgcttcagtccacctcctctctggcttcagggattcccttttttgtgggaaatgtagcaggaagagcctcagacaaaacccctcagatgctgagttaaagaaggaaggggtttattcagctgggagcatcggcaagactcctgtctcaagagctgagctccctgagtgagcaattcctatcccttttaagggctcacaactctaagggggtccgcgtgagagcgtcgtgatcgattgagcaagcagcgggtacgtgactgggggatgcatacaccggtaattagaagggaacagaacaggacagggatcttcacagtgcttttttatacaaataaccgattaggtcaggggtcaatctttaactgccaggcccagggtgtggcgctgggctgtctggctgtctgcttgtggatttcatttctgccttttagtgtttactttggaggcagaaatcggacataagacaatatgaggtatggtttcctcccttagaagaacactgggcaggtcagactgggcagaggctggtgttcctgagccctgaggagacatccagaaatagatgggggcgtgtcacgtttctgagcagctgtgtgggggaggttcaaggggtggggactaacaatatcaaaaagaaacttgtcctcccctctcctggtggccatggtggagatcagcagcagcttccccacccaggacaaggcctaggtaaggagtgcaccactctcctcctgggtgctgggcaggaaaagtggttttgaggtgaaatttgggagatgaacggtggaattttaggagtcatgagaaaaagtttccaggaaactttgatgaagtttgggatacctaggaaggttgggagccatgggaagtttgggattcctgtggggagatttggggtcacattcccaggagggtatgttcagcaagggcctggatgagaaactgatgacagaattgctccgagcaggatgagagggaggacagaagcgcagctcccttgggctagaaaaggaattgctcagcatccccagctccttgggcccatgcccaccccatccctccggttcccaccacatctcccctgacactggtcaccaaggccagccacccacctgctctgcagtggtctacactgttagctgcgctgagaaagttcctcagactctcagcaaacatgctggggcctccccagtccctggccttggcatacatggtccctgccctcaaggaactcactggccagaagaggagccaggcacatataagggcagcacagtgtgataaggacagtgacagaggacagcacagggtgataccagagcccagaggagtcagagggcttcctggaggaggtggccctcgggttaagccttgaagagtaggtatccaggagaagggtgtcccaaggagaggggcgatgtgtgcagagccacagggagggtaaccacggagccgcacctgcgacgttgttctgcactacagaagccaagcaggagtggcaggtgcgagcctgcagagggtgcagagggccaggataaggacgctggcctctgtccttagggtatggagggatgttttgtttgtttgttttgttttttttttctagatgtgtttgtatctcttccctcatgattttcatctctgcatttttactctatattttgagatatttcttccagtcagttttggcacagagggcttttaagcatgtaaggaacatgaccagagtcgcgctttagaaacattgctctccctgggcaggcaggatattggggctgactgtggaggcggggagatcagcgaggaggaaggggcaaacctgagccagggcagggggtgtggatgttgaagggaaggagaatctaggatggacccctatctcacccagcattagttggcaactatgtgaatgtttgacgaatgattgactgaatggacacccaggggaccatcatgggtgactgggtgaataatggggatggtttatcacgtgagacttgccatggcaaattaacaggagccaccctgagctagattaagcctaaagaggattttatcacaaggataccagggtatctcatggaacccaaggaccagatgcaaagagcctctagaaagccaaggaggagtgcggctccacctgacctctggcttcatcaatcaagcagctcaccctctgcctttcagccttctctttcccttgctctggggatctcatctcttccctgatttcaatcacctgtgactctcagatgtctccttgattgtccattctgctacctcttggacatctgcttcagggagttcacatttcccaaagtgaactcaccatttcccctccaaacccgatcattcattcaatacatttttactgagcacctgctttgtactgggactacaataatgagcaagatgagcttttcaagtctactctggtataacattgtgcctatagtaacaataaggcactgtgcacttaaacatgtgtaaagagggtacatctcacattaaatgttcttgctacatgaaaaccaaaaacaaaacaaaacaaaataaaaataaaaacaggccaggcacggtggcttatgcctgtaatcccagcactttaggaggccgaggcgggcagcggatcacctgaggtcaggaatttgagaccagcctgaccaacgtggagaaaccccatttctactaaaaatataaaattagccaggcatgatggcacatgcctgtaatcgcaactactggggaggctgaggcggagaattgcttgaacccgggaggcagaggttgcagtgagtcgagattgcaccattgcactccagcctgggcaacgagcaaaactccgtctcaaaaaaaacaaaacaaaacaaaaaaaaaaacgaggctgggtgcggtggctcaggcctataatcccagcactttgaaaggcctgggcaggtggatcacctgaggtcaggagttccagaacagcttggtcaacatggcaaaaccccttctcaactaaatacaaaaattagctgggcgtgcttgtgggcacctgtagtaccagctacttgggaagttgaggtgggagaatcacttgaacccgggaggtagaggttgaagtgagccgagattgcaccactgcactccagcctgggcgacagagtgagaccctgtctcaaaataaataaataatatataaataaaaataaaaataaaatgaaaacaaagggatacacagaaacttggaagtgatgaacatgtttattcccttgattgtgggaatggtaacatgagtgtatacttatttccaaactcaccaaattgtatatattaattatgtgcagttttttgtataccaattatacttcaatgaggctgaaaaaaaaaaaagtaaagttgcacagggctgtgctggagcaggacactctgcagtcatgtaagaatggtggaagaagatagagggcaataaaagaagatgggcaataaaagaggtgtcaggcctctgagccgaagctaagccatcatatcccctgtgacctgcacaaacacatccagatggccggttcctgccttaactgatgacattgtcttgtgaaattccttctcctggctcatcctggctcaaaagctcccctactgagcaccttgtgacccccactctgcctgccagagaacaacccccctttgactgtaattttcctttacctacccaaatcctataaaacggccccacccttatctcccttcgctgactctcttttcggactcagtccacctgcacccaggtgattaaaagctttattgctcacacaaagcctgtttggtggtctcttcacacggacgcgcatgaaatttggtgccctgactcagatcgggggacctcccttaggagatcaatcccctgtcctcctgctctttgctctgtgagaaagacccacctacaacctcaggtcctcagaccgaccagcgcaagaaatatctcaccaatttcaaatccagtaagcagactctttttactcacttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgcagggacacctctctgattattcacccacgtttcagaggtgtcagatcatgcagggacgcctgccttggtccttcacccttagcggcaagtcccgcttttctggaggaggggtaagtaccccaaccccttttctctgtgtctctaccccttctctgcttttctgggggaggggcaaaaactcctcaaccccttctccttcacccttagcggcaagtcccgcttttctaggaggaaagaacccccaatcccttatttccacaccccaacctcttacctctgtgccccaatcccttatttccacgccccgacctcttatctctgtgccccatcccttatttccgtgccccgacctcttatctctgcgcccaaaccccttatttccacgccctgacccctttcccgcttttctggagggtaagaacccctgaaccccttccctccgtttctctactctctcttttctctgggcttgcctccttcactacgggcaaccttccaccctccgttcctccgtctcccttagcctgtgctctcaagaacttaaaacctcttcaactcacacctgacctaaaacctaaatgccttattttcttctgcaaggctgcttgaccccaatacaaactcgacagtggttccaaatagccagaaaacggcactttcaatttttccatcctgcaagatctaaataattcttgtcgtaaaatggacaaacggtctgaggtgcctgacgtcaaggcattcttttacacatcagtccctccctagtctctgcccaatgcaacttgtcccaaatcttccttctttccctcccgcctgtcccctcagtcccaaccccaagtgtcgctgagtctttctaatcttccttttctacagacccgtctgacgtctcccctcctccccaggctgctcctcgccaggctgagctaggtcccaattcttcctcagcctcagctcctccaccctgtaatctttttatcacctcccctcctcacacccggtctggtttaccatttcatttcatgactagccctccccaacctgcccagcaatttactcttaaaaaggtggctggagccaaaggcatagtcaaggttaatgctcctttttctttatcccaaatcagaagcatttaggctcttttttatcaaatataaaaacccagcccagttcatggctcgttcggcagcaaccctgagatgctttacagccctagacggtaaaatgtcaaaaggccgtcttattctcaatatacattttattacccaatctgccccggacattaaataaaactccaaaaattagaatctggccttcaaaccccacaacaggacttaattaacctctccttcaaggtgtacaataataaaaaaaaaagttgcaattcctcgcctccactgtgagacaaaccctagccacatctctagcatacaagaacttccaaacgcctgaaccgcagaggccaggtgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcagctcacctgacagccactgccagagtccctggaactctggcccgaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctacctctgtctgtcctcactgccattctcccatcagacatcaagtcttgtaaattccacctcctacctctgtctgtcctcactgccattctcccatcagacatcaagtcttgtaaattccacctcctacctctgtctgtcctcactgccattctcccatcagacatcaagtcttgtaaattccacctcctacctctgtctatcctcactgccattctcccatcagacatcaagtcttgtaaattccacctcctacctctgtctatcctcactgccattctcccatcagacatcaagtcttgtaaattccacctcctacctctgtctatcctcactgccattctcccatcagacatcaagtcttgtaaattccacctcctacctctgtctgtcctcactgccattctcttactcaggtccactaattccatgtcctcagtctgccttcaagcctctcctcccctcaagcctctgatgtatcttgtttattgtagagcagatgcagacagaaacagagctgtggagacacaatgagagatacagctggcccagtgggcttttgctgcataactattttgccgtgtgccacaaaatctcagtggcaaacaaacatttactcccaggctcatggtctttgggttgacggcaagtggcttatctaaactggacttggttgggcagctctgctcaggccgccggtctggctcagctggggtcttccttgctctgggctgggctcaggtctgttcctcacgtgttcattctgggggtccagactaaagaagaatcttccaaagaaaagactctcagtttccttcccccaaaagcagacccacagacaagtacatgggtgcagtgagcttctttgtaaagtgatcccaagaaatacaagtcagggagcggcaaagtcagacagagaagagaaaagcagccaattaaaagcctgttaccactgtgatcaactagtcccactggggaccctctatgggacaggaagtctgacttccagccctcattggttgaaggctgtccttgagaatattaaatcccttacacttttggcctgccctgtgctcacaaaaaacaggctcccagggtgatggagaatgcttcagagacagaaaaatgtgagccctagaagtgggaggctgacagcctgcatgagaactatccactgtacctgcatgtggactcgaagacagtctccgggaatatgggctgaggaatccacagtgtcaggtacactctcttttaccctgcatccatagatcaactcgcaggaaggcctctgattggccttcttgggtcatgtgcccatccatgagccagtcacaatggtcaaagccttagggcaccagtcctggggcatgtgttcctctcatggggtgcatagaatgagaaaagccccacctgagcccatgactggattctacacaggaaagtgaggaactagtaacagcagctctagcctccttgctggacttcaagagaccacagacaagagctcaagtctttttttttttttttttttttgagacagagtttcactcttgtcgcccaggctagagagcaatggtgcgatctcgggtcactgcaacctccacctcccaggttcaagagattcttctgcctcagcttcccgagtagttgggattacaagcgcacaacaccacgcccagctaattttttgtaattttagtagagatggggtttcaccatgttggccagtctggtttcaaactcctgacctcaggtgatccacccgccttggcctcccagagtgctgggattacaagcgtgagccaccgcgcccggcccagggaagtgggttttcatagctcactgcagactcaacctcctggtctcaagcaatcctcctaccttcagcctgccgagttgttgggactacagatatgcaccaccacacctgtagcctggcttatttatttatttatttatttatttatttattttttaaatttttgagacggagtctcgctctgtcacccaggcttgagtgcaatggcgcaatcttggctcactgcaacctccgcttcctgggttcaagctattctcctgcctcagcctcccgagtagctgggattataggcacctgccatcatgcccagctaatttttgtatttttgtggagatggggtttcaccacgttggccaggctggtcttgaactcctgacttcaggtgatccgcccacctcagcctcccggagttgtccggatgtatttttttatttttagtagcaatggtgtctcacaatgttgcccaggctcgtttcaaactcctgggctcaagtaatcctcccgcctcagtctcccaaagtgctgggattacaggctggagccaccatggctggctgttgttcataattttatccttaatgcctgacatgctacagatgctaaacaacaataacaaaaaaaattgttgaataaatgagtaagcagcttttgagggggagaagataatgagctccattttggacatgtggaatttggtaaaaactactgctaaccccattgtccagagaagctcatacttcacatttaaattgtgtattggcaattataggatcttagatttgaagattaatgaaattatagacacatagaatcccagtgtcttagagtcactgaactatccaaacttaggtctccccagagccagaggagatgataaagcagcgacgcttaacctaaatgagattgggggcagaggcataaccaccttgatatttatgtaacatttgtgtgaaggcgcatatattcattttctgaagggaagtttcagcttttatcagattccaaaacataaagacccattgactatattaccatttgtgtacagaaagaaaacagaggctgggagctgtggctcacgcctgtaatcccagcactttgggaggccaaggtgggtagaatgcttgagcccaggaattcgagatcagcctgggcaacacggcaaaaccccacctctacaaaaaatataaaaataagccaggcatcgtgatgtgtgcctgtactcccagctactcgggaggctgaggcaggaggatcgattgagctcaggaggtcaaggctgcagtgagctatgattgtgccactgcactccagcctgggcaacagagcaagaccctgcctcaaacaaacaaacaaagtagataccatttttcctaccagttaaatggaaattaaaaagagatcaatcatattcagcactggcaaagatgtggaataaagggcactctcatccattgttggtggggtggcagtttctgtcaaaataaaaaatattcatattctttaaatctcattttacttctcaaaatctttcctataaaaacatgcacacacatagagaaggatttatatacctaaatattcactgtagtattatgtataatattttaaaattagggaagaaacctaagtgttcataagtatgaaatggttaattatggtttataccatgagataaaccaagctgccattatgtgagcagggagatatttatgtactgacatggaaggaagttaatattttttttctgaggaaaaaaggtaataaaatgtgtatgtgtaagcatgtttcctttcagttcttaaaaaaatgacaataaggccggcatggtggctcacacctgtaatcccaacattttgggaggctgaggcgggcggatcacctgaggtcaggagttcgagaccatcctggccagcatggtgaaaccccgtctttactaaaaatacaaaaattagctgggtgtggaggcgggcacctctagtcccagctactccggaggctgaggcaaaagaatcacttgaactcaggaggtggaggatgcagtgcgccgagatcacgccactgcactccagcctgggcaacagagtgagacttggtctcggaaaaaaaaaaaaaaagagagagaaagaaaaaaaaggaaactgcctgctccaatccagacccaatgcctggacaccctcttcctggaaccacttcgggcactccgcctgtcccccagcaaagagggtgtggaaggcttgtggttcctgctgcttctcttagggaaactggtatcctctgtcttctcctgctcttctgatcccctcttcccccagcacccggggtttatatctgtccctccctggaagcaccgaaggctcattccacaagaggactgcagggagtgggggcaactggtggaccaagccctgctctaagtctgtccctggagatcctgctaaggccccaccagctgaacactcctggatctgcccctgtcccaaaacccacaacccctgcgaggtgaagcccaggtctctcactgtggctgtcaagtcctttcatgactggcccatcttcccaacgttcctaccccgcaagctctgccagcctagatgacatgtctttctctctttacatcctcagttcccacctccaatacctttgctttttccattcctgctgcacaaaagtcctttcccacccaaacaccagtcttttctctcccagtctccacttgctgacatcttagtctcctgttcatcctacaagacctgttcacgtcactcctccaggaagtcactcatgttcctttcagcaagaagggtcctctctcttctgagcctccatgtctgtcttatgactctcagtgccaagcactaggaatggcacagactaagtgtcgattcatgtttattaaactatacagattaacactgcaattttccagatgaggaaactgagacccaaaaagagacagcaactggcccagggtcaccagcatgcagatgcctgctatgatgtctctgcttcttgtgtctgtgggcctcatggaagcacttcaggtatgggcatcccccactgttcccaccccagcagggaactgagccatcggcttcttctgaaccctggagggagaaagagagagaggaaagaatgcccgacgcttcccctggggatcactcagcccaaggggacagctccagatgctagtcttggggaaattacagccagaggttcccaatccccttccccaccaggtgtgtttggggcccttcctgcctttctcagtggaggggagagctggatggcaggggactcattctcccaggggcctatcctctcagtccctgctactcctgtcccctcaggcccagagccaccccatcacacgacgagacctcttctctcaagagattcagctggacatggccctggcctcctttgatgaccagtacgctggctgtgctgctgccatgacagctgctctcccggatctcaaccacacggagttccaggccaaccaggtgtatgcagacagctggacactggcaagcagccaatggcaggagcgtcaggccaggtggccagagtggagtctcagccccacccgtccatccccgccacccctgggcttccgcgatgagcatggggtggccctcctggcctacacagccaacagccccctgcacaaggagttcaatgcagccgtgcgtgaggcgggccgctcccgggcccactacctccaccacttctccttcaagacactccatttcctgctgactgaggccctgcagctcctgggcagcggccagcgtccaccccggtgccaccaggtgttccgaggtgtgcacggcctgcgcttccggccagcagggccccgggccaccgtgaggctggggggctttgcttctgcctccctgaagcatgttgcagcccagcagtttggtgaggacaccttcttcggcatctggacctgccttggggcccctatcaagggctactccttcttccctggagaggaagaggtgctgatccccccctttgagaccttccaagtgatcaatgccagcagactggcccagggccccgcccgcatctacctccgagccctgggcaagcacagcacctacaactgcgagtacatcaaaggtaggagggcaagcgctggtcggcacctgtgcggaaggtggaccttccacatccaccagggactttggcaaaccgaagcccctatctcctgtgtcccagggatacataaatacaagtcatatccaccagctcccaaccccttccatctaaggggagacataaccttctgaggggtgcacttactgcccctgaagggatctaagccatagttcgccacttgcctgctgggaggctgaagaggtttcctggccaacgcagcggtctctggccatttgagtgggcaagcagacccggtcgggcttttctcctggtcagaggctggaagggaattattttccagccagattattgacacctagatagctgttgccagaaatgagtaggagtcccaccctcagtttctgagaacagtgcatttatgagatggaagaggaattatgtgctgaagggtgtgctgggtggggtggtgggggcaaggagacagcagttgggtgctgtgcccctaaggtccagctcaggctgtggtcaggaagtggtggatgctcctcctgttcatgtccccagcacaggccagaagaagaaccatgaggatgggcccaggttcttaatttctgaagggctatgggctttacttcctatcttggacaacatcaggagcatgcatgagttgacagaaggtaaggagggcatgcaaagaaaacaaaccaggctggggcgaggcatggaagagggagaggtgagtgtggcagggaggcaaagttataggcccagggagcaggagtgccccagagtagaccctggctctgatggcccactcccttctggccctgctgctcatgggtcgaggcaaacctagtcaagggaggttccaccatgaaagagcagaattagggggaaatgcaccaacttctcctagaacaagtcagggatggactaccagggctctgaggtccctttccatcctgacagctcctgagcctttcattctttactgtttcttttctatagacaagaagtgcaagtctgggccttgccatctggataattcaggtaagggctgcaggcacctgtgggactcagttcagggatgagcaggctgctctggggttggccccatcacctcgatctttttttttttttttttttttgagacagagtttcactcttgttgcccaggctggagtgcaatggcacaatctcggctcactgcaacctccacttcccgggttcaagccattctcctgcctcagcctcttgattacagctgggattacaggcgcatgccaccaagcccggctaattttttgtatttttagtagagatggggtttcaccatgttggccaggctggtcttgaactcctgacctcaggtgatccatccacctcggcctcccaaagtgctgggattacaggcgtcagccaccgtgcccggcccacctgaatcttttataaggaaacaactgcattaataataaaaaaaagtgcactagctgaagtggcaccttgggggttgccagccttagccaggagatgagtgtgtgggagagcagatggttgagggagcagggacacctgctctccagcctggatctgcctatcccttgcaggaaaaggccactgatcaggcccctgagagattcaggctgcactgaggtgagggacagaagggctgctccccacaaagtcctcctttggtccttctctgcctcccagtgcagaacccactgtctctgttactgccctcagggctccctcaaacccacctttgaaggccatgaggccaggcttttggtgctggaggcctgggctctagtccaggctctgctctaactttctctacgaccaacccattctttctctgtgcctcagtttctctgtgtgtataataagcaaattggaccagatgatccccagctatgactcttctcttccctcggacacttggtgtgccaaggcctacccaggccaccatgtttctaggtgggaatgggccatttccagggaagaaacagcagctcctccccaagccttcagaactcctttgtccttcagaactctgtgagtgggcaggaaggaccccccagcttcctctgatccactccaggcacatcatgccattcatcctcaccacaccccagtggtactgtcatcacctctgttctgcagatgaaagtaccaaagcacaaaggggcaaagagaggccgggtgtggtggctcacgcctgtaatcccagcactttgggaggccaagatgggcagatcacctgaggtcaggagttcgagaccagcctgaccaacatggagaaaccccgtctctactaaaaatacaaaattagccgggcgtggtggcgcatgcctgtaatcccagctactcgggagactgaggcaggagaatctcttgaacctgggaggcggaggttgctgtgagccatgattgtgccattgcactccagcctgggcaacaagagcgaaactctgtctcaaaacaaaacaaaacaaaaacaaaaaaaatcaaaggtgcagaggagaagcaactggccctgtgccacccagctactaagaagtggagtccagagagcctggctcaagagccaaactctgaaccaccacaccaggatagttcccacccctccccagacatcatctcatctcatcatctcatctcatctcatcatctcatctcatctcatctcatctcatctcatctcatctcatcatctcatctcatcatctcatctcatctcatctcatctcatctcatctcatctcatctcatctcatctcatcatcatctcatctcatctttactgcacagtaatctatgggaaggaggcagaacaggaggcattaccccccttatatggtcaagtgagacccagagacaaattatttgctcaaggtgacaatgagtttatggcagagccaggacaagaagccaggtttccagcttccaacccaggcatctttgagttctgattatgtaattccagatactggaaaagtttaggatttctccttctagtccactccacacctctcctaccagggtttgggtagaggagccaagttcagccacagcagatcccactctgatcttaaatccatgtttcatcccactctgcagcaccttatttgtggcaatagaaggcagttaagttagacccaatgacctctggaagagaaactgggactctaattggtctcatctctgtctaccttcctaaattctttattaaaaaaatttttttttgagacgtggtctcagtctgtcacccaggttggagtgcagtggcaccaccacagctcactgtagcctcaaactcttgggctcaagcgatcctcccacctcagcctcccaagtagcttggactacagatatatgccactacgcctggctactttttgtattttttgtagagaagggttctccctatgttgcccaggttgcctaaaattttttaagccagtcaaatttagcagtggggggactgtacatcaactttagtgacactggtgttaataagttctgataacccattaccattggaccagctcctccctaaacttgatcttcatctctgttgcccgtggcagttttgtgtatcagtctgtccagctcactctgccaatctctccaccttgtatctgcatgtccccacttttgctcctgtgctcctaaatacctctttttttctctctctctcccccaacctctctgcctgttttccctgcagccatgggtcagagccccctctctgcagtctggtctttgctgctgctgctctggttcctcgtggtgagggcctttccagatggtccaggcctcctttgatgcatgagacacgggacagcctcgcctgctgcctctgcccatcctgaggatgttggccatgtgtgctttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggcggtgtggcgggtacttcaagacaggcagcaactaacctggcgatagaagggcttcagctgatttgggggatgactggagaggaaagcgcttggccgtcatacctgctagtgttactcagatgcctcacgtgtccatctggaaagcttctgttcactcctccaggaagccttctgtgacctctcccacctggctggggtagtgaccctgtctctacgctcccacagagacctggatgcttccctataccaccacatgtccatgtctgtctgccacatcagaccatgagcttcctgagggaagggactgggtcggaggcacagagatggtgccaggaaacgtgtgaaactcagaaaggaacaaatacctgtgaatggctggtccctgcactgcccctgccttggacactgtcaagctctcattgtccgtgtgtgggaatggggtggacggtgcctaactccagcacacagagagaaggagagacgggagagagagcgctagtcctccatcggcacctcggtcaaattccattctcttgtcagcacagatgtaacttctgctctaatccatgagtcctgaggctcctctcatcacggctcactgtagcctcaaactcctggtttcaagagatcctcccacctcagcctcccaagtagctgggactacagatatgtgccaccacacctgactaatttttgtgttttttgtagagacagggtctccctaggttgcctaagttctttttttttttaagctagtcaaatttagcagtggggggttatataccaactttagtgacagtgacattaataagttctgataacccaccaccatggacaccagcaatacccagacagctgggaaagcattatttctggatgtgtctgtgagggtttgcagcaggagattggcgtgtgagttggtggactcagtggcaagttccactctcaatgtgggagggcatggagaggacaaaaaaataagggaaaggcaaattcacactctttcctggagctgggacatccttctcttaccattggacattagaacttcaggttctcaggctttgaacttggacttgcgccagcggccatgagacctgaagtagacagacctggacccccagcttccactaccacagacctcatgggtaacacagggcatcgaggaggtgctaggtacacgcttactttattgagtcagggatttggggccaaatgtctgtagggcctcctgctctggaaactcgactgagaatccccgacccttttccctgagcccctcagcagggaaaggtaacagccaaagccctgcaaagcagccacctaggaaggaagacaggaaatgcagcagtacagttcagtttctcattataacccatgtgctccccactgagagctccaatacccagcacaaacaattctgtccctccaagactgtactctgtgatcttggcctttgtagagttcctcttttttttggaattaggggagtggcaggctctggacttcctttagttagggtgtgtagacaatgagtgctcccttgtggattgtgaagtcaagtgtctcaggatcttaggagcagtggggagagactggctggcccaaagaccagcaaccacttggccgtggctgtccctttctggaggagctgtggctgcagcagatccctgtgacttagtcccagccctcacagggcctgcaccagcaccaggaggctcatgaccagggccatggagaagaagatggccaggaagaagcggtccatcacacgggccaggcgcttccagtcctcatggcagcgctgggcagctcggtggctgcggaaggtattggcaatggtggctacgtggtgcagtagggcttcctggcggcacagacatcgtggctcgtggcaagggcccgctggggggccagcccctccttcaggcgactgggggctaggagataactcaggtggcctggactgcccacagggctcccctctttcccgcacgcaca

SEQ ID NO: 17218 - DNA, 42276 bp, Human
caggctggtgtcagactcctaggctcaagagaccctcctgccaagacctcccgaagtgctggaattgcaggcattagccacacagcgcctagcctggtctgtttacagagtcagcaaattctggcctttaggctacccagccttgtttgtacatgaagttttattgaaacatggtcacgcccacacggtcagagttgggtttcgtccccgtggcccgtaatgcctaaaatagtgactctggcgctttaagaaacagtttgggaactcctgcctgaaggagaatcggaaacagcactgaagatgttactgaggtttaaatgcgacccaaacagaaagggcttcggggcggttggtgtccgtctgattaacctgctgtctgctggttacatgtggattagaatcttaaactgttacgcttggcaagatgaatgactacaacttttcattattattttttgtaaattatgcattttcacttgtagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaaggtgggtaacctccttcctgattctctagaagaattcacatttgcttattgtttagctcttcttatttcttatctctgttttgactgctataaattcaagatacactttttttatttgtgtttcagtagagattattggatttatttatagagtactgaaaaacaggatattaggttgtttcaatttgggctttaaaaaaaatggccctcacttaagcgttttcccagttgaataaaaactagaggatgctgtttaacctaacacatccgaataactcccttcatcccagttttccttaaacacatccctgggtattgggccatagtgttctgtagagagagtgaatgtgggggcggtggctctgcggggaataaccgttccccatgcgcagtggtcaggctgggcgctggctggggccccagagagcagcgtggtttaacttgtcagtcaggcatgcagctgacgtccaccctacgaaagttaagtgttttttgatctttagttttttgaaaaatattttgaggcacacgtttattgctgtagtcactaaaatggaacttggaggttaggaccaggggagggtgaaactaggggcattcctgtagaaggtagagactttcaccagatgggtggggtcagcgtggagttgctgacttcctccagaccgtggcttgggaaaccgtggccatggtggtgccaggtcatccggggcttacagtcacggtggcgccaggtctgcaggggcttacggccacggtggcgccaggtctgcaggggcttacggccacggtggcgccaggtctgcaggggcttacggccacggtggcgccaggtctgcaggggcttacggccacggtggtgccaggtctgcaggggcttacggccacggtggcgccaggtcgtcaggggcttacggccacggtggcgccaggtctgcaggggcttacggtcacggtggcgccaggtctgcagcccggaaacctctagttgtccttacaggtggaggatccctcctcccccaaatccaaagctttttgagtgcccacatggtgcttaaaggaaatactcattagggtattttggatttttcggattggggatgttcagctggtaagtttaacgcaaatactccaaactcagaaaaaaattcaatatccaaaacgtccctggtcccacgcacttcaggtaaggggtgctcaccctgtccggcctcttcacagcaaggttgccaaggcctggtctagagggtggtggacttcacagccatggagaagggtgctgctttaacttggaacgttatttaatgtttaatgctaaattgcggtaacttttccttttgcatgcatatttagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggtgagtgctgcctccctgtgccctgggcatggtcaggcccgcgggctccttgcaggcactccttagagttggcattgctgtttatctcactttcaattttcagaaacatttcccagaatcaccatcttttaagaatagatcatgacagtgggtgaaattggagtttgggcacgttcatgctttcagaccgcagtcatcgcacacaccattcaggggtgggagttactcgtgtgtagaaagttcaaccttctccctggagtaagccatggccgggttggaaaacagggaatcagcgatagggacgtagtggagaaattcgaggcaggaacaggagttcgcaggtaaaagattgacaaaccctctgagttagaaaactaaatgcaaggtttcagctgaaacgtgcacagaaggacacgttgtggctgggagggcggaggacaggcctgctgtctcccgacggtgaaacctgtcccggacggggcaggctgctctgacatgttgaaacttccgccgaataaaacaacctttcagcaataggtgattcttgaaggaagacttaacaccccggtgcttaaaaaacccaaatacctcgttattctagttattctgtgaaaatgctcccataagcacctggattttccgcgaatgaagattgcggtttttctcctccaatctgcttcctgtcctggcggcgtttcctgagagggcttctcagtgcgtggccccgcctccggggctcaggaaagccttgtggggtgagctcatccctgtccacgcacgctccctgacagcaggtgtggtcttatttgaggccacggctctggcacgtatcatggggcgttggacacgcatgtgctcagtaaagcatttgaatcaagggtaaatggaaggttccatctcagtgtgaaatagccaggtgctagctgcagggcagaggcgggctttccgtggagcccagcgagacccttgatcccaggagaaagccaagccctggcctcctgtgggcagtcagacccttctctcctgagcgtggagccgggccaggccggggtcctccttggcccctcaggtgcccgtctgccctgccgcgtgtctgcccagctcctgacccttctctcctgagcatggagctgggccaggccagggtcctccttggcccctcaggtgcccgcctgccctgtcctgtgagtgcccaagctcctggcccttctctcgcattccttccttccccctgaattgtgctcacgtttcctttttgcttctgtgtacgtggcctcactgttgagaggctttgctgaacacatgctaagagaggtcctcctgctgctcaggtcacccgctgtgcccggctccccgtctgagatccaccccttcccaccatggctgcctatccctggcctggcagatgggaacctgcagtgggcagccctggtggggtgcagccgggtgagggccctggtggggtgcagccgagtgagggccctgagccctagtggggtacagctgggtaaaggccctgagtcctggtgggtacagccgggtgagggccctgagccctggtgggctgcagccgagtgagggccctgagccctggtggggtacagctgggtgaaggccctgagtcctggtgggtactgccaggtgagggccctgggccctggtggggtgtagccgggtgggggccctggtggggtgcagccgagtgagggccctgagccctggtggggtacagctgggtgaaggccctgagtcctggagaggtgcagccgagtgagggccttggtggggtgcagccgggtgagggccctggtggggtacagctgggtgagggccctgagccctggaggggtgcagtcaggtgaaggccctggtgggatgcagccgagtgagggccctgagccctggtggggtacagccaggtgagggccctggtgggtgcagccggatgtgggccctgagcctccagtgctggccggaacagcctgacgcagccgggtctcctgcaggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagaggtgggtcctcgctgcacccagcaggtccgtgccaggcgttcccttgctggacagctgttggttcatgcacctgggcagtgcccctcatcacccggacgccccgctcatggccctcgttctcttcctccgacagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcaggtacgtggcggcccagccactgtccccagctaatgagggctcttcaagcttgctgctccagtctgttggggggatggcgtcagttgcccgaagtgagggcgggtggaggctgcagacggtgactcctgcttccaccttgtgggagcgccgcccccgcttgcagtcttgggtccttttgtttttctctcctgtcttgggtcccaaaactaaaacaaaaccccgaccatcagcttctcagatgttgtccaggcacccgcatgtgcccacctgtggccgccccgcagagcactcggtcctgggaacactcagcagagaacgagcagagccgggctggttctgagccccccgccccactcgcctcaccatctgctctccgccggctccacgtttgctgctctgccaaccccaggctgccctcttcgtttccacacagagcagatgcaggggttggtggcagtggcggctggtaaacagcactgtgaggaagggaaacttgattggactggaaggcgttggtagccgggatctgtgctgccctggagtggggagattgcaggccccgagggatgcttcctgagcatgtggcctctgtgcctgtttgcccgcgtggacccgagatcagccctcagcctaaggttgtggcccctggagaccccatgtaaatggctgtgggacattgttggagatttaagtgaggagtctttgtttgtaccgtggttgttgctttgaaattcaaccaaaagttcaactcaattaaacttgacccaggcaaggagcacccaccaagacctggtgtgcgtttgcccctggaagccgtctgacaggtcacaacacctcagatcctgtgacgggtacagaatgcaggctgctagagggagacgggtgctcacggttaatggggagatggagaggtacggcttgatgtccttttcgagcctttgcaggatccagcactgtccctgcgtggggatgctgaggcctggagtgcatggccctcccaagtcaggagcaggggtggccagggcgtggccttcgcacagtgggtggcagctcccgaacctgggtggacaggtgagaaggccccgccaggcaccgcggcaaagcccagccggctttcgggagaggccgctccctctggaaacgcgctctagttcctccccggttttctgtttcatagattgtgttttgtcttttacgattctggagagcagcgtgtgcccctctcggctgatttcacggcccttgaggtcatggtggagagtgttgctaagaggaggagtcgggtcgggtgactgggatgtgggcaggtgcagggtggctgcgggcagctgggccggtgcgggtggcttcccgtgcggcagcctggcgacgctctgggacctagggggtggggggtttgggatgaatctgaggtcctccattctgatgacagggaagaggatccccagccacagagatgatgtcatccctgatggataggaaggtgtcctcgtgatgatgtcacctcccgttgttaggaaggcatcctggtgatgtcacctccagttgttaggaaggtgtcctggtgatgtcacttcccattaggaaggcgtcctggtgatgatgtcacctcccattaggaaggcgtcctggtgttgatgtcacctcccatcattaggaaagcgtcctggtgatgatgtcacctcccattaggaaggcgtcctggtgatgatgtcacctcccatcgtgtcctggtgatgctgtcacctcccatcattaggaaggcatcctggtgatgatgtcacctcccattgtgtcctggtgatgatgtcatctcctgctgttaggaaggcgtcctggtgatgctgtcacctcccattaggaaggtgtcctggtgatgatgtcacctcccatcgtgtcctggtgatgatgtcacctcccatcattaggaaggcatcctggtgatgatgtcacctcccattgtgtcctggtgacgatgtcatctcctgtcgttaggaaggcgtcctggtgatgctgtcacctcccattaggaaggcgtcctggtgatgatgtcacctcccatcgtgtcctggtgatgatgtcacctcccatcattaggaaggcatcctggtgatgatgtcacctcccactgtgtcctggtgatgatgtcacctgttgtgtcctggtgacgatgtcatctcctgtcgttaggaaggcgtcctggtgatgctgtcacctcccattgtgtcctggtgatgtcacctcccatcattaggagggcatcctggtgatgatgtcacctcctattgtgtcctggtgatgctgtcacctcccgtcattaggagggcgtcctggtgatgatgtcacctcctattgtgtcctggtgatgctgtcacctcccgtcattaggaaggcgtcctggtgatgatgtcacctcccatcgtgtcctggtgatgctgtcacctcctgtcattaggagggcgtcctcgtgatgatgtcacctcccatcgtgtcctagtgatgatgtcaccacccgtcattagcgcattctggtgatgatgtcacctcccatcgtgtcctggtgatgtcacttcccatcgtgttctggtgacgatgtcatctcctgttaaggcatcctcgtggtgatgtcgtttcaggtctttagaagggcttcctgttgcgggctggttgggtttttaatacaaggtgtctttccaacactgcttctctagctcttcgaggccagcaggtgcctaaagttcagtttgtttctgacgctgacgacccacggttgtcatcaggccttgagtctaggggctcagtcccaccaggctgccctcatctcggacccccaggccacctcactgtccagcttggccacagtgttgggggtccccacacacagacttgtgcagttttgataatctgctgaatcggctcacaaaattctggaaaacgtttcactcagcaataccagtttattttaaaggctcaagaacagccgaatgagggggcgcctggggcagggtccagaagggccctgagcatggcacgtgccctctggaagctctccgtcctttcatctgtggcgaaggcatagctgatcccacacgctgcccacttgctcctgcgaagcctcctaccctggagccgctcaggcccagcccacagccactctcaccactgcggtgatcccagggactgggaacaggtctctttctgtaacaccagggcttagtgctttggtgctactcttacttctttatttgacttaattaattccaactctccagccagttgacaaagctcctggacacttctgagaacagcagggcggaacctggcctatgggattgctgtgggccagtcagtgaacgggccagcaccacctagagcagaaggatgtggagaccccccgtctaggaagtcagggtctgttctgtactgtcattctaatcagtagaagcacgatggcaggacagatacgtgcactgaagtgatactgctgagatttggtttcgaaattatgtgataatttaaagcagccacacgatcagtactgcgaacagcacctgttctttagacgctgcttttcatactgttgaataaaatatccaggggggtggctcgcactgtagtcccagtgctttgggaggtggacccgcaaggatctctcgagctcaggagttcaaggctgcagtgagctgtgatcgcacccctgcgcttcatcctgggccacagggtgagagcctgtctcaaaaaaaaatttttcttaataatttaaaataaaatcacaaacctttgacttattttttcttcagtatttttatttatttttttttttttgagacggaatcttgctccatcgtccaggctggagtgcagtggtgcaatcttggctcactgcaacctccgcctcccaggttcaagcaattctcatgcctcagcctcttgagcagctggaattacaggcacgtgccaccacgcctggctaatctgtgtatttttagcagagatggggtttcatcatgttgctgaggttggtctcaagctcctgtcctcattgtcttaaactacataaagtggttaaagattagatacaaaactggtgttttaataattcagccttgcttgaagtgagctaggaatttctaagatcaatgagaaaaaaataattgttatctgaaaacagacttgcagatggtaagctggatttgaatgaagtcaaacacttttacttgaatgacactaataacatggcagccgataactgtgtatgtgtgttctgaaatgtgtataatttacgtgaacagcagcagttcagtttcgaatggcacgtcataaacaactgtttagctgtgccttccgtgaggaagatgcacgctgggctgtagttcatttgaataagtcgacttttgatgaaattttcttctgtttttaatgtgaaagtgtaatttgcaccaaaatatcaatattacttcagttaataccagctcatttatacgaaaggatgttaatgtgatttgttaggttgcgataatcgtcagtttggtggcgggaagcagcgttgttgtggctgcagcagcgggccccctggtctgggtgattgcaggctggatgcatctttgtcacgttaaggaaatgtctctcccttcacttgtacgtgttggaaactgagttctcctaaaatgagcctgggttctgctttttgatagttttcaaaattgatgaaacgacctacttacatcagaaaaaaggaatccctgtttgaatgtctccctccccaggctagacatagtgctggaagtctgaggaaacgggaccagccggcaggagttctgcggggccttcgtgctgcggtgaggacctgggcctgtgtggattggccacgcctctggtcccaccctcccttttctccgtaggcctccatcttggaggaacagtagagtgttttcttctggtttaatccaagagtcccccctgcttgtctgagttcatgtggcgcctgcccagttccctgcactaaatagacctgtgtccgcaatgccactccacgtgtggacccctagtgcctgcaggaccactccacctgtataaacgggtccagcgtggtctcctgcagccaccctcacacgcttgcaacagcactggtgccctgcagcccagttcccccatggcactcctgtctcacggagggtcccacacctgagcagccccaggcctcatctgtcacgggcattggttgcccgattcccccatggcatcccgtctcacagtgggtcccgtgcctgagtggccccaggcctcatatgttgtgtgcattggttgtgctgctgtggaggtggccccgtctccccaccctcctgagagtggtggttcctcattctgttctcggaaccccgtgcagaccccattgtgacaggacgcttggcagtgagggcagttggcccttcgtccctggactggtcctcatctaagtctttgaacgttgtacgttttttctaattctggctttgacctttttggtgctgggctggcaggctggctcactggggacctgggggtgagtgggaacattcagttttttggttagactttttgagatatttgtagatatatatgcagtgataatgcagagaggccctttggaccctttatcctgtttcccctgtggttgcctcttgtgaaagtggggaacaggctcaccactaggacccacacagactcatccagacacagaaccctcacaccagctcccctgcggcccttcatggcctcagccgcttccccttccctgacccttggccctccacctgctgtccctccctgcaccgcgccctctccggagtgctgtgtacggcaagtcggcaaccttctggagttggccctcctccctcagccagttcctggagcacctctgtgcccctcattcatgtccttctcttgcggagccgggtctcatggtgtgtggtggagccaactgtggtttcaccgttcaccctttgagggatatttgggttgtttccagcctttgctctaaatgtttgcacaggttgagcctctcatccgaaaatccaaaattgggaatgctccaaggttcgcatctttctgagcacgaagattcgcacctttctgagcactgacgtggccctggaaggaagtgctcatcagagcattcggatttggggtcaccggttgcagatgctcagcccgtaagtgtaacacagatatttcaaaattcaaaaatccaaaatcggaaacacttttggtctcaagcatgttggatatgggatgcttaacctatctaagtttttatttctttgggataaatgtccagtggtagatacagttgctaaattggatggtgagtgtgtgtttagctttttaaagaaactgccagacctttttctggaatacctgcatcatcatttcatgttttcagcagcggtgagtgacccaggtggcgtggccagtgctgtttattgcagccattctgataggtgtgtcctgagctggttgtggctgtaacctgcatttccgtggtgaataattacgcatcactcctgtgtttgttccatctgctagtccttggttggatgtgtggcttacaaatcctttcctcccagtcagcaacttgagttttcatcctctagagggtctttggcagagcaaaagttattaattttcacgagattctatttatcacttctttcttttaggaatcgtgcttttgctgtgaagttaactagtagcccagtcccagatcccagagattttcttgatgttttatcctaaaagttctatagtctttcatgcgacacctcagccccagatgctcttgagggtggttttctggccccagccgcattgtcgccggcgccgtcctccctccatggctgcttctgccgcagcgtctcgagggcactcaggtgcacctgtgtggtctgtttctgggttttctgcccgtagatgcccttgatcaagttggatttcctgttttctgtgagttgttatcaccagtgggtgttgaattttttaggagtttgttgattgatatgatggtgtgtgtggtttttcttcttttgcctgtcagtatgtggtggtcacattgactgatttttggacatgaaaacaaccttgcaccccagaaacaattcccgttggttgtggtatatagtaaccttgatgcgcttctgtgaagtgtctttatgttgacgttgaggggcctgtggggctgcacttgtcacgttgtgtgccgtctgcccccaggtttgctgtggctcccgtgatgaggtgggaagcgccccaccctccagcatcactggtgagactgcggacttgccccttcctttcacatattcgggagaattctccagtgagaccgtctggtcctggagattttatttttgcaaggtttaaaatttcatattcattttccttaacagttacagggcttttcacaggacctgctgcgtttgggtgagttgtggttgtgtttttgaaggaattgctccgcttaccttctctattttttttttgtttgtttttcagcctccttatttcgtactttccttctgcttgctttgggattatttcttatgacttttgttttgacagtcaagtgtggtctagagaactcgagcggagtctccggtgcttgcccggattcctgcttccgtcctcacgggaggttccctcggggtcccttccctcccgacctgacctggagtgtccatcatgctctcggagcaggcctgggccctctccagtccctcccttgctgggggacgttttcacaggacaagactctgggttgatcttcctttttctcggggcctgaaaaacatccggcttccttctgggctccgtggttctgatgagtgatcttctgtctttgaccgtttttcctgtaggtaagctgtgttttctctttcactgccttccaggtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctgccatgctgggacagcagggacacggatgctgaggctttttgtatctcgtgcgtctctaagctgtgttctttttcctgttcagctcgttttctctgttgtccaggttgggtgacttctgttagattttcgggttcacagccttcctctgtctccttcatttgttgctagtctgtccaggacattttttggttttagtttttattttctgtttataaaatgtctgtatcttctatttctttgccaatcctttctgtgtttttcagttgtttcaagcatacttgcaattgcctcttgaagcatttttatcatggatgctataaaatcattgtgaattttagcatctctgccctctcagcttggcccttgttgattgtccttttctccatagtttgagatcttcctggttcttgctgtggcaagtgatactggattgaaacctggacctgtcacatcatgttaggagactctggatcttatttaaaccttctcccatcactgattttttttttttgggccatgctccagcagcaggagtggaggcccccttgttcctgccatttgggataggagtccagttccccacacggcctctttttgatgcctgagagtgggggatggaggtgacgaggccattgctggtggacggctgtgggggatgggggtgacaccattgctggtggacggctgtgggggaagggggtgacgctgttgctggtggacggctgtgggggatgggggtgacgccattgctggtggactgctgtgggggtggggtgacgccgttgctggtggatggctgtcggggtgggatgacgccgttgctggtggacgtctgtggggtatggggttgatgccgttgctggtggactgctgtgggggtggggtgacgccgttgctggtggacagctgtggggtatgggggtgacgcccttgctggtggacggctgtgggggctggtgagaatcctgaccttcccgcgtgggtgtgtggggcctcattgctgccggtggggttggatgtcaggctcctccatggccttctctgagaccccagaggtggggtgtttggcgggagtagagcagttatcataggtttttaacatttagttgaaacatttaattcagtttaaaataacagtgcagttggccctttgaacaacactgctttggactgcgtgtgtccagttgtacgtacatgggtgtttcagccaaatgcaggtgggaagcacagcgttcgcggtgttcgcgggatgggaagcgtggcgttcacgggatggaaagcgcagcgttcacggtgttcacgggatgggaagcgcagcgttcgtggggtgggaagcctggcattcacggtgttcgtgggatgggaagcgcggctttcgcggggtgggaagcgtggcgtttgcggcgttcgtgggatgggaagcgcgtgttcacagagggccgccgtgaagagtggactttgacaaggcttgggaagtcctgaattccaaacagcgcagatcagcactttcagatttctgggcagaaaatcttctctccattagtaaatagcctaacatggttgtgtctttttagttttgtgactttgacttagtgcccgttttccttcaccaggatgggttttatcaccttcatcctcgtgcctgtcccgagcgagttggtatctgggacgcacgcttagtgcctcctggtctcatcctttggtcatccagggaagaaccagcagctagaaacagccgcctctcaggagggccgcaccacccctttcccagaggcttgccttaaattccagcagtcagaggcatgcatcagaatatattaataagattgacatatccagatcgagaaagatgtgtacagaggagagaaactatttcaaacggagctgcggtttgaacatagcagaaagatccttgaaacagaagattggccctttctagttgatttattacattaatatttaactatacaagcacaagatttacctttttctgttttttcgtgaattttttttttaaggtggagtcttgctctgttgcccaggctggagtgcagtggcgcaatctcggctcactgcaacctctgcctcccaggttcaagcgattctcctgcctcagcctcctgagtagctgggattacaggcgtgcaccaccacaccgggctaatttttgtatttttagtagagatggggtttagccatgttggccaggctggtctcgaactcctcacctgaagtgatccacccgcctcggcctcccaaagtgctggctttacaagcatgagccaccgtgctgacctgtgaaatgattttaatttcagcccactgacgtctgttttgtcacttggccgttttttgtgtctgttttcgtagcctggagatgttgcattttcttgttttgtgttttgccgtgtagctctccggaccctattttgagggtgaatgacatgtcctgggggttcccagaacacgcttcatctcccgtctctctttgccctttattctaagatgccagagcctggcagatgctctctgccccacgggggttttgtggataaaagaagatgggtgttatttttccacaggatagtcagaaacgtgttttgccagtcaccctggctcagttagcaaattctgatccattaacctctgaaaagtgtattggcgaaacatcacgtttttcatacgtgttccctgttggggtgtgtgagtgtttacctagtccgagagccaggagtctgattcggtgcggaaaagtgccattcgaactgaccttcctcatgtgggacctatgaaattcctttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtgagccaaccccacgccccggtgcccgcgccagcgctcgtgctggggccgcagagctctggtgtgcgggcggattgctgagctgtgcacctggaggccgagctagagtcctgcacttgtgtagttgtgtctggtttgggacgagcacttgtgtttttcacgcaacttcctattcaaggagacctagaacagcattaagcaatgtgtccgcagtgtgtggcatgagaacacgtggaagttgtggcttaggattcgtgcctgcgtcttcaccaggaccgatgccgcccagcccctccggctctcccggctcaccccaaggacatgggacggggtctggaggcactcatggtcatgacaaggggtgaccctggggccggtcaacaccccctgcctgacgccgaccggcccccattgagaaacgctggagggctgtgtgttgcacgtgggccttaaacacacgcacacagagtgactggtgattctcacagcatctcgttatcacagcgcgaaacaactttaggcagcatcggtggagctggggttttctcagccgggtcctgcttggcccctgtgtcctgggccccttggcccgtgtgcttctcctcttgggtcccaggccgccccctgatagaaggttccacaacagtccggatgttagggatgggcgatctgcgcagcaccgtccttcggagactgttctttaggaggactgtcctggaaaaccacatcccatgtcctcctgtaaggtgccctcatgggtggcgcctgtgtggggtgctcacctgcagctggtcagggcacaggccgtccccttccctcaggtcttcatgttcccaccagagcctatcctccctgcccgcctggcaccgctgtcctctggagagagccaccattctgtttgcatccagaaggcagcagaggttcttgaggaggaaaacagctcctgtgtatcttcaacagtagcagaaaaatgcagatagttctattcaggacagactcgtctcagtaactcaggtcatcacctttagacgccagtttatcttgtgaggatcagacccttttttgaggtgtgctgaatttctctgccatttttctgtctttttgaacattagctgttttttgtttcacaaaaatgttttctctaaaaaaaatttttctcagccactacctgtaagcccagaccactttatttaagattccagaaggttctgtataaggaacagtcacctgcctaggaccaggggtgggaggagaggagggagggacgctgcctcttcctgcctggaagctgctgacacgtcccgtctccctcctggtttcctggtcgggcgtggaggactcggggtctgttccccacgcagtcctgtttcaggcagtggtgacaactggttcttagtcattcgatatcaaagggggttgaattctcaatgggagacagatgtcttgaacgcactcagcagctttcagccaccccaaaacctaatcctttctctcagaaataaaaagtaatcgtaaccccccagatgtagctctttgggaacaaatggtattgaaagcagaaggctgcagccgtggattgttctgtgcatgggagagaggccagagggttttatgttcgtgaatttttaaagcctccttgattctctgtgagtcctgggcccttaagacaatcagcgcctgcaggcaggagaaggggtcagaggagccccggcgccaaggacccgaggcctctggaagctggaagatgtgaggaagggattctcccagtggacacctggattttggtcctgtgaggctcatgttggacttctgacctgcacagctgtgaggttgtgaatttggatcttttgagccgtggcgcctggttattacagcagcctcaggaagctcctcgtggcctggccctggcctgacagcctcgtctcacatgtgtccctcttccactccatgtgcttggggcagatgaggcagcttcaccccagataagcctgtctctcgggcccattgcctgcacccccccgtgggcctgtgagacggactaggtacctgcccccgggtgctccctggaggctgccgtggcccctcttcatcctggggacacatggggtggggctgctgctcgttttggggcacagacgatggggagtcaagaggatctggaaccagggtcaagtgcagcccgtcagggggcctttgagtgaggggtgtcgagatctctggccatttccggcgcgtcagtgtgttaggtgggcattggctgctccagtggtagaggaagggtctccacgtcgacagaggagaggcaaagttgctgacccaagagtagcacctgccgtgggggatgctgctcccacccacactgacaagggcttccccgcccctcatgtgaggagcagctttgagaactcgcgcctggtcagtgctgtgggaatgtgtgcccagttccttgagacccagtaggcatctggatttcttctcgggtttaaaccacggaggcttctacagctaggagaccactcacttgatgtcactgctttcaaggaaaacccgtccccgtgtagcacatgcttctgacctccacgtccagaacatgcctaagcagagcgaggcatggcgtcagtaagcgttcacctgcaacggctttgaagaaacctgaaagccatgaaaattaacgttgtaattttatcttaaccatttttaaattctgcatttaatatacgtggaagccaagaaatatgatgaccctgataaaatgcctcaagaacagaggccgggtgtggggccaccatcaccaggagtgctcccaagatcacatgagatgtaagaactcactaacatcaggagtgctcccaaaatcacgtgagatgtaagaactcacattaggagtgctccccaaatcaggtgagacatgagaactcactaacatgaggaatgctcccaaaatcccatgagatgtaagaactcactaacatcaggagtgctcccaaaatcacatagacatgagaactcgctaacatcaggagtgctcccaaatcacatgagatgtaagaacttgctgacatcaggagtgctcccaaaatcacgtgagacataagaactaacatcaggagtgctcccaaaatcaccagacgtaagaactcgctgtcatcaggagtgctcccaaaatcacatgagacttgagaactcactaacatgagaagtgctcccaaaatcacagacatgagaactcgctaacatcaggagtgctcccaaaatcacttgagacatgagaactaacatcaggagtgctcccaaaatcacgtgagacatgagaactcacatcaggagtgctcccaaaatcacgcgagacatgagaactcaggagtgctcccaaaatcacgtgagacatgagaactcacatcaggagtgctcccaaaatcacgtgagacatgagaactcacatcaggagtgctcccaaaatcacgtgagacatgagaactcacatcaggagtgctcccaaaatcacgtgagacatgagaactcacatcaggagtgctcccaaaatcacgtgagacatgagaactaacatcaggagtgctcccaaaatcacgtgagacgtaagaactcactgtcatcaggagtgctcccaaaatcacttgagacttgagaactcgctgacatcaggagtgctcccaaaatcacgagacataagaactcactgtcaccaggagtgctcccaaaatcatgtgagacgtaagaactccctaacaggagtgctcccaaaatcatgagatgtaagaactcagctgtcaccaggagcgctcccaaaatcatgtgagacgtaagaactcgctaacatcaggagtgctcccaaaatcacctgagacatgaaaactcgctctcaccatgagtgctcccaaaatcacaggagatgtgagaactcgctaacgtggatttttcttctggaagcgactctaaagcatgcacccccacacagtccctgagtctcctcgtggtgggcgtggccaaagcactgtgcctggtgactgtgtgtgaatagcactcagtcctcgtgctgtggcctcagcacaggacgaatgtgtgttgtgtgtgtggatcctcacgccacggcctcggcacaggacgggtgtgcgtttgtcgtgtgtggatcctcacgctgcggcctcagcagaggacaggtgtgcgtttggcgtgtgtggatcctcgcgccgcagcctcggcacaggacgggtgtgcgtttggtgtgtttgtgcacaaacacccgcctgtctcagccagctcacaaagagactcacacccatgtgtcggtccccctgcaggttcctgtgtgatcatggaactgcggggaagggaaggtgccggaaccagggctgggagatcactgagggttgaggtggggcccgtctcctgtacacccctgcggaaaagcctgctgggccccagagccggcgtccgctgcctctgcagctgcgttacctcgttcctgcctgttctgctgggccccaaagccggcgtccgctgcctctccagctgcgttacctcgtttctgcgtgttctgctgggccccaaagctggcgtccgctgcctctccagctgcgttacctcgtttcagcctgttctgcttctcatgctcaggatgctttcccgaccttgctctgtgtctcttcttgtttcccgtcctctctcttgaagccgtcccacctcactccagcgcagagctggggagagttttattctgtgatccagggtcgtgcaaggaggttggtagaaacatttcatttccgtgcattgacaggataccgtagcatctgctgttatctgtatttgctctttggtagaaattccaacacttaggtatgaattcacttgtgttttttctctttacatacttttaaattttccttaagattaaaaaaaattatgttagcatgttttaagtgaagtaaatacaaacgaccctcaactttacaatagttcgcttaacaattttctaactttacaatgatgtgcaagtgacgtgtgtttcgtagaaaccacactttgaattagaagtcttggctcagaattctgtagaacagcttgttccaagtcggccttgtgctggacgactttgccagcgatggggtaatgtctgagcgtggaaggcggctgggccgggtgtgctgacacgttttcagcctgtgatgggctcatctggacgtgaccccatcctgagtcaaggagcctctgtaatgaagaaaactgtttttcagaaagcgcagtcaccttttttgtaaaaacaagcccaggaaaggtaggtgtcgttcccacatcagtgtgtttacacgagtcaggcagaaagagggagaggagatcggaggagcatgatgtaggcgaggtcaggttttaatgtgaatgtgtgcccacgtttctggcttggctgtgcaaaacgtacctccagatcttccagatagcagcacgggggcacgtgccgggctgccctgcctcaccagcgttggcacggacgtctgaggccctcccaggtggggcgccacactagcgagggtccctcgggtccgtgggctgccgtgctggccggcccgcctgcccttggctgtcaagtgtaaaataacagattttaacagtgccttgtttttctctcttgacaaggtatgatgccgtgttaaaggccctaagtatttcagaatagaatttagtagaattattcccgtaggagatttgccatcgaaacagtaaattcagtgatgtaagcattctggtgaagtgtgaatattagtaaccttgtcgagtaaccagatgctcttattaaataccattccatgccagcgtccctgggaacatgttacttttagagatcattataatgacctgatgataaagccgctgccttagctaattaaccattggttaaaatgtttctgccttttaatgattcaggccagggcacatgtgctgtgactagctggacacgtggcgatgagtttgaaattgcagagtggacggggtggatgcgtcggcctccatgtgggctcgggggctgagctgtgatttctgatcgaagcggcttcacaccgagtctctgtgactctggactcggcctcgactgctccgaaccgcgcctgtctcgggagttgtgctccgtcctctgtggccgtttctcgtacctgctgcgggggtggggttaggtcggcgtcggtgagtgcccctcaaggccccagccaggtgtgcacccccagatccctcctgggaaacagcctgcgctgggggactgtggtcaggccgccccgcctcacctgcctgtctcagggaccacggggctgtgccgtcgcacacagacgccctcaacgtcggagagctgtgagcggggccgtgctcttgggatgggagcccccgggagagctgcccgccaacaccactccgacgtgatccatgctggacataaagtgctcttccctccgctagtcatcggccgagcgggcccctcgctcctgggtgtaagttctttctgtgcgtccttctcccatctccgtgcagttcaggagaggaggggagaacttgagttcacctcccggcactgggctcagcctctcccgccgccacatcgaggcactgacggtacccacctcccgcctgctgaggttcggggaggctgaggtttggatgcggtactcccatcacctgctcacttgcctgccgcctctgttgccactcccgtccgcgtcacacgtgtcaggcgtggggccggctgagctcaccccaggtgttcaggagtcgccctctctgcatgtttcccaaattggaggcgtgcccagagcgagcgggtggacatcttagcgagcgtccctgtggcacggccacgtctccacccccaggtggctgctctcccagattccaggatgggaaggactgggacgcctccctgaaagccctgccactcaggagtcttgctgtgaatctcattgatcttgaaaatttcaagcaaatattctgattattcaccataaaatccaacagtgcaccaggaataaagtccctgttcacataagggacagaaggaatttaaacccaatctttgcctgcgaaccgactgggtttgctctgtggatttccaagcgtcttttgcccggggctttgttaaggattggttgagtttcaagccccagggctcaggtagaaagcagagtgctacctccagcccccaccctgctgcactcagagccctggactctgccgggagaagcctgttgcggaggaacggggcccgggaaggaggtctgtcgctgactcttggctgtttgtcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccaggtgagtgcggggtctgaggtgggaggggcctgacacgggctcccggaggtgactctgcagttggtgggccgcctacctgcatctcattcttcacgccctccaccattctgtgtgtgacaccagcagcttccaaactcagcagcccctggtgatggccacttggttgtctccatgctgatccatgtcatcttacatgtgtgcaggcgtgtgaggtgtgtgcaggtgtgggggggatctgtacatctgcgcaggcgtgtgtggggtgtctacacgtgcacaggcgtgtggtgggggtatgcacgtgtgcgcaggcatgtgtgaggtgtctacaggcgtgtgtgaggtatctacacgtgcgcacaggcgtgtgtgggttctgcaggtgtgggggggtctgcacgtgtgcacgcaggcatgtacggggtctgtatgtgtgcacaggcgtgtgcagggtctgcacatggcactgctggtcaggagccagcgtcctgcatgtcgagggtggtgcctgatgtgggtcccccgccggtgacagtggtccccgcctccagcgtgcggtctgtgggtgggaagagctgagcaccgtggtttgctttgcgcttccttcgccatgaatgaggcctgttttcgggcgtttggccgcaacagcgcactctaaacgctgctcacctgctccttgtgactggtcagtgttttctgcattgccgtgaaaggtatctttttgtcacctttaacttggatgacatttctgccatgcagagatgttactattgtgcagatcttacagctgcttggttctgaatcttgtccgagaatcttaaccctgtgtcttttccttggatgcgtttacgtttgaccttttctacatatgaatctttgtaaattaagatttattttttagtaagggggggatttagcttttttcccagatgattagctcacggtcccatcgcagtttctgacatcatctttctccactaatcggctttgttctctggatctctgtgctgctgtcgaatggtggggaggagccggtttgctttgagacatcttttctcaggttggtcgatgaacaggcatgaaacccagggtgtggagaggtccccgtcccgcatcccccatgcatgtccttgtgtgaaaggcagccacctcactgcccggttctgggtggtggcggagacctgccgtgccgttaggcattttgggtgccgtctgttgattcttagcgttcaacatacagactgcgtctcttcttgcctccgccctgccaatatcaacacgccaggatttgggggtgtggaatgacgcagtgtttcctatgaccgtaaattgcttttaccaaatagaataggacacggtgatgctgttccctttcttaaacatctgttttacctggatttgataatcacctcacttttgttagctttcttcctttttgcctgtttctgaatccctggctgcctctccgctccactcccccggcctcccccgcaggttccccgcctccccccgcccgccctgctcaccgcccccgggagttgccttccccactctctggggtgttctctgtctctgcattttggtggagtacatctcccagaagcttcctgagaaagcgtctgtcctgtccatacgtccgcagtcagcgggctgcgtaaccccaggtggcagcatctccttgaggatttagaagcacggctcccgtcttcagctccggggctgctccgaggccgtccgaggtaacctcggaggctttgtcttgcccgcctgttagacaggatgtggccctccaggtcctgccgacatcctcagtacagacttgtgtcccgaggatttgccctgagaacttggtctccagagccttcttgcatctgctgcggggccgtgggccggtatttggacctctgcatcctggtttcctcacctgtgaaatgaggtaggagcagcgccagcctcggaggagctgctcccagcttcagcaggctagcagggggcactccaggtacacgtctggtgtctgtggtgaagaagacagtgcagactgctttctttctccccacgtctggtcttactcttaggctctcctgtaggtgaataaacagcatttcaagaaaagagcgtaactcattcaggcaatccagttacaaaattgggccagaaattccagcaacagatgcagacaagacaagatagtcattgttccgtttgcaggaattacttacagaaaatcacttgatttgcagctctgtggtttagcagggaaatgagtgcagcttctctcctggcaacccactctgtgtttaccacgtagaaagcagcattttccagctgtgttgaaatgatatgaagttgttttaggagagattttgaaattccgtattgggtgataacaagccttggttcttcccacatgaattacggggtggttttgcctggccgtaccttccttcacttttcggtgtagacccattgggtctgtcatgaagctctggggtcaggcctggggaaggcggtgcactgggggcctctgggagggttccactgccctcccctgaagaccctctagcccggggctgagctgagccagctccaaggagtctgtctgccgtggccatgttagtatctgcggatttgcagcgtgctctttgtatgaacataggtggtttaacctgatagtttttttttctaattaaaagaagaaacccaaagtgcttttccactaagaccagtcagggtgttgctggcggccagccacgtcatccaggatacgtgctgcatccgtgtctccccctgtgggcaactggatgtggcgctcagcgggtcgggacccagagctgctgaagacttgggggccaggactggagttagcacccctgggtttttgtggtttttttttttttgctaaatgacctgcgcacggcagaactgaccctcacgggtgaaaccacgcaagcacgattagagaaccacgcaagcacggaactgaccctccctggtgaaaccacacgagcatgattagaaaacccctcggctctggcgcggcttccatgctgccctcccagctgcaggaggtggttggggttctgcctctccattctggctcctcgggcaaggaccagatcagtactgtaattgccgtttcactctatgtcttacagactcggtgggcttgggtgatttcagaatttgagatcaggagaataaagtgtcctgggagtctgttcaggttctgctgcgcagccttcatacccgccgccaggacgggtgggactctcatacccacggccgggacgggtgggactctcatacccacggccgggacgggtgggactctcatacccacggccgggacgggtgggactcggcgcttgctccctgcctgcaccacgcctgccgtttgcggatcgctgtggacgtgtggccgcgatagcagcctgactgctgggggccgtgtgtgcccctcaaaagggtggggcggtggggtcttttcagcttcctgtccagctgggtttttgtgactcttggactttggggacctcacttcttccttaaagaccagggacttccagttttatttcattcctgtttatggggtattcagtgagatgtgaatgttttgaaatttttcacatgaaatttttgcttgtaacgaagtaaatgtggtttgagttttttatttttgcatgttgaacatgtaggtttcatcatgattctttcccatgcgtggcaatgcgtttcgtacagaagctggaggtcactctgctctttcctgtcagtgctctagctggtggtacgtcttgctaatttcgcatggccaagctgttccacagaatcttaatgtcagttgaacttgaaaatgagttttaacataagggggaaggttgtgttttttacttgtctaccaagagtgattcattcttctctcaagtcaacaaacatcagatgcctgttctatatgcagccgcctgccgggcactttcactccttaaaataaatcctcaaaataaaaaaccaaacaagtcatcttcagaatgtttaaggatctcacagacacatcgtcccaacaccagttccaggtaccgaaaagaacaggcgcccaggtgaggtgaggtctcctgcacaggttgggtgaggtcccccgtgcggttgatctgtccctgagtccctgaggtcccccgtgcggttgatctgtccctgagtccctgaggtcccccgtacggttgatctgtcccttagcccatggttgggtgaggtccccgtgtggttgatctgtccctgagtccccgaggtccccttgcggttgatctgtccctgagcccgtggttgggtgaggtccccgtgcggttgatctgtccctgagtccctgaggtcccccgtgtggttgatctgtccctgagcctgtggttgggtgaggtcccccgtgcggttgatctctccctgagcctatccttttatgcttttggtggccggaggtgaatcatcactcacaaaggcaactttaaaatataccatagcctctttcttcagatcattcctagagttcgcggagaagtgaaaacgacattgagttaactgccaagaaacatagcacagcatggtgggagctgttatgttactggcaagaagatgagctggtcgttcccatgatctgttgacagagacaacagctgatgatggctccctaagtacttggagattttagtcctggtgcccccgtttcctgtcccatctggtgcagtgataaacaggaaaggaaaacagcaccacgttttaaaggcttagtttcctgacacgagtacccagatcccaacactcagctcttctccacaggggtgtgtggtcagcctgcgtgggagacacagggcggcaggcagggtccttctgaggttcacctcctcttgtccgtttgggagggttgcgtgagctcccactcttagacaacagggaatagtgctccaccagaaacactcacacatcaaagttgtttttaatcttggataattaactaagaaagataatctttaggagagagaggagcagaaaaactattcaaagacataatgactgaaaactccccaaatgtaatggaaaacattaatttatacatcccagaagcacaacaaactccaaataggatgaacacaaagatctttacctaggcacatcccagtggaagaggaaatgccgggagcagggctgggggcccagaggaagcgtgaggcgtcgtgggagagaggcctgggggcagcagaggaggcatgaggtggaggcctgggggcagcagaggaagcatgaagcatgagagagagagagagagagagagagaggcctggcaccagaggaagcgtgaggggttggtggagagaggcctgagggcagcagaggaggtgtgaggtgtccacgagagagaggcctgagggcagcagaggaggcatgaggcgtccatgggagagaggcctgagggtgggagaacccatcacaccacagccgcttctcctcagagatggcaccaccacacccaggcccctgtatccagcaaaacaacctttcaaaaacaaaggcagggttttcccagacaaagtgggaattcactagcagacgcaccttacaagaagttctaaaggaagctcttcaggctgaaagcaggtgacttagatgaaatctgaatccacacaaacaagcaagcacgaggaatgcagattatgtaactctgtaaggtagcgtgttgcttctcctttattctcttgatttaaaaagcagtatagttttatagtataagactctatgcctgggcatgtggtggctgtggctcacgcctgtaatcctagcactttaggatgccgaggtgggcagatgacttgaggtcaggagttcaagaccaacctggccaacatggtgaaaccctgtctctactgaaaatacaaaaattagctgggcatggtggtgcacgcctgtaatttcagctactcaggaggctgaggcacaagaatcactagaacccagaggggaggttgcagtgagccaagatcatgccactgcactcccgcctgggccacagagcaagaccctgtcacaaaacgaaataaaacaactctttgtacctaattgtattgttgggcccataccatgtggagatgtaacatttgccagtagccgcgccgaggaggggcctaggattaaatgacagcagatggtgactggaatttacagcaagagctgaagagacccaggagtgctgaacaagaaggttggtctcaccgtgctccgagtgtgcacctgttccctgtcctgctgtaaataattacaacgatgcattgttgggtttgtagcatgcatggatgtggtatcgtacagtgaagcaaggccgagcacggtggctcatgcttgtaatcccagcactctaggaagctgaggcgggcggattgcctgagttcaggagttcgagaacagcctgggcaacatggtgaaaccccatctctactaaaatacaaaaaattagctggacatggcagcatgcgcctgtagtcccagctactcaggaggctgaggcaggagaattgcttgaacccaggaggtggaggttgcggtgagccgagatcgtgccactacactccaccctggacaacggagtgagactccgtctccaaaaaaaaaaaaaaaaaaacagtgaagcacaaagtgaggagtctgagtgtgcacctgctctcactcctgctgtaaataattacaacgatgcattgttgggttcatggcgtgcatggatgtggtattgtacagtgaagcacaaagtgaggaggggctgagctgtgcagcagccatgtctccgtatcgaattggaattaggccagcatgagtccaaaattgattctgatcaagcgagatatacgtatgctaaacccaagagcagaagctaaggaagtaactcaaaatacatcgtgaaacagatcatacaagtgtgaaaggaggataaaccttgggccccaccatcatgaaactgaagggaaaagtcacactgggaactgctcagggccagcctgcctcccgttctatccaacctcccgcccattctatccaaagccaccctccgctcactgagacagatgcagctcagggcaaacccgccacccattctatccaaagccaccttctgctcactgagacaggtgcagatctgatggcctcctttggagaggctgatcagaaactcaggaggatgcagccatttgtctcttgtctacctgtgacctggaagtccctccctggttccagctgtcccacctttccagagtgaaccagtgttcatcttacatatgttctttcatgtctcatgtctccctaaaatgtgtaaaacagagccgtgccccgaccacctcaggcacatgtcaggccctcctgaggccgtgtcacaggcaggtgaccccaaccttggcaaaataaactttttaagttaagtgagacctgacacagatacttggagttcacaaaaggaaccaaaatgttacattagacagtattcacttaatgcaaaagaaaacagaaaagggaagacaggaactaaaactacatgaggcatgagaaacaaagcagagtggcggtgtgaacgtgaggggattcagagctttaactatgagtggatggacaactgggtcagaggccatcaccgtaggaaagctggagtgttccgctaatatcagagaagactgaatttaaacaaagaatgcttctacaggtaaagaaggacgctttataatgataacggatggaattacgatgctaagagctggatccatcgggaagagtgacagttgctagcacatgtgcaccggaagtgagaaccaactcaccagtggcagaaactgacaagcaaagggagaggcggccatggcgagaccttggaggttcccccgccactcagtcatggggggcgtcgtgggaggatgctgcccctggaggggccacagaccagtcctgaagctcttacaggaacgcaggagaccctggagggtcttgaggaagagcaggccagaggacgcacatcgtgcttcagagtaacggaggctggtgtgatgacagtgtgctgggccgtggagcaggagtgtccatcccagaacagccccatgtccatggccagctggctctcagcaggggtaccaggccactccatgggaaagacttgtgggtcctgagagtggggtggggaatcagaaggtgctcctgggattaggaggtgtccccacgacatgtaagttcatgtgagtttcaggcttttccaaagcagttgtaatgactgtggcatggataatttttgtggggaagatgagtggtcagcacacatacgtgtttgactggattgtgcgtccctcccatgcgcgttgtgtccctgcgtccctcccgtgcgcgttctgtccccgcgtccctccccgtgcgcgttctgtccctgcgtccctcccgtgcgggttctgtccctgcgtccctcccgtgcgcgttctgtgcccgcgtccctcccgtgcgcgttctgtccccgcgtccctcccgtgcgcgttctgtccccgcgtccctcccgtgcgcgttctgaccctgcgtccctcccgtgcgcgttctgtccgtgcgtccctcccatgcgtgttctgactctgcggtctcttcagggtttgccactcgagggtgtcggaggtggaggttgtgttcgttctcccttcacatagcacgcggagttttggtttgtgaaagtttgctttttcgtgttttcatagctacacaaactgcatctcttggaaaagtgagagcgttttgacagctgctgtcactgtgaacaggtcaggaggccctgccttgcccaccccatacttaggggcttaagaaacaaggtctcactctgttgcctgggctggagtgcagtggcacgatcatggctcactggaagcttgaactcctgggctcaagggatcgtcccgcctcaaccttccaagtaggtaggaccacaggtgcgcaccaccatgcctggctaatgtttttaaaatttttttgtagagatggggacttcctttgttgcccattgagaccagcctggcctcaaactcctggcctccagcgatcctcccgcctcagcctcccaaagtgctggacctacaggtgtgaacaccgtgcccactgtgcctaccgtgcctaggggtgttaaagtggtccttggtgcacagggctaaaggctcctggtcgcgtgacttgaccgtgtgctgccagccactctggtgcctgcagtttagaatttgggtacaaagctgctgaatcaaatagtgttttttaatgattgcccaattttaaatgagagacattaatttttttccagtcctttcataccaatacacgaagcagcaattcttaccctaaaataggtcactgaacttcccactttaaagagccccggcctggcagcaggctctcggaggggagggtcaggtgtggtgagcgcccggccagctccctgctgggaagggcccctgcccctcttccacctgtaacacacacaggttcattctaatgccatgagattgctgaggagagcatgacaatgttcacacccagagctgtggcatccccgctggggccctgcgggaactgggactcaggtgcagacgccacggagggagggcaccgctggctctccctgggcccgggcccactctcagcagcagaccagctcttgccgcctgctttccttggcagagcccagccctgtgttgtaggtggttggactgttgggtcccgctgacgtcatctggtgggttccttccaggtccccgcggagccccccacgcttgtgtgaggcttcacctgctttgggcagccccaacgccgctctcacgccacgttccactccagggtgcactggggaaattatccgccatgcgcagcgcctcctgcaggtgtccggtgcgtgcagacctggccacgccggcacgggttttttagtgacgtggcggcctcacggtgagcagcactggtcttcccttttgttcccgcggccacgctggcagtggccacgggaaccctgtgcctgtggattgttccatcccctttggattagatgctggtgtgacacaattgtgcatttgccgcactgacggatatctttccggtgccaaatcgtgtgcactgtgacagcccagtgtgtttggaaaactgaaatatgggggtggggtatacatatatattattctgtttgtattcttgccttattcaatgttgaatttgagataaatgttaaagctgtaaattttccccaaattctatctgttaacatttctctatggagctgtgcagctggttgtatgaacaaaatacaaatattgcatgttatgctgaggaagtgaagctagtatcagttgcggacatttactaaccatagtctgcagctgtgtctaatgttcgaggtaatttttaatgactaaagtccattcatctcgtatttttaaatcccatgctccaaacatcgtttaactaagagcaaaggttttgtgccaccttagtgaggcgctccctgtacttcatcatggagcgagaccgagggtgcggcattcgcagcaccaggagggaccgcgcagggcctggggggacccatggagggagggccgccccagcccgggctctgtgacccctcagggtggaagccgttgacctggtcccagacactcagcctcatggaagccctgaccctgtctcccgagtcagctacgtttttccaaagtgcgtggaggacgtttctcagcattcttaccagcatcgtggggtccaggcccctgctgtgagatggggatggtggcgcctgcccgcaggtttcttgtgaaaatctaaggaagaagcacttagcacagccccagaccacagcgtccccagctgtggatccacaagaaactgttcccagcgaatgccatgagcgcctgcggccgcctcatctcacacaacagcgacagagtcatgatcagaggcctttagagtcatcattatcatgtctgtgtgtgagccgtgactgcctgggagccgtgtctgcctgggagccgtgactgcacatgagccgtgtctgtgtgtgagccgttctgtgtgtttgccgtgtctgtgtgtgagccgtgtctgtgtgtgagccgtgttggtgcatgtgcacagggctctccagcgggagctgaggtggtcccttccgtgggctcggttcaggtcctgtggcaccctgccaagttatgctggcgtttctgaaggtgtgtcctgctgtcaacagcactctgggtgtttttgtcggccttgtgaggggaacatatttctaaacctcaaacagagagtcacagctggcatttcccattctttgccatcctcttgctgccattagaactctgccacggatggcttcctcgcttgattttagaaagaaaagaattgttggaactggttcttgcacctctcgccctccccctcctctccctgcttgccccagggtcccgcctggctctcgtctgccccgtcttcactttcggtcggggcccctgcccctgcccctgctctgctcagtgcccctgatacgtccaacccagcgtcgctgtgagggagtcaaccacacctgccagcacccccgagtctggccccactaggaggggccagggctcccttgagcaaggcatcagcacacaggcagggagccgggcaccagactgtgagggtcgcgccacgcactcccgaggccccgtgcacacgagatccaggcccgccccctcctggacttggtgaccgtcccgagctcgacctgagagggcacttcggctctcctgttcacagtcatgactgccccctccccgaggtcagcgccatgcactgctctgggggcctgaaacgccgcctctgttcgcaagggtctcctgtcccgtccacctgccagtgggttgagctcttccaggggttcgggacacccctcacggcagcaccttcacgtttacgagaactgtctctgtcttgttttgtttcaagttctcaaaacggagtgaggtggaggaagcctaatgggaggatgggagccgggttttcccggaacagccgtcagcgtgtatgcggaggaagagagatgactgatgaatttgttaattgccaaaagcttgttgctgtagcaaccggaggccagactcgtggccctgacagcgtcgttagtgtcagcagagactggaaataaaggaaactcgtgtatgatacgcctggcgtcctcaaagcaaacagcaggcggtgcccagcccaacacaggcacgggcacaagatctgcagatgaggcatggaggggaagcgggcggtgcccagcccaacacaggcacgggcacaagatctgcagacgaggtgtgcagaggggaagcaggtgcacagaaaaggtgcgcggagattttttttttttaagacagggtcttgctctgtcgcccaggctggagtgcagtgttgcggtcatggcccaggctcactgcagcctccatttcctgggctcagaggatcctttttcctcagcctcccaaatagctgggactccaggcatgcaccgacactcccagctaatttgcaacccctcactctcatgtagcaattaaaagtaagcctttatttctcagtagaaaatattcattccagttgacataaaaataaattcgtttaaaacttggacggcaggtattagggcgtgcacttcccgctactctgcctttttttttcccccccgagacagagtctcgctctgtcacccaggctggagtgcagtggcgtgatctcagctcactgcaacttccgcctcccgggttcaaacaattctcgtgccccggcttcccgagtagctgggactacaggtgcccaccaccacacctggctaattttttgctttttttttttttttttttttttaatggggagatggggtttcaccatgttggtcaggctggtcttgaactcctgacctcaggtgatccgcctgacttggcctcccaaagtgctggtattacaggtgtgagccgccacgccctgcctactccgcttttaaatgatgggatgcattgctttttaagaaaggatctcatggatccaggggtcccagtatgtgatgaaagatggcagttcccatcttacagagcgggctggactcagaggcaggccggggagggaggggctgggtacagagggcaggcttgggagggaggggctgggcacagaggacaggctggggaaggaggcactgggcgccgagggcaggtcagggagggagggaggctgggcacacagagggcaggtcagggagggagggaggctgggcacacagagggcaggccagggagggaggggctggactcagaggcaggccggggagggaggggctgggtacagagggcaggcttgggagggaggggctgggcacagaagacaggctagggagggaggggctgggcgcagaggacaggccggggagggagggaggctgggcacacagggcaggccagggaaggaggggctgggcacacagagggcaggccagggagggaggggctgggcacagaggcaggtccaggagggaaggagggagcgggggaggggctgtcatcctacggcccagtgcctgccacctggacaggacttggagttctggggcccttgtgtttctctcatgcggtatttcctggaccacgaacagttgggttctctgaacgagcttgtcgtgactgatcggctgtgtgtgccagcccacggggttctcttgtcttctgttggttccatctgatcagctgattttattccttttgtctcttataaatgaactgtgattcttctaataccagcaagaatggtttcaagttatttctgcgctatagtttgtgtatattagcctcgagtgcatgtgtgttacatgcgtgctgtgtgtgcgtgcaggtgtatcacattaccgtgctatagtttgtgtgtgagcctcgagtgcatgtgtgttatatgcctgctgtgtgtgtgtgtggctgtatcacacataatgtgtcacataggtgtgtatgttagctacattgtatctacgttagctaagaaaatattcttagggtactcacatatggtgactgtccctagtttctctcagtgacttttcgggattgtaactgaaggctagtatggctcagttgcccctaatcagggtaaaatcaaaacaggctgtgcacatttaaccaggcttccacctctaaggttgtagctgaggttccttggcgcagtgggacgtcccagcacggcaccaggagggagggtgtctggcaggacatcaggtggttggaatttcagggctctggggatctcctgggtgtgccccgatcaagtcggctcacgtcacagaaaccaggtgcacctgcagcggctcctaaggaaaacctagtggcactggctggttatgcagaggctcgtaaggaaagcctagtggcaccggctggttatgcagaggctcctaaggaaagcctagtggcaccggctggttatgcagaggctcctaaggaaagcctagtggcaccggctggttatgcagaggctcctaaggaaagcctagtggcacccgctggttatgcagaggctcgtaaggaaagcctagtggcaccggctggttatgcagaggctcgtaaggaaagcctagtggcacccgctggttatgcagaggctcctaaggaaagcctagtggcaccggctggttatgcagaggctcctaaggaaagcctagtggcaccggctggttatgcagaggctcctaaggaaagcctagtggcaccggctggttatgcagaggctcgtaaggaaagcctagtggtactggctggttatgcagaggctcgtaaggaaagcctagtggcaccggctggttatgcagagggctggtgttctctttgtttattaagagtcattttagcagtggcctgaggaaatgagaatttccagaccgtggcccacttgatgagctgggaggtgcttgttcacataacactaatagttactctgacagatgatcttaacttccctgtcctgttttcctgttctgatgtcttctggcatcacaggtgttcatgagcggccggaacgtgcatttgcagcaggtgaacacctgctttgtcagtggtgtcctggtgtgtaacagggctggggcctcttctcctgcgctggggctctgctgtccacacgtgtgtgacgtggccctgggtcggtggcctgtgtgtgtccttgaccagagaattgtgccgtcttgtgttaaaaccacggaagccacttcccaaatgcagaccaggcggtgacccggcgttgtgcgtttgccacaagcatctcacaccatgtttgcttctctgcagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctcttctcgtgggtgtgtggcagcggtgagcacccgcctcctccctcgctgggatccagctccttagctgtgaaacagaaacgaaaaaattcccacggacgggaccgtgtggaacggcagaaatggaaaccgcagaactgcgagcgtgatgatctcagggtttcgcctctgagcataagaaccaggcttgtagctggtattttaaaacggttaagtgtgaagaattactctcttgcattattttcatccttcccttttgtttgtttgggatgcgggggcccgagagctacaggtaggtgctgggctatggccgccgccaggacccctcccggccagcagcctcggctcacgtcccctcctcctcccagcatcagtcccgcagcgtggcggtgggaggctgcacctcgaggccacggcccttctccaaaagcacacactcctgctttccgacggcaccctcccctgaccacagctcgggaggtggcacgtgtgagaactctccatccacaggatgtggctctcgcgggacctccaggctcaggctgtctccgctgggtgtgggacctttcctgtggggttttcgatggaggttggctggggagggaggcatcctcagtgggtagaggaccccggggtcctggtgctgctgtcgtcaagatgcggcgacatggtggcagaggaaaggcaccgttacccagcagcacgccagccccgggtgactgtttcctgtactaactaggttatttgcagcgccgagtgaagaggcagcttcaccacccaacccacctgtgggttctccggggtctgcagtctgaggaggctgcaggatgaccagacgccggtcagggagttcctcctgtccagagaagcaggaggtgaactgggcccacctcaggtccgatttcgccacgagcaagaatgtaagatgaattggacagaaaacaaaaatagatgtacaagttgatacccaaagaaagcagaagattctacagtttatagggaggggcacaaaacgtgcagggagtaatgtgccggggggtgggggcaggggccgatgaacgaggccttgatgctgtgtggagacctctgggaaaggctgggagaccttccctccttccacagtggtttctccctgaaggcgattctgcgtgtggttggtcctgctgggaccaaggtggccccttgttctgctcttggccgagtcccctctggcttcatgggggtgttaatgaggctctgcaaggcctccttaaacacagtgtggaaatacaggtggtgctgcaggggcagcgagaacggggacctctgctgctgggtctggcctaggggtgaagaggacgggaggagggtggcgtggtagctggctgcgcggggcctggtgacgggaggggccggaccgcatgcagcattcaggaccagcgtggccctgggtgttccgcctgttctgaccgtgtggtcgagtgaacagagcatgcaggggagatgcagcaggttctccccgacgcggaagagcaaggggtccccggttcctggaggagcagcgggattgccccaggctctgggatcgcccacgggggcagcgggccagcacccccagccgcatctctgcacagccgtgctgcacaccttctccgtcacgtgttggaggtgggtctcagcaccagcacatccacattgatagcttaaaatgggacttttctcccgcctgtctcactgttggcccgcccccatgcagcggtggggaccccactgcagggactccaagagccccatcctgtcctcggctccagcctccatcagcaccagccgtgtccttgcagccctgactggagcaactcccaaactctgctgcccggcaggtcttctgaccctgcccgcggtgatggcaccctctggaaggctggcccaggacggcacctccatgctggcagcccctgagtgtagtgtgtgttctacacaaaagagccaggaagtcatctgtgatcattgtttaagggactg

SEQ ID NO: 17219 - DNA, 31545 bp, Human
gtttgacaaaataattgttactggatggtggaggtagaaaccaaattgttgtaatctaaggagtgaatgacagaacaagaggacactaaattaaagctctgctgatgaagaaaatagtaaggcagtaacttgaggatgagtcattgtctataaaggatttttattccccaccatagtcctaacctaacatttgacatctatctagtaggcactcaatacctactgaatgcaataatattttcatttatagaccaggtctcctataaaatagtccagtgtttatgtccacataaaacagcacaaaacagattcatcattctgggtgggtagagggattgaaggaaataaagacatttcatattctatattatgttttgggttaattggcaagaataattacttctttctcaccccatccctgactatacacacacccaaattatagattatagaggagaaaggaattaaatgactcctgagaccagaactgcatagtccaaaaaaaaaaaaaaaattcagcaatcttactttattaaaaaattaggcatcaagatgctgcaatttgccttacttacatatttaattgctcttaggttagatatataatatgggaaacctggaaaaaaattttaatggtataataaacgcttacaacctaacattaagtgaaaaaagcagctgccttattgcatatgatctcaatttgggaaacaggaaaaaatataaatacaaacacacatgcacacacacacacaaagtcagaatactataagaaaataaactgaacggtcacagtggctcacgcctgtagttccagttactcaggagacagagacaggtggatcgttttgagcccaggagttcaagacccgcccgggcaacataaggaaactccatctccacacaaaaaaagtaaaaattagccaggtgtggtggctcatgcctgtagttccagctactcaggaggctgaggagggagatcagttgagacgaggagttcggtgatgcagtgagccgagactgcgccactgcactccagcttgggcaatatagagcgaaactcagcatcaaaaaaaaaagaacatctttctattctgaattttcccaattttctacaattaaaaacgctttaaagatctctataaagtcagtcaagggaatttctatctaagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaacgcggaaaacggaatggagactccagcttgttttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggtagcaaagccgagctctgggcagggggcttcggcgcgctggatagtggaaggggcggggaaagccccctaaaagggcgagcgaaagcaagggcgaggtggggtggggtggggtggggttccgccgcgaggcagctggctgcaggctgcgcgttgtgaggggcctgagggggggcggtgttggcgacggcggagacagagacggaggtggtggtggagcagcaggggaaggaaggaggcgccgcgctcagaatccggctgcggaggcgcggctgtgggcctggagttcctgtggtcgcgctgtcccgggcctgagctggaaggtcagcctcccctggggcgcagacgctgacccttcccggggctcctcccctcccttcaccccatcctctggccttagctggcctgaaattaaggccacggtaataggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacgtggtgtaaacaaccacaacctcgttggtgctgcaacgagctggtggagcccagaaacctttcacatgccagtgtgtcatcctcgtagtaacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttctttttttttttaagtttatcgatttattggcgtacaatacagatgttttgagctatgcaagttaaaattcttctgtaaactttttaagtgctgtgaaaaagacacacatgatcagtaaatttggaattttggaatttggcagaaataaagtagttccgaacagggtgcagaagggaattagaaagaggcagatttcgagttcagacagataagactaggtcttaagatcagtagaagtttctaattatactgttcttaatctttcaagagttagtgttattcctctgacgtgggtatacagtattttattagattgtatattgaaattgtctgtcagatttgtacttacagaactccttagatttacacttgacagtacaattttatgcccttcaatacacattgttttacaattccagttgctctttaatattgttgtaagggctatataattcaccttttgaatagctgctcttatttagttgtgatcttatattaaacagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggtgagtcaacttatttattaaaagttattaaaagtgtttggcacgcagcccctcccttctattctactccttacccaggatgaaggatttagattggattgttattttattttttgttaactactctttgatatgctgaagaaagattaacaaccctctattcagtaaactattaggttgggagttatgtagagtatagctgtttactttctattatttgaggattgattattaaaatctactgggcatactgcaaaattaagtgacatttatttttctgtccttgaaattttctacatggctgtataaaatgtttgtgagagatcttagagtactactttcatgcagcctaacacacttatgaaaatatactagcctagaaagtacctcagttttatcattccagataatcagaaactataatacatcacttgtgataaaaagatcaaatgtaatgaaaagttcagagtttaacttacaaaaaagatcctgttgtagaatttttaggcaaaaggtctgtaataccaactgagtttctgtcatttgttgcttgatgttttatgtttagaaagatggttaatagattcagtgatctttaattatactttgcacattggggagaaatgtttgatacaaacaaataagttcagggttaaaaaaaaaagtagctaatttgctttttctttgtaattcagtataatttcagattctcgtgtcccatcgaagtttctagcaagaggactgttgtcacatttccttcttggactcattactggtcactgaaaaccagaagtgagctacatgtactcatacagtaactacatatagattaacaatgtgctgctgcatagtagaagttgatttacaatcctggtatcaagaaattttagagtttaaaaggatctagtagggtttgtttggaagcctttttcataaattcagtcttaacatgaaagcagagtggtgatcctacagctgactgatctcacccaacaccctcgtttttcagataaactgaggtccagtgaggttttgtgacttaatccaggatcgtcaatcaagatagtaaaaccagatttagaccaggtcttctgattcccaactgaatactctttctgtctcacaatagataaaaaataagttgctttgaaatactttaatcctgacttctttattattgaattatgcaacgtaaagacttaacatgacttgtccttgctaaagagaatcatcccattcagtattctgcttaatgtccagttgagttttgagacatttaaatggctaattcttagaacttttataaccctccattagttatttttgttgcacccatctgtcttcctggcaagcaataaaaccttgacatatcatgggcttatgtgcttaatttcaggacagggaagaaaagagaaaatttgggactatatagccagactatacaggtctaatttctgactctgaatattctgaagagaaagaactcaggaagccagtcctaaatcagaaaactacccctcaaaggcttaatggagggttttgcagtttagcaaacccattgctaaggaaagaatacaatagaagggagttggagctattacagaagggcactgctgttgtctagatactcttgtatagtgttatttgtgtagcacatattgttactaatgattaaggtcccctccagctttcagatcttattgttaaactactatttgcatttttcacaaatattttatactgcttgaaccaagcctttttcttttttgctcagttcatggttgacagatcaactaagctaatttttattggatgtagtaatttttaaaagttcctctgtatcacaaattctgtaagattggtgcctgtgacatacttactcttgatttttttctcaaaaaggttaaatattggctaaaataacttagaaatgtcaaactctatcttattatagtatttgagtgtcggtgtattctaaagtaaaaaacagtatttattaaagaattttataagagtattctaaccaaacttccaatttaaataattttgtattttaagttacagcacccagtgtattggtgttgggtgcaaagaaaggaaaggcagtccagcctaaatttattggctcttagcttcctcattgtaagacagttgtgttcattcattgaactaagaagttctctccatttgtttgaagattgataggttggtttctctttattagtgggtgctactattcccaaaaggccttcactttgttagaagtcttctaggaaaattataaaaatattctgtttacatcaaaagagaacaaagagggggaggtactgtagtccaatgtataaacaaaaagaaggtaaaacttttataccttcttatgctgcatcaggagaacagtgaaagtgaagactgcatgcacgttggatgtggtggcttgtgcttgtaatcccaactatctgttcatgttctcatggtactttttttttttttttttaaagagacaaggtctcactgtggtgcccaggctggaatgcagtgatggcatcatagctcactagagactcaaactcctggtctcaagtgatcctctggccacaacctcccaactagctgggactacaagtgtgtgcaccacctcacctagctaattttttttaattttttgtagagatggagtatcagaaagttacctaggctggtcttaaactcctggtctcatgcgatccacctcggcctcccaaagtggtggggattacagggatgagccactgagccctgcctctcatggtactcttctacagcaatctatctttctggcttcaacgccaaagcaatggcacaaattatattgttgcattgaaggcagtctacaatatggataagttattataagttaataaattgcaatactttaagaaagtatcagtaaacaagttaattctgtgtctagttgggagagattatccaagtccgtgttttctggtctcttcctttcattgcctcttgatagtgcctttacaaaggacagggtgcagttttagaagagtttggtgaacttgaaattaattgttagaatgagatttttaaattttgtgcatacatatcaggttccctattgcgtaatatgtaatcagcttctcaattttttatgtaccctaatatttaatcaggttttacatgtgatgcctctatcagcagtcagtagattagtatatttatgtctgtattcaggaatggtataactgagtgttagtatgagtatatttgtatcatgcctaaatttgatatggtcattctctacaattactttccttccacatttcctttctgttgataaagttggaaatctgacatctttacctagccattttatttatcctttatcattgagttctatgtgttctacatttgaaatgtttcagatatctaaatttctttcccatttatagtccagtatcacactacaatttacttgaatattacagtagtcttccatccatttccctgccttatgcatttttttccagttcatcctacacacagccaccaaaatcatgtctaaatcatttttctagttatgtcctattaagaaactactagtggtctttctgctgcttacagggtaaagtagaaatttccttgcctaccttgatgactattctgcttttacacacttaatctcccagtacttcctagcttgtctctactagagccaaattttgtgtcattctcagccacaatatttatggcttttcagtcagtttacccaaaacttgttcatctttcaaactttatcttcctcttccagtgttcccatccacattgataatctcactcctaatttgggtgctttcactttgttgccaaggctggagtgcagtggcatgatcttggttcactgcagcctcaacctaccagggctcaggtggtcttcctacctcagcctcctgagtagctggaactacacatgtgtagcacctttttctatcttttttttttttttttttttatgtagagaaggagtttcaccatgttgcccaggctggtctcaagcctggtttcctgggctcaagcagtctgcctgcctcagccacccaaagtactgggattacaggcatgagccacccaacccatcctactctgtgtatttcaaaaatattttttctgcccctctttttgggaaataataattactgcttctaacagttatgtaacagagtgtacatatcatgccttacaaatctttgctgttaactgtagcatccaaagatgatagggtgagtactctgtaagtctggaagaacaggtcacatttattcagacttctcccccacaatttttaatcaagcacctcccagtaacaagttatttaattagatcgattttaagttgacaacagatgtatcagatgaggaaaaaattgagcatgtgtggtgtgattatataatagaattggtttctataaaccatttatagtattcaacttttatagtattactttttcagatgtatggatatatagactattatttactaattgaggctctgcgaagtgtagtgtattttacaaacataattaaatactatcatttaatatgcctgatactaacatatattaatatattttagcatggtttcaaaaattttaattaggaatttttgccttttattatatcagaaagtatattttgcagtcaggcctcaaataaatcattatgaatcttgtagttgttcctgaacttggagtgttaaattttgaatttgccattttttaaggttccagttttttgctgggcgtggtggcttacgcctgtaatcccaagactttgggagactgaggcatgcagattatctgaggtcaggaattcgagaccagcctggctaacatggtaaaatcccatccctacaaaaaatacaaaaaattagccggacatggtggtgggcacctgtaatcccagctactcgggaggctgaggcatgagaatcgctggaactcaggaggtgggggttgcagtgagatgagatagcaccattgcactccagcctgggagacagagcaagactgcgtctcaaaaaaaaaaaaaaaatctactttttgtgatacgtattttcatatataaaagttttaatttcataaatacttggtttttatagtagccttcttttgggttgagtgatttgggctcttaatttttattgccacaaatagcccacagctggtagttgcagactgtaggaattgtacactggtatgatcttacacaggtaattgggctactggaagtagaggacttgcgaaatacaaaggaagaaatgagagatgtacctgccaggagactcagtaaccaaaacaaaaacttccacttcatctaacaaattattcctttttgggataaagttaaagctgaaacgtaggtttgttggttgttctttattttcctcaaacataacttaattcagacttctcttaactttggaaaaacccaacatagataagttggatagattcttttttctattttgcatcattagattttttttgcttgaaacagctgtctttagcattaattcttagcatcttagattcttgccagattattttttactattatttgtcattttattctttaatgaagcagcccttcctgaaatcattcacatttagattatatgttgctggaaatactgaatgttctgtgtattgtgcttaagcatgcaattatagacagtaattaagtacagtgcatttgtttcaatagcttacagcaataagacagcttttgaaagtttatacataagatgtatacaaagatagactgccttcattttcttcagtacgtgagtagggaaaataaattcacaggaggaattgtcaaagaagttcagaatgaaagggaataaagggaagatggggaatgagaaacaatgaagaaaataatagaaaatttgggaaaagatatagaagaaagaaagcagagaaggattaaaacggcctttccaaaacgactctttgtcagtgcacttccattaatcacctcttcaaatgagatagtaataactctttttgcatttttcatttttgcctcacccttactggagaagagaagatgagaaagacagtcccaggagtgtctggtatctgcagccacagggggaaaggaaagagaatacaaattgtcattgtgtcagtagttcttatggctaccacattgggggcagctgtcattgattaatttgagaactccttctgcgatctgttgtccattgttcaggatacatatctttggctgttattttaacatttatttatgacacttgtttctacttactttgacatttggatactcactattagcaacatcttatctttttaattactgttttgtggcttataaaaagagactataggccggtgacgatggctcacgcctgtaatcccagcactttgggaggcctaggctggcggatcacttgaggtcaggagttcaagaccaccctagccaacgtggcgaaaccctgtctctactaaaaatacaaaaattagctgggcatggtggcaggcacctgtaataccagctacttgggaggctgaggcaggagagtcacttgaactcaggaggcagaggttgcagtgagccgagatcgcaccactgcactctagcctaggcaacagagtgagactccatctcaaaaaaaaaaaaaaaaaagaccgtataagaatgaaagtgaactggtacaaagtagttaccattgtggaaaaaacaactcaaatgcctcatagttgaagccaagaagcagacaggctttgcctctatcaacttatatttgaaaaacgtagtttctttaaatctccatttttgtcttttgaatactttattaggtcgctccagagaaagcttgaaagcaaggcctgtactccacttgaaaagattcataaaatagatttgtaaattattattcagcgcatgaatttctcaagtatatgattatactaaattaatattcatatgttgcaggaagttggtgaaccatctaaagaagagaaggctgtggccaagtatcttcgattcaactgtccaacaaagtccaccaatatgatgggtcaccgggttgattattttattggtaggattatatcagtaaaatcgtattagtgtacatatgttatgaagttaacctacatttgggatatgtagaagttttaaaagtgctttccaaatgtgattgttctggtgatggacatatggcagttgattattctgttcttttcttttatgattgaaaatgtctataataaaaagataacatgttttctaataacaattgttggaaatttttttaaataggatttattttcagtgttttaaaatactaccttttgtttagatagtatgcgtacttggaactaagagcactggctttttttccccaaacaatgtcattataagctgatgtcatttataacaccagagcttataagtaggggttgagtttgcctttctcatcaattaaaagtgaattgcagctgggtgtcgtggctcacacctatagtaccaacactttgggaagccaaggcaggagggttgcttgaggccaggagttcgagaccagcctatgcaacacaatgagaccccatctctacaaaaaaattagatgagtatgatggcatgcgcctctgaagtgagaggatggcttgagcccaggagttagaggctgcagttaactatgatcccaccactgtactccagcctgggtgacagagcaagaacctgtctcttagaagaaaaaaaaaactaaattgccagtgtagaggaaaagtcctttatcgtctctttctttactgtttttaatgatttgacattcattacaagttttaaaaagtagatgtgctaatctcttcagatataatatgtttagctgtttcttgtgacagcagtggattgttgacagagcttcttcctcagtgtattagagtaaaacttgatgagaatttttattacttgcagggagtggtgaacattttggtttatctacatatgcttgtgattaataagagtgatagttacatacagatattttaaatttttgaatatttccccattaatttaacttgctttagttggtctttctgaatgccattatttcccaacattacttttaaaagatacttaatatagttcacaagttgaggttttggggaactactaatcatgatcatgttagatttagttttctgttgagtttggttttcttttttgttgccagagtgttgaaattttactttataaaatattatttagatagacataaatccccatgtatgctaaatttaaaataatgaatttcttctttagcttcaaaagcagtggactgtcttttggattcaaagtgggcaaaggccaagaaaggagaggaagctttatttacaaccagggagtctgtggttgactactgcaacaggtactgtttatttcttagtgaagaataacataataattttaaattttcttcatagtcctgaagctccttacatcattaaatgtagtgatactacaacataactcaaatactgttttcacatgtaacctgatttctttggtacctctggaaatgtgtttggtattagactattatacttttaactgtatataatttttatttatgttctattttatatatttgtgagccctactgaagggtcagcaacaaaagtcatataccagtgcctacagtagaaaagaaagttttttcttttgtagagcaaattggttgaggagtctttttttcaaaacttttgcaggaattcctattagctgtgttaccgctacttttttagtgcctgcaccctgagccataagcctcataccctttcctatttggttcagtgtttgctaatgtagtatttcttctaaaatcaaggaagctgcaacatctaccttatctttttctgagaatttcaagatgaaatacagctaattcagtaatatacatatatttttcataatagatactttttctgttttgaaaaaacttttgatgttaagtggtttacctaaaagacaaaatcaccttccttttggaaggaagtatgctggtttttctttccatttcttttcttttttttcttggtttacttaatactaagcattttcttaatatatgttaactaaattttgttttcataacactaaagcttatcttttgggattttagattattttatgtgtactaatattttatttaatggcacctaaagtatcagccacataagaaccctcttaaaaaccactatttcacaacctggtttcttaagctgtcaagttaaagaattattgaatatttcttaaaattcttagttgccaaagactagaggttactaacagaccttttagaaacagtaggtttcggccaggcacagtggctcatgcccgtaatcccagcactttgggaggccgaggcaggtggatcacaaggtcaggagatcgagaccattctggctaacaaggtgaaaccccatctctactaaaaatacaaaaaattagccaggtgtggtggcgggcacctatagtcccagctactcgggaggctgaggcaggagaatggcgtgaacccgggaggcggagcttgcagtgagccgaggttgcgccactgcactccagcctgggcgacagagtgagacattgttgagacaaggatgagctaacactcatgcagttgatatttgcttgtcttttgtagcaacttgtctagttagaattagctccagcaagcatatatccagggcaacttgaatctgctcgtggggaaaaaataaaaaggtgaatagaattagctccacggtacaaacttccaggctgggcacagtggttcacgcctgtaatcctgacactttgggagaccaaggcagggagatcacatgaggccaggagttcaagaccagcctggccaacatagcgaaaccccatctctactaaaaatacaaaaattagccaggcgtggtggcatgcacctgtagtcccagcaacttgggtgactgagacatgaaaatagcttcagcccgggaggtggaggttgcagtgagccgagatcgcaccactgcactccaacctgggtgacagagcaagactctgtcttaaaaacaaaccaaaaagtacaaacttccttacctgccacaaaactgatgtattttttacatgttgtgtaaaaattaagagatgctacaaatgcagaaactggggcacagagaacttaagtactttatctaaggctacacagctagcaagtggcagatctagggttctacatctagcagcctgtctccacagtctgtgttcttaactaccgctctatactgtctcctccaacaaaatgacgatgcatttaatggagctattagatctgtaagcccaaatctctgagtagagcagccagtatgaatccacattttttggctttttaggagccttggtaccttgttatttgaaaagctcaaaagacctgagtacagagagtgtccaaagacactcgattttcattgtatacgctcttcccactgatgtcagattgtttgagtcctttctgcactaaaataaatgagaatagcataactttaaggtctccagagccacttctaatataaccgtagagtcttattggccagttctcatgagttgctgcccaatagcagacaaaatcacaaagggtctcttgaccagtttctttttttctttttttggcatcctccaatactgtcagtttttctgaggcagctaagtggcatgagggagtctgaggaaaaacaaaataggaaaatgtaggatgataaaacaatcttttctaatgtgatctatacctttttatggcctatatcatgaatgaactcatacatactaggttaagtctccacaagactttgtatcactgacccccaatccagttatgtcgtcctcagtcttgtgcacatgccacactcattttttcttctagtctttttcctatcataacttgccactttccctaaacggttctgtttcctctgtcccacctgcctctcaaaatcacaaacaaatccctcaagtccttcctctaccgaatgtactcttccccaggccctccagccttcatcagcctttgtatctaaagttctactgagtttatcaagttagtacctcccagtttggcccttaactattttagaattgctacatatgtgtgagtttttttaaaatctcctgccagctaaatctgaaaacaattgtaagactgttttatactttattgtaactccatagcaattaccacagtgtgagcacttcataaaaactcacctttgccacattggtggaagtccccaacatgtctggcatttaataaatgtttgttaaatctgaaaaaaaaatggaagtgaaggaaaaaaatacagaagtaattttttaaatgttttagaagctgttttaaaaccacttactcaacaaatagtctaggctccaggaatacaataataactatgacttggtccctacatcaaaacatattctgatctgttagggaagatttataactaatcacaatgcagtgtgttgaataaggaagagagagatggtgaaactatgaagaatgacatcacacagaaaatgttttaagtaaattttgaaacataaataggtgattacccaacaaacaagagaagaaaggaaattcattccaagcaaagggcatagaacacaccgagataggaaagtatgagtagttgtgtaaaaatgtcagagagttttatgttagtaatgtgttctatgtcatgggtttaaagccaaacaaacggaggctctgatactatacaaatgttaaataatgtcagtctcatctttcaacctaattgtgaaattattttcaacacaatttgattgaaagttaataatctacttttctttcgtgggggtgggcagctgtgcaggaaaattgacagaagcagatgatcctgctggttctattgccttcagtatctactcatcagggaaaaggcttttttctactaaagttgcattgtttgtttttaaaattctttattaagaatcattttttccactaaagtaaatttaagaaaatgggaactgttgcaaatgatttagaagaaaatccaaattactaataatgttgcttcgtagatagccagccacattaccatttgagaatatatacttcaagtatctgtatgtgtacacatgtactcttaatatatggacatgtatattaactgcattataaaatgctgctttttcaattaacatatgaggaacaggatgtatttttattttcatttggagtggaaataaatgttcctgaaagaaaatctggaaatcatataagtgcacaaagaaaattagaatatattttcattatagattttttttgtaagacattctggagtaaaaaatgtaagactacacttcatattcaaatatgccactactattcttaaatcccactttgtactcataagtagttaatcattaaggtctcatttcagattcttgtttgtttatatatgtatatgtattcatagcagatatgatggtagcattttgaggggcagtttgaacatttgcacaattatatgcacaatcatatttacataatttaaaaatagctcttccaaataagtagtatgggccaaatgaggaaacctagaaattagctttgtggaagtgctcataggctggacctaattggggagcagatggaagcccagccaggcaggtaaaacatagaaacataggtgcttcaggggactgaacacagtgacaaaaagaagtggttatctgggcaggaagaaagcatctagttaacaagtgctgtgatgtgctggagcaggcaccagtgaggtgtaagtagaaaggtagctagatagtcaccattagcaggcaccagtggtggtagtgagacgtagcttctagattgtattgtggcaattagacattatcaaagcaggaatggagaaaccaatcagaaattctgaaactagaacatgagatttgaaaaagtgacttttagatgacaaaaataagggcaacccaatttcttgagtaggattgtaaggttaaagagaaactaccaagcaacgttgacttaatctggggtcagataaaaaatgaataaagcaaggatctctctctctcttaagaagtttaccgtctagtgaaggagcaaacaactactacaaattatatagtgagttagaagataagtgctatggatagggtaacaggaaacgagagaatgggaaggtgggcttatgttttaaacagagtaggttgtggttgagggaaaacttgaaggaagggagtgaaacaaaaggacctgcttatttgggggaagagcattctaagtaaagggaacagccagtgtgaaggccctaaggtgagaatataaaatatagtaataactgataaaaagagagaaaacaatctatttagagagaaattagtgaaaccaggaatacatcatgttttgccaaatatattgcacatttttcaatttgatgttgtgcacgtccttttcagagtccaaaaatctcaccttagtatatttaatcattgcttaattgaagataatcattacagtggcacactgaattgcgaagtacttggagaaaaaataacaccaagaaagctgaaaagacattatttggacccatcaaatcatcacttttaatctgttaacatttcttaaactgtttattttctcctttctttattacgtcagctcttgcatttgagacttaacataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggtgagttaatctaaaattaagtaaaaatttaaaaatcattatgtgcacatgaacactactggcctatgagcacatttaagtattatgcaacacctacctgagataactatattagagttgttataaataccgtggttgagaatttttatttctgtgttacaaatagtcagtgaaagttttttgactgtatgaacatcatatttcttgcttacttgtgttatttcttctgtccaacttgtgttttcataggaggaaactccaggaactcctaaaaagaaggaaactaagaaaaaattcaaacttgagccacatgatgatcaggtttttctggatggaaatgaggtgagagtaagcctataactagaagttcagttttctataggagtttttagaaagatgtttgatgccttcactaataaaaggaaaaattttgagaaatctaattatgctcttaaatgtataaaagctactccatttttaaaaatcaataatttctcttatttagatttttaaaagtcagatttgactgtgagtgataggaaacctgaaataaaagcatcttaatacaaaatagatgcttatttcttttttatcagtgaaatctgtaggtaagctgtacagatacgtcagctccatggtggatcccagctcttcttttctcctctgtctgaggcttctagctaaggttaccttatggtccagaatgactgccaatcttatatctgcatcgaaaagaggaaaggagagtgaagaatatgtctcctctttaaggagaccagtttaaggacactgtccagaaagctggtaatttcatttctgcttgaattccattggccagaacatagtcacatggtcatgcatatgagaagtaaaatcttggaaatgcactttttatacaggatgattatttgcccagccgaaatgtagggtttccattattatcaaagaaaaaagagcagaataggagatagctacaagtctctatctcttacagaatgtaagtcagacacatcacttgaggggcttaaaatttttaacatttcttgatgctttatgcttatcatttgtaatggaagatttgtatggtggtagccttccataaagactgcttaattcagtcacttcaccagtacgtaaacatgagttatatactgggcattgaactgttgtgaatttcaggatatatcctttcctgttatacctatacaatagtaacatctataaagtcatggctcctagggttgtgtgtttgaaattcttacttgcatgagactatctagagtgggattgtgggggaggattatatatctataataaagtgtcctcaggtgactgatgtgaaccccttgttgagaaccactgtaatagaaatttttatttttataggcgttgggaatagcttgataagtaggataaaatctcttaatggtctagcaaagatacaggcacttaaacatgttaatatagtacagtgtggtaagcattaatggtgtgaaagcaccaggtaggaatagttaatttagtcaggaaggataagaagggtctaaaggacatttgagcttagacttgaagatgactggcagattgccaggcgtgccaggaaggaggttaggtctgttagggaaggaaacagcctgagcaaacgcatgggtgcttggtatcctgagaagcctagattttattctgtagaaagcagcatgcactccataacttttaaagttgtgaaatatcttttttaaaaaaacatgtttttttagaatggaaactggcagaagtaatatctgtgaatctgattcccaaggaaatgggcagagtaaaataagaggttaaagtggaacctctggtgttaaaaattgaagaaccacgttggaaagacaataaagagttctggtcaatatagaaataagagggaagagtactgttatttatagaaactaagaaataaaactgagttttatggatgaatgatcaaacagagttctgatctgaatgaagtaaatttctgttgtgtaaaataagagcctgataaaagtaaattaagttttgaagtagtggttcccagcttatgggccctccatggaggagtaggcaatgaaattaatacagtcatagagactatgttcaccaagcatgatctttaataattgatctttgtgtcttctcaggagagaaaagtgtggagttgagtgatactagatctgtaatagggcctggctggaatctgtcttaactgcgcttttatcccagactggttcatcattacattagggacaaaaaggttggcagttgctggtgttttggttgaataaataatgatgtgcacacatggaacaatttttttttcccccaagacagagtcttgctctgtcgcccatgctggagtgcagtggtgtgatctcagctaactgcaacctctgcctcctgggttcaagcaattctcctgcctcagcctcccgagtagctgggattacaagcgtccaccaccacacctggctaatttttgtatttttagtagaggcagggtttcaccatgttggccaggcttgtcttgaactcctgacctcaagtgatctgcccgccttggcctccaaagtgctgggattataggcgtgagccaccaagcccagtcaaacaaatttttaagtgtatgtaagaacatacaaatttacttaagtgctttatagaatttatagttatcctataatcattttctagcgccagaagaaccactactactgaaggaaagatctttggaatttatttaccttagaaattacttctcgtatgttaagaggttgatgactgctttaagggacctaaaatatagaattaagcattactttctaatgtgacattagaacttttaagcaccgaggtttcttgattcttctaggtgtatgtatggatctatgacccagttcactttaaaacatttgtcatgggattaattcttggtaagtagtgagatgttaatagctataaagtgcaatctaaaatttagaaaacaatatgcagatactgtaaaagaaaatgttcctaaatttaacataaaatagttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaaaaaatcagctctctctaacagttgataggtatgtctattgttttaatttttgtaaagggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagataaaaaaagaaaagaaagttacagacgagtaagaatagtataagctcatttacttatttagaaaaaaagtccctgtagctagttaattatatataggcagtctctgagaatacaggtaagcttaatagtacttaacctctgggaagtggaataagaattagatgaagacttaattttctctataccttttgatttgcttgtttgtgacagggtctcattcctgtcacccaggctggaatgcaatggcacaatcatggctcactgcagcccgacttgctggggtcaggtgatctcccacatcagcctactgagtagctggaactataggcacactccactacaccccgctaatttttgtatttttttgtagagatggggtttcgccatgttgcccaggctggtctcaaactcctgggcacttgcctcgttgtcccaaagtgctgggggtttgatttgtttttgatttgctttttaacgtgtgtattccaggaggttttatggggaaagaatgatttaacaaacagaaaaaaaaaaaataggtagcagttaaaataagcttggtcaatatggtatgataggatcccattcaaaataactctttaaggctgggctcagtggctcacacttgtaatcctaacactttaggaggccaaggcagggagatggcttgaatccaagggttcgaaaccagcctaggcaacatggcgaaacctcgtttctacaaaaaattagccgggtgtggtggttcacacctgtagtcccaactacttagaaggctgaggtgggaggatcacctaagctcaggaggtcgaggctgtcgtgagccaagatcatgccactgtactgcagcctgggtgacagagtaagactctgtttcagaaaacaaaaagcaaaataactcttttataataagagtactagtcactttgctagatattttgcgtacaatatatcatttcatcctcacaacaacctttgaagaataggaagagacttattaaatataaggtaacttagcctcaaaagagttaagtaacttgcccagggttacatagcttataagtgatggagctagaattttaatcctggtcttattctaaagacctaataaccaggcttctaatttcttataattctttcttgtgtccccactttacttgcaaaaaaactggagacacttgtaaacagtttccctaagcaccaaaaaatacatctgtagcagaaatcacctggggaatctttcagtctgtggatgtcagagctccaccccagaagaagaatctccagagaggggtcttggaaatcattttttgttggctttgttgttctgttgtttcttttagctcccttacttagtaggcaaatatcttagtattttttaaataaagtagatatagcttgaaaaagggggcagttgataaattaaggaggcaacagttttgaatttctacatagcatttttttctaattatatgtaatttacactaataaaaactagtttaagaatagtataaaatgttaggttgaacaatatgaaattgctcataattgaccattttttacctataaaaatggcaattttatatttcactgtgtttatgtttctcagtttttcccccagggatatgtttctgttagtgcagccataccatttaagtttttattctaaaatttaacttttgtcatttcttgttccagtgattgcagtaatagcggccaccctcttccccctttggccagcagaaatgagagtaggtgtttattacctcagtgtgggtgcaggctgttttgtagccagtattcttctccttgctgttggtaagtattgttattataaaattgacctcaagaaggttggtattgagcagttggactgtaatttggagcttcagtaaagcttaagaaaaattaatggaggtaaatcaagaaatatatggtactactttctgagtcaaatctcaaaactcaggcttggtaagatgtgttctgtctgcagaaaaaggatttaatacatctttaaaaaaattttttaataagattattttttattgacagatcataattgtatacatttatggggtacaatgtgatgttttggtgtatgtgtacaatgtggaatgtttaaatcaagctaattaacataattagcatattgatcacctttcttgcctatcatttattgtgagacatttgaaatttacttattttgaaatataccatacattattatatcttaatctgcaaatagatgtgctttaaaaattagttatggcagaggcgtttaatatttttgcagtggtagatcatttattagacataatactttcagtaaaacattttttaattttgacttagaacaaatgcaacatctaaataatctatgcatatatttaataaatgattctaaacaattgatttgccattttgggaaaaatcaataattttcacccaagtaccaaaatactagatgcaataaggagttaatgttttaaaaatcaaataggaaaacataagtaaatgaattttccgcatttctggatgattggggtctttcatagattatttgtttagaggcagggtcttgctctgtcacccaagctgaagtgcagtggtgagatcatagctcactgcagccttgaattcctgggcttaagcaatcctcctgcctcagcctcccaagtagctaggagtactggtgcatttcatcatgcctggctttttgtgggggagatagggtatcactctgcccaggctagtctcgaactcctgacctcaggtgatctgccctccttggcctcccaaagtgttgggattacaggcgtgaaccaccacgcccagcctccttcctctgatttggtaacctctggcagcagaaaaatcccctgctggttttgcatggaacacgggcacatttgtaggccaagaaacaatatctaagcctgtttgaatttagtgtcagtgtaatacctgcatcaagaaggaaaagtcataaactttgatctgacattagacataataaaattggtgctttttgcctttcaaattcctgaaatttagaaactccttggaaatttttagcaaaggtttagctccactgaatagaattattctacttgcttatttttaaattaaaccagtgttcacaatagtttatggttattatgtagttttgctgtttaaaatattgtttcttcagtagtctctttaaataaattttcattgtaaatatgctgtggatttaaatatgcattatgaaccaaatagtcttctgaattataccaggaaacaaacccaacattttattttgattctcttagaaaatgcaattccaaatatactttcaaataattagatatttcttttatattattctttgaagtctttatatatattatgtatatcgcatataatatatatcatgtatattatatatgaatatatatgatatatagatatatgatatatcataatattatatatcatatatatcatataatatatatcatatgatatgtcatatatattatatgatatctcatatttatatgaaatatatttttatatatattcattttttggagacagggtcttgctctgttgcccagggtaaagtaccatggcagaatcatagctcactgtaccctcaaactcctgggctcaagcagccctcccaccttagcctcctgaatagctgggactataggagcatgttgccatgcctagctaatttttttttttaaagtcagggtcttgaaatattatgtattggtcacaattatatctggtgtttctttgaatatgcattattaataatgccatttaaaataaaacctttggcagttttctaaaatctgtcgcttttagcataggaatgttattatagtacatgtcacagcttccccataattcttcccttttcactctcggtaatctagtgccacatagcgaaaaactgtaaaacatgaacattttgccataccatttgtatgtgataagaaattaggttagtgccatttctatattgctttttctttggtttgatacaagatttcatattatgaatcatctgtcttacaatcctgtaaaacctatcattgcatcataattggagaaaaaaatgtacagcctccttaaattcattatctctgtttatcagtggaatttattcttaaatcataattttaagcatatttaccttttccgtttataccacgaaagattctaatgtgtacaggagtctttcagaatatttatattcttgtgaaaataaaaattgctatttttaaaagtcaagacagctataacgattttcttccatttatacaaagcaaaataatggaagacacatagattagcttatttcaggctttatatgaaaacagtgacagaattgtctaaagaaaacaaaaaccaaaactcctgtcataattgattagtctgtaacattcacataatcatcatgaccttttaaaaaacaggaaaaaatcactcagctctacataattggtaaattcagagaaaactaaatattggggtttgtgataactcattactacaaattttaaaattcaaattccatttttctacagttttttcataatacagtgttataaaagagtaaaccttatgtatttaagtgatcttgctttcattaacattgtatttttcctaatattgagaggattggtctttaagcaaaaattacatagtttacctaactaataaaacaaaaaggtcaggttcagtgactcacaactgcgatcccaactactcgggaggctgaggtgagaggatcacataaagccaggagtttaagactggcctggacaacatagcaagaacctgtctatcaaagtaggtagataggtagagagagagggaggatagatagagagagagagattagataaataaatgatagatatagacctgtaatccctgcactttgggagtttgagcccaggagttcaagaccagactgggcaacttggcaagaccccatctctacaaaaaatacaaaaattagcggagcatggtggcacgtacctgctacttggaggctgaggtgggaggattgcttgagcccaggaggttgaggctgcagcgagtcatgattgtgccactgcactccagcctgggtgacagagcaagaccttgtcctcaataaataaataagaaaacaaggattaaaagatggaaactttctaatactggggttccttatccagggctaatttatcctttaggcatagtaaacgtgtgccttggaccaagatacatataggggtccacagaaatattttcatttttatttcttttaaatcagaagtagtaatgtatatacatgtatgtaatagcaaacctatacagtattttattcgtgtttatacagatgtacagaaaatatagtcataaatgtatagaaaatataatatttaatagtttttgtggagtaagtgccttacaaaggcaaaagggcctagggccttgggaagtatgatgcagccctgcttttccttcttaaaggcttccttcctaaacacctttcatctctttattttattcttttcctacaccatgatcttatgaatacttaaattcccaactgattgctatgtgtattgaagcataatatcacaaagtacataaatcagaagtgtatatccatgtaagtgtacacccagatggaaaaaagaagtaatttttttcagtgacattattgcattgtgacctcaagttcagagcaacattctgtgcccctagaataccgtgatagctgctaaactagtcaggaattttttgttttcaggcatgcagtggtgtaattatagctcactgcagcctcgagctcctgggctcaagtgatcctcccaagtagcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttt

SEQ ID NO: 17220 - DNA, 9748 bp, Human
gagactctgtctcaacaaccaccaaaaaaataaaagctgagggatgaggcaggtggtgactcagcgtttggatacagaactgtgtggctcaggactgggtttcaaaaagacccctctggggctatgtgggggacagactggagggagaaactagaagccagggagaagcctaaagtcagggtccaggtaggagagcaggagcccagagcctgcctgagccctcaggacagagaagaggggtggagtggagactcagcaggcaggagggatctggctaagagactgatgcgctgttggggaagaggggacaagatggagctttgacctcatgactagatagatggtggggctgcctcagatgaggaaaccaggtgagagaatttggggacatcagaggaaactgcagaggccactgggtgtgcacctgcaaccaggcactgcagacccagatctgactgtcaggatcccaggctcagtgcctcctcctctggggcctccgctcctcgggccccactgcagaggcaggaagtaccgcctgatgctcagcttccgctgggggtgttggcacggcccagcgccctccccactcccagggaccttcccacctcgagcctgtagcactttcacttccccaggtacccagcccctgcccccagcacctgggtgctccctggtccagaacaggctgcagactctgagaggcacaaaaacaagtggggaagggggagacagagaaaagaagacaggctgggcacagtggctcacgcccataatcccagcactttaggaggccaaggcaggaggatcacttgagcccagaaatttgagaccagcctaggcaacacagtgagactcccatctctacaaaaaatgaagaaaattagccaggcatggtggtgtgcacctgtagtcccagctacttgggaggctgaggtgcaaggattgctcgagcctgggaaggttggggctgcagtgagctatgatcgcactactgcattccagcctgggcgaccctgtctcaaaaacaaaaacaaaagagagatgaagagagaaaggaggaaggacccaaagaaggggccagaagcagagagaggccaggcacagtggctcacgcctgtaatcccaacactttgggaggccaaggcaggagggtcgcttgagtccaggagttccagaccagcctgggcaacctagtgagaccctatctctgttttttttaattaaatataaaaaatacaacactcccactccatagcaagaccccatttctacaaaaaatacaaaaattagccaggcatggtagtgtgcacctgtaatcccagctactcagaaggcagaggtgggaggatagcttgagcccaggctacagtgagctgttttccccaccgtactccagcctgggtgaaaagtgagaccctgtctcaaaaagaaacaaatatataaataaaataaagaaacacagagagagggaggatagagaccccaggaggcaggaggacagagacccagaggagggagagactctgctgagataaggggacagagatggggagtagcaggaaggtggggacaaagacccagagaggaggaacaagagacccagggcaggaaatgggagacacagctggatgcagagatgggagagcttagcaggccatgaggtcagagtgtctgtgaggtcagctgctgtccagggtcagccctgaggtccccatgcccagaggtgggttccagtagatcaggggtccctttagatcccccagcgcctgagacatggagacctgggagggactgccccatgagtccttggtgcccacaaattccaaggcccctcaggtaccagagcatgtgtcccagtggagcaggtgagggagacagggacagagagagagacagaaagccaccttacatgaagcgggagtgggtggagccccacccctggaacttcctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtgagttgcctcatggctacccagacggggcccagcccctgccgctaacccagccctcatcttcccctgtggcccacccccgtatccgcatctcctctccccaggtcctcggcagcctgatcttctgcttcggcatctggatcctcatcgacaagaccagcttcgtgtcctttgtgggtgaggggggctggggcaggtgggagggcctcccccaacccaagcaacttcctggggtctcccttgtctcagggagacctacggtgccctactctgcaggcaggctacaggctcccatccactgctcaccggaggcttcttggagcctgagtcttcttccggcaaatggggttgtgcatacaaacaacaatgatcatgagagccatttctcaagcacttcctatctgtcgggacttgtgactggtcagatgcccccacaaaccttcccctcgcttgaggttcagagaggggaagccccttgatggatgtcatacagcaaggacgtaaaagagccaaaataacattaataataggaaaataataatgaagtatgaccctaaataacaatgaaatataaccctaaacgctcatatttaagaagtctttgccctgtgttgaggactgggttgaacacatgtccccatgtgtctctcaaaatgaccctaggggccgggcgcggtggctcacacctgtaattccagcactttgggaagccgaggcaggtggatcacttgaggtcaggagttcgagaatagcctggccaacatggtgaaaccctgtctctactcaaaaatacaaaacgttagccaggcatggtggcacatgcctgtagtcgcagctactagggaggctgaggcaggagaatcacttgaacctgggaggcagaggttgcagtgagccgagatcacatcactgcactccagcctgggggacagagcgaggctccaactcaaaaaaaaaccctaagaaatagatatcatctcctatgcctcagggaggtttaaggagccaagccaatgtcacagaacaagtgatagggctgaaactactggggacgaggaggagctgaaggaggaaggagagggtaagaggaagagagacagagatccagggacgggaaacaggcccagaaagaagagaaagtttcagaaggaaacagggactcagggtggggcagggacagagtcccagagagaggggcaccaagatactgctccccacttgggtggctgcctaggtgggaaatggggctgcctggagctgtgccacacagctcatcatcactcccctcacctctcccaggcttggccttcgtgcctctgcagatctggtccaaagtcctggccatctcaggaatcttcaccatgggcatcgccctcctgggttgtgtgggggccctcaaggagctccgctgcctcctgggcctggtgagtgcaccatccctctccgtccctaggaacactcctatccccaccctcaaaaatggcctgggccggggttgcaggggtggtcagcctgatctctccactctgctccccagtattttgggatgctgctgctcctgtttgccacacagatcaccctgggaatcctcatctccactcagcgggcccaggtgagcttcctgcagtggccaccacccacccccagcagggaggagagggaagggagtggtgggagagggtggagagagaccgaaacaagggcagacaggggctaacctagataaagagaaataagaggctgggcctggtggctcacgcctgtaatcccataatcccagcactttgggaggctgaggtgggagtccaggagtttgagaccagcctgggcaacatagtgagaccccatctatatttaaaaaaaaaatccgggtgtgatggtgtgcacctggggtcccagctacttgggaggtcgaggtgggaggatcacttgagccagggagtttgaggctacagtgagccatgcactcagcctgggtgacagagtgagaccctgtctcaaaaaataaattaatagaaagacacaccgacctggaccaagggagacaggcataaacagctccaaagggaaacacacgggaaaaagagagaacaagagaaagaaatagacgccctgaaagaagagacagagacttatgagccgtagaaatagtggaagaaacagaaagacagacctgaagtacacagatctagccattcagtaaggatttgagactggcccagagatgcacagggcccgcctgaggctggcacagcctgagagggggaggggtggggcggggaagataaggcccagcctcactggtggcctctcagctggagcgaagcttgcgggacgtcgtagagaaaaccatccaaaagtacggcaccaaccccgaggagaccgcggccgaggagagctgggactatgtgcagttccaggtaagcccccctcctccagttccctcccggactgacccgcctcagccctgtgcttggaggagactccaccccaacgtgggcccgacccccagctctacgatcctaacacaccccaatccctcccaggcccgacgctccccactccccagatgacacaactgtccccggcgtcgcctggtctcccagtacccagaccctggcgtggcttcgccatctacctcgagagactccgcccccgcccccgccccgaccagaggttgtcaggcccctagtcccaagaccctagcgagacacggcttcctaccccgtagtgactctggcttccaccggaccccgcccccgatgagactcacatggtctcgcactcctattcacctgtcgggtatcagaggctcaattgcaccacccacccaatctctagtccacagcgcgaccctgcagctccttccccagccccaggtcaccccgtgactcgtctttcccagccccatgttcccgtaatgtcccctggctccggccccatcgtgaccccagcccactgtcccccactccacacccaccacttagtcccctgctccccgacctgacctcatacccatcaccttgtcccctgatccccaacatcatatgtctccagtcccggtccctctgactcgtatccctctcccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgaggtgggcaggggttcggagcataaacctgtcgaatggggcggggcctgcgggagggggagggctgtcagtgagtagcggcctgagaaagggcggggtctacgagaaaaggaaaggtacggcaggaggggcggggccctctgaagggggcggggtctgcaggaagggcagggcctaaagaaaaggctgggctggctctggaatacagatgtctagggaggggccaggcttggaaaaggtgaagcgagggtgcactagtaaggagactagagtgccctggtgactaggggagcgggtagatgcctgaagacggtgagggttggcctgaaaagaacgctgggcctgggcttgagagtcccagaaagaatccctttaacttttccctacaccccccagggctgcgcgcagggcctccagaagtggctgcacaacaaccttatttccatagtgggcatttgcctgggcgtcggcctactcgaggtgatctggccccgcccccacccgcgatcggccctaaatccctagatggccctgcccttcatttcgcgtccttcggttgcctgggaaggacgagctcagggcggagcgcagcccaccccggccctcccgccgctccacccagcaccggagggtgggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgccagcaccccttcgacttctctgacctcatctcctttctctatagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgcagaggagtgggggtggcctgtcaggggctgaaaagaaaagccagtgctgtacctggggggttgtctcactcctgtccccacaatccctgatactccggagtgatctgtcctttcagacacccactgtgaggtcccaatatcggggtttatcctttcctcagtcccagcctgttcagctctccaaccaagttttgggggcccctctaatgggggggatggccccagttgcttaggcctctgaggtcaacccctttacatcacagccctctccccaaataagaagcatgaggtgagctggaggaccctccctgggaggagggtgttctggggggtgagccagttttggggtcccccttcagtccctgaccaggcggtaaatgtgatgctgggccccacgctcgctggtggagacctcgaagacataggcggtgcagagcagcagttcctgggtgtctctgtttgtcaccacctgccaggaaggccaggacaagggacttatgcttagaagggagggcagggacccctgtgcccccctgccaagctatcatggaatacccagcaggctcttttccatctccaggaaacaggccgccaccatatcatgttccccaggagaaagggatgcccaaaagtcagttccctgggcaatgggggttacccctcagctgagcgttggcagttatggtgtatcacatctcagggttaatcgggttcccatcacatcacattccctgggtaaaaggggtccccatcatgtcacaagtaaagggagaaccctccctgcaggttccgcggtcaaggggtctctgcctcagcagtccaaaaagttaaaggggctcccaccatatcatgttccttgacaagctgaggatctgccttcgagtgccctccagtcagcttcaccagggaaggagggacccaccttatgtgcgagtgctgtggggctgggcgtggtggctcacacctgtaatcccagcactttgggaggcctaggcaggtggatcacttgaggtcggagatcaagaccaacctggccaacatggtgaaaccccatctctactaaaaatacaaaaattagccaggcgtggtggggcgtgcctgtaatcccagctactcgggaggctgaggcaggagaatcacttgaacccgggaggcagaggttgcagtgagccgagatcttgccactgcactccagcctgggcgacagagcgagactccatctcaaaaaaaaaaagagagagagtgctgtgacatccccaccacatctgggtgaagggtcccctaaactaagggtcaatggtggggtccccgctgcatcagtttcctagttaaaagagcctcaggctgagggctcactttggagtccctgctgtgtcagttcctgggtgaggagatcccctagactgagggtctgttataggtactgtccctccacactggggggccccactccagcccagccccaggcatcacctggaggatggtgaagttttccaggacgctgttcatcatgtatcgctcaggcagctgccgcaacttgtgcaagaaattcaccaggtactcgcacatgggcgagcgcagcaggcggtacacaaatctgccgtcctccagctgggcccgttccgtctgaaccaaggggaagggagttgggaaaatggtggctgagagacccacgggtcaccccaggaattgagctccaccctgtgcctctaagatgccaccacactcactctcactgccaccttcctttcatcaccccacccacagtgactggagactgggcctgaaccctcggagatccgaatcaggatctctgagcctgcaaatcacaagcccctcaaagtgattctctgaacccccaaagacctctggactcctctaacctcccagccctcagataccctccaaagacccctccatgacgtcttcaaactctgacttctaaacttgagacttccccaagtctccagcaactgtaagtgtgacttctgaaccttcttgccctaagaacctctccatatccataagacccttctcaatctcagtgactctaagtctctatactacacattacctgtcagcccgcagaatgatccctgcctgtgacttctgaactgcccattagctcccaacgcatgcattaaaccctcaaagaggctgggacccactccctccatgcatactcccaaatgcctgagtcatgatggcttctggtccattctgcacccccaagtgct

SEQ ID NO: 17221 - DNA, 15615 bp, Human
  misc_feature (1)...(15615): n = A,T,C or G
aggccgaagtaggcggatcacctgaggtcaggagtttgagagcagcctggccaacacagtgaaaccctgtctgtactaaaaatacaaaaattagctgggtgtggtggcgggcacctgtaatcccaattactcaggaggctgaggcagaagaatcactcgaacccaggaggcagaggttgcagtgagctgagagcacacacttcactctagtctgggcaacagagcaaggctccatctcaaagaaaaaaaaaatgagagttttccggactaggtgtggcagttcacacctgtaatcccagcactttgggaggccgaggtgggtggatcacttgtcagaagtttgagaccagcctgggcaccatggtgaaatcccgactctactaaaattataaaaattagccaggcgtggtggcggcacctgaaatcccagctatctgggaggcaggagaattgcttgaacctgggaggcagagggggagcttgcagtgagccaagatcgtgccactgcactccagcctgggcaacacagcgagactcggtctcaaaaaaaaaagagagagagagaggagtcttctggaaggctacagagattccctagaggcaatagggcgatagggcaggacacacattgaggggccccaggacttggtcaggaaggagctagagcaggtcctttgtccatgggccacatgagctattggggcttgtatctctgcctctctgcttcatttaaatctttctagccagatggaaggtctgaccattgggtgcgacaaggcagctaacccaggctgaacaggaagtgaggcaggcagagggatcagggaagggaaatggatgatgaaggccaggacgggcgaggctttgctgcagtaacacataacccccgaatctgcgtgggccacaaccacaacattagtttgttgcttacactccctgtgctcatccggggctggcaggatccctgtgctcctccgagtggcacaggaaacttggctgatagaggcgctctctccatgcatcctccaccatccactccccggtcccttagacttccattcagaagtgacacctgtcacctccaccctcatgtgactggccaaagtgagtgtggccatgtccgagttccccaggatgggacctcgaatcctcctgctgggggggtgggggcagcagatgtttcaggacagtctgccacggatcagatgggtgagcaagagattcaggatgggcgtgatgggtcacacctgtaatcccagcattttgggaggccgaggcaggctgatcacctgaggtcaggagttcgagatcagcctggccaacatagtgaaacctcgtctctactaaaaatacaaaaattagccgggcatggtggcacgcacctgcaattccagctacttgggagcctgaggcacaagaattgcttaagcccaggaggcggaggttgccgtgagccgagactgtgccactgcactccagcctgggcaacagagtgagaccccatctaaaaaaaaaaaatgcttcagagattcagagatccacagatgtggaagagagcttctattttgtctcatgtaccacctcacccctcagtttggagttggagaagccgaggcttagagaggtcaaggggctggccaagctcccacagtgataaagctagtgctagggcgacacctgccaggcccaatgtgacaagatgcatcctgagtcctgtgtgccaagccttggcggggcaaagttggggcccggaggacggtaagacacagcaactgcgagttcccagagacagatccgggttccagccccagctcaccatgcactgggcgtgccacccagggagtcagccccactgcagcccccgctgcggggcgtccggagaacgcgccatctgcggcgtgagcggccgcctctcaccaccagggggcgcgctccgcctgggcccagattccaccccttgactgtctccccccaaaaatttcctttcactttcggtctctggctgtcacccggcttggccccttccacacccaactggggcaagcctggtgcgtgaggagacttggactctaggtccccaaggggcggagccagggtccccactcctggggcagggggagcagagggtggggggctgggttcccgggtccctaacctggggagggttctggggaccagacgtcgaggttcttagaagtggagatgaagagttttcaccgtaactggggcagacgcaggaagcctgggggaggaaggggcggaaactcagccacatcaatgggacgcgggaggggcggggaggcaaaggggcgggcagggcaggggctggggcatgagggtccgagacttgttcttctgtcccttccaagacccggcgacaggaggcatgaggggcccccggccgaaatgacagtgctggcgccagcctggagcccaacagtgcgtaaaccccagggacaagatcaggggagaggggaggcacaatgtcaggatggggcagagatgaggggagatggacgggagaacagatggacagatgacgaggaaataggaggggagatggacagatgtgaggggagatggataggagaggagacggacagaggagggggagatggacagaggatggggagatggacagaggagggggagatagaggagagggagatagagaggagtgggagatggacaggagcggggagatggacagaggagggggagatggacagaggagagggcagatgaacagaggagagggagataaagaggagggaggtggacaggaggagggagatggacagagaagggggagatggacagaggtgggggagatggacaggagggaagatggagaggagggggtatggacagaggagaggggagatggacaggagggggagatggacagaggagagggagatgaagaggagggggaggtggacaggaggagggagacggacagaggagaggaagagagacagaggaggggggagatggacagaggagggggagatggacagaaaaggggggagatggacagaggagagggaaggtggacagagccaagaacaaatgaagaggacgtggaccaagatcaagagagaagcaggcaacagtggtgtagaaggcagagggagggacagagctggaggaacccgggcgaggaaaccagacgtgaagatgaggtggttggagagagaccagcagagtgggggagatggggagagagaggggtggggcagagggggatgcaaactggacagcattggaccagaggcagagagaaaccgggaaagacaggcagagatggggccatgtctccagaaagtgtggaagaggcagaaggacacccagggaaggaggagcggggaagacagaacagtacaggtgggaagcccggaggagggggctgtgtgtggaacagcagagggctcccccagcacccgctcccctgcagacctatctcctcctgctgctgctgctgagctcgggactcagtgggacccaggactgctccttccaacacagccccatctcctccgacttcgctgtcaaaatccgtgagctggtgagcggcgctgccccggaccccctcatgtgatcccccttccccccacttttttttttaagtagagatggggtctctctccctgtgtttcccagggtggtcttgaactcctgggctcaagcgatcctcccaccttggcctcccaaagtgctggaattacaggcgtgagccactgtgcttaggggtgtcatccctttttaagggcaaggttctgtggcttcttctgggctccccctctcttggtcttgtccctctctctctggatctctgctgccacctctgggtccccacagttctgtttctcgctgttttcagccaggcctgatcctgttttctcccgcagtctgactacctgcttcaagattacccagtcaccgtggcctccaacctgcaggacgtaagtcatgttgggagggacctgggatggaggtggggaccacagactcaagatgctccaccgaggcgagtggataaccaggccctcccctccccaaacccaggaatcagagtcctcagcccctcctccctcagacccaggagccccggcccagcccctcctccctcagacccagcagccccgtgcccagctcctccctcagacccgtgggttctcccctctaggaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcaggtcagccctcaacttaggggacaagtgaggggagggagatgccttcctacgaattagaagtaaagctccactaggccttattggcgatttggaccatagccacccaacgaaggtagagcgagaagcgccaccctgcagagccctgttcctacagaacaacacgtccccaggcaccggtgatggggagcagtctggtcccattctggggccccggtttcctaggccatgatgaagggtgccactgaggggttcttcccccaaaaaaaaacagggagagaaggggtctctaaactgaggaggccgggcgtggtggctcactcctgtaatcctagcactttgggaggctgaggtgggcggatcacttgaggtcaggagtttgagaccagcctggccaacatgatgaaatcccggctgtactaaaaatacaaaaattagccgggcatggtggctcaggaggctgaggcacaggaatcgcttgaacccgggagccagaggctgcagtgagccgagatcatgccactgcactccagcctgggagacagagtgaaactgtctcaaaaacaaaacaaacaaacaaaaacctctctctgagggctgggtgcagtggctcacacctgtaatcccagcactttcggaggccaaggtgggaggattatttgagcccaggagttcaagaccagcccgggtaacacagtgaaacctcatctctgcacaaaaataaaaataaattagccaggcatggtggtgcccacctgtggtcccagctactcagaaggctgaggtgggaggatcacttgagccctggaggtcgaggctgcgatgagctatgattgggccactgcactccagcttgagcgacagagcaagaccctgtctcaaaacatagaataggccgtgtatggtggctcacgactgtaatcccagcactttgggaggctgaggcgggtggattgcctgagctcaggagttcgagaccagcctcggcaacgtgatgaaaaccatctctactaaaatacaaaaacaaaattagccaggcatggtggtgggcacctgtagtcccagctacttgggagactgaggcaggagaattgcttgaacccaggaggcagaggttgcagtgagccgagatcacaccactgccctccagcctgggcgacagagcaagactccatctccaaaaaaataaaaataaaataaaaggctgggtacagtggctcacgcctgtaatcccagcactttgggagcccgaggcgggcagatcacgaggtcaggagtttgagaccaccctggccaatgtggtgaaaccccgtctctactaaaaatacaaaaattagctgggcatggtggcgcgcgcctgtagtcccagctactcaggaggctgaggcagaattccttgaacccgggaggtagaagttgcagtaagccgagatcgtgccactgtactccagccagggtgacagagcaagactctgtccccaaaaaataaataaataataaagtaactttgggaggccgaggcgggcgagtcacctgaggtcaggagttcgagaccagcctggccaacatagagaaaccccgtttctactaaaaaatataaataaataaataaataaataaataggctgggcacggtggctcacgcctgtaatcccacactttgggaggccgaggcgggcggatcacaaggtcaggagatcaagaccatcctggctaacacaatgaaaccccatctctactaaaaatacaaacaattagccgggcgtggtggcaggcgcctgtagtcccaactacctgggaggctgaggcaggtgaatggcgtgaaaccaggaggcggagcttgcagtgagccgagattgcgccactgtactccagcctgggcaacagagcgagactctgtcttaaaaataaataaataaataaatatggccaagcacggtggctcatgcctacaatcccagcactttgggaggccaaggtgggcagatcacctgaggtcaggagttcgagaccagcctggccaacatggagaaaccccgtctctactacaaatacaaaaaatagctgggcatggtggtgggcacctatagtcccaaccactgaggaggctgaggcaggagaatcacttgaacctgggaggcagaggttgcatttcaccactccagcctgggcaacagagtgagactctatctcaaaaaaaaattaattaattaaataaataaactctgagagccagagctcactgggccctgttgctgggcatcgccagcagggaagggcctttggcctgcggaggggcggtggggggatgacgtggtggtgacgtctccctcccctgctcccagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccggtaaaggcttccaggcacccccactccttcccctcctgtcctcacggccgctcctcctctctgcacagtgcatcccagaccccatctttctcatattggttgtgacaagggcaagcttattcctctttctggagctcagtttaccaattttttttttttttttttgagacggagtctcgcactgtcgcccaggctggagtgcagtggcgtgatcttggctcactgcaagctccgcctctcgggttcatgccattctcctgcctcagcctcccaagtagctgggaccacaggcgcccgccaccacacccggctaattttttgtatttttagtagagacggggttttaccgagttaaaccaggatggtctcgatctcctgaccttgtgatccacctgccttggcctcccaaagtgctgggattacaggcgtgagccacagtgcccagcctacctttttttttttttttttttttgagatggagtcttgctctgtcccccaggctggagtgcaggggtgctatctcggctcactgcaagctctgcctcctgggttcacgccattctcttgcctcagcctccccagcagctgggactacaggcgcctgccacctcacgcggctaatttttttttttgtatttttagtagagacggtgtttcaccgtgtcagccaggatggtctcgatctcctgacctcgtgatctgcccgcctcggcctcccaaagtgctaggattacagatgtgagccaccgcgcccagcctattgttttttttttctaagtcggagtcttgctctgtcgcccaggctggagtgcagtggcgcaatcttggctcactgcaacctccatctccagggttcaagcgaatcttctgcctcagccttccgagtacctgggattacagatgcgcataccatgcctggctagtttttgtgtttttagtagagatgggttttcaccatgttggccaggctggtcttgaactcctgacctcaagtgatccacccaccttggcctcccaaagtgctgggattataggcgtgagccaccgcgctcagcctattcactcatttaatttgtgacagtctgatgaggtaggtacaatgattatcctagttttacagatgagcaaactgaggcacagagaggccaagcagcccatccaaggtcacacagccagtggcagccaggcctctctttccttccttaccccagcccttctccttggtcacccagcctcctctttctccccagactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgagcaggctgggaagagggggtgagggggccgagagggtggcccacttgtggctgacactttggggcccacaggtgccccccgtccccagtccccaggacctgctgcttgtggagcactgacctggccaaggcctcatcctggtgagtccttcctgggctatggggcctggactttgtgtctgcaggttgggagggtcactaggaggccatggaagggtggtgagcagtggaggggcaggggcagctctaggtgcagaaagacccctctggggccaggcgcggtggctcacgcctgtaatcccagcactttgggaggccgaggcgggtggatcacttgaggtcaggagttcaagaccagcctggccaacatggcaaaccccagtctctactaaaaatacaaaaattaactgggcatagtggtgtgtgcctgtaatcccagctactcaggaggctgaggaaggagaattgcttgaacccaggaggcggaggttgcagtgagccgagattgcgccactggactccagcctgagtgacagagctagactccgtctcaaaaaaaaaaaaaaaaagaaaaggaaagacccctctggggccacggagacagactggagaccaagccggaggctgtgggaaggcccagggtgaggaccatgactgagccagggctgggaccatgggatggagtggagtggatgggcagagagtcaggggtcagagatcaggagggaccggcctggggcctgacaggcttgagttggcacagatagccctggtccagtgatggggtggacaggggggaacctgggggaggagtcagattagggaaagacatggagctcactggggacctgaaggagcaaggggccctggggagatctgtggatgtgggagtttgcaagcctcctgggacaggaaggaaatggcattccagaaagagggaactgcctttggaagccctttggtatgagaaagctcagggtgttccagtaacttgggccagcgtggggcagcaaggagccatgggaggtgtgagagggaggaaaggagctgggaacaggtgtggagggtgcaggcaggtaggcaggtgggccaggagggaagaaggaggggaggccccagcgggtcccctaacatttcaaatctaacattttgtagtaattgctcgcacatatagtgccttggtaatgcaggcctcatgtggggctggcttgcttgctttatttttttttgagatggactctcactctgtcacccaggctggagtgcagtggcgggatcttggctcactgcaacctccacctcccaggttcaagcaattctcctgcctcagcctcccaagtagctgggattacaggcgcccgccaccatgcctggctaattttttgtatttttagtagagatggggtttcgccatgttggccaggctggtctcaaactcctgatctcagctgatccgcccgcctcagcctcccaaagtgctgggatgacaggtgtgagccactgttcctggcccatgctgggctttccacaaatgaactcacttccttgagaagttcgtgccattatgatcccaaggcatagagaggtaaataatttgccaaaagtcacacagctcaagggtgacaaccaagatttgacttcaggttgtcttttttttttttttgagatggagtcttgctctgtcgcccaggctgtagtgcagtggcatgatctcggctcactgcagcccccgcctcccaggttcaagtgattctcctgcctcagcctctggagtagctgggattacaggtacccaccaccacactcggctaatttttgtatttgtagtagagacggggtttcaccatgttggccaggctggtctcgaactcctgaccttagctgatccgcccgcctcagcctcccaaagtgctgggattacaggcatgagccaccacgcccggcctcgagtttgtcttgatccagcatctgtgcccttcactctgctgcctcagtttcctgatctgtacaaaaggctctaataatagtccttccaccatagggttgttatggggtgaagtgaagtgacacaggcaaggctcttagagcaacgcagtggaaacggcatgtgagccacctgtgcgattttcactttcctggtagccacattttttttttttttttcctgagatggagtctcactctgtcgccaggttgaagtgcagtggtgtgatctcagctcactgcaacctccacctcccgggttcaagcgattctcctgcttcagtctaccgagtagctgggattacaggcacgcgccatcacgcccggctaattttttgtgtttttagtagagacaaggtttcaccatgttggtcaggctggtctcgaactcctgacctcatgatccacccgcctcagcctcccaaagtgctgggattacaggcgtgagccaccgcgcccggggtcacagtttttaaaaaaggaaaaagaagcaggtaactttattttatgcagtatatccaaaatgttgttatttcaacatgtaatcagtatttctcaatgattaatgagacattaatcagttggaatcattcatcattttgggatattttacattcttttgtcatactaagccttcagcatccaacgtatagtttatttatttatttatttttccttttgagatggattctcgctctgtcacccaggctggagtgcagtggcgcgatctcagctcactgcaacctcggactccctggttcaggcgattctcctgcctcagcctcccgagtacctgggattacgccaccacacccagctaatttttgtacttttagtagagaccgggtttcaccatgttggccaggatgatctccatcccctgacctcgtgatccgcccgcctcagcctcccaaagtgctggattacaagtgtaagccaccgcgcccagcccagacaataaatttttatcagaaatgcttcatctatatttaaatttcatgaaatttacagttgccaaaagtagactcacatagtcaagttgttcaaaacatacattaaaccagcctgggccacatggtgaaaccccatctctacaaaaaattttaaaaagtagctgggtgtggtggcacatgcctgcagtcccagctacttaggaggcaaagtaggaggattgcttgagcccacgaggtcgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctgcctcagctaattttgtagttttagtagaaaacggtttctccatgttagctaggctggtctcaaactcccaacctcaggtgatccgcccgcctcgacctcctaaagtgctggaattacaggcgtgagccactgtgcctggccctaattttgtatttttagtagagatggggtttctccctgttggtcaggctggtctcaaactcccaacctaaggtgatccaccagcctcagcctcccaaactgctgggattataggcatgagccaccgcgcccggggaaatatagggaacatttctatcatggccacgttctcttggacagcaatgccctagcacatagtaagcgcttgctgggaatggagttgttttgggcataaatctgtggcccgccccaagctaagctactttccctctcctctctcagcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccagctctggccaggtctgtctatggatgggtgtgaatggggtagttttgatttcagaatcttggtttttgaattgcaatgcaatgtttcattcaatacgtgttttctgaggtcccctggagccccgggccggcgctgggcaatgtcagagcctggatttgagtcagaaccagcccaggtgccccaggtctccttggctatggacgagaagacaagggattcagcgagcctgggtgcaggatgccataggctactatggagataaaacagaggcagtgtgaggggcaactcacccaggcagggagagcagagaggctttccagagccaaatggcattgcgatggtgacaagccagatttggagggggtggggagggcatcctgggcaagggacccagctgaagcaaaggccgacagtccagaaagtgagaagttcctctgaggaacgctcagtggattggtgcagccaggcaactagaagccattccttgatccactcttagagcccctggggaagaccacctccatctgttttacagatggataaactgaggcccagataaggccaagggtttgtccaggtcacagtgaagtcgaccagacacaggaatccaaatctctaagcctagaatgggcaaggctccggggctcacgccggtaatcccagcactttgggaggccgaaacgggaggatcgcttgagcccaggagttcgagatcagcctggccaacatgtcagactccccccgttcccgggccacaacaaaatatatatatatatatatattagccaggcatggtggcgcgcccctgtagtccaagttactcgagaggctgaggcaggaggatcccttgagcccaggaagtggaggctgcggtgagccatgatcgccccacagcactctggtgtggacaacacagcgagaccctgtctcacaaaataaagtaagcccggactgagtgcggaaaggcgggcctggcgggtctggtctccccatgcgggccaccagaggccctgcagccttcagtcgcttgaaggggtaatggcgcttccactcacaaacatggcggacagagcgtgtgaacgagatgaacagcccctcaaaaatatggccgccgaggctggacggccgtgccccagcagcaccgcctccgcgccccacgtgatctctcgccgggcacagcgctgaccgcggaggtccaaccggaagaatgtccggattggacattcggaagagggcccgccttccctggggaatctctgcgcacgcgcagaacgcttcgaccaatgaaaacacaggaagccgtccgcgcaaccgcgttgcgtcacttctgccgcccctgtttcaagggataagaaaccctgcgacaaaacctcctccttttccaagcggctgccgaagatggcggaggtgcaggtatgggctccgcgcgggccggggcggcaaggggccgggtgggatccaggccggaatggggtcgcaccctctctgtcttgcatgttttgcggagcttaacatccataatgaagcaaaatggaagtcttttgggataaggggaatctgtaggaaatgccgcggctctctttaggcctagggttggctacaatgtggcatttccttctcgaggcgagggtgatagagcttccagcacaggacaggtattttgcaactagattttgcttaccttgaactcgggtagtgggtgggggccctggggtagagtcttggccgaattggacccttgtgtgtcctcagcgatgaggaacacgcggaagtgtggccgggcggtctcggggcaatgagaaactgagttttggccaaaatg

SEQ ID NO: 17222 - DNA, 26007 bp, Human
ccaggctccaaaacccagtgagggagaccccctcatggccaatccagcttctcaccattgcccaagagaagcctgcatggtcattccctgcccccagggaccttgctgacctgcctcccaatttcctctccctgactagggacaccagcatgcagggctctgcctctcccatgaccctatcccagacccaggagccccagcccccagcctcctcccatcctggagcccaggccctggcgatacccggctgggtgttcacgggccccctctcctcctgggagacacagtccctttctcctccaagacccagcaaagcaaccccccagaccctgctctttgaggtgtgagattggcttgttcctggggatttcagccccagccttctccaaggccagaacctcagctttctgaagcccaagacacagaaatgcaggctcctagcccctcccatcctagggcccagcctctgactaacttaggacttcccagccttcccctattccagtacgcatgtgtcccaggccatgggctcctctactcctaggaactaatagctcaggccctcagctccttcaaagcccaggcattcattacagtctccagcccgtcccatctttattcttaagcagccagatcctcaggtcctcccaccgccgctcaggcctcctatctcccagtcagctctctctcaaatctggagttttatcccctagaccatgctgttagggtcataggtctgaaaccccggcagcttcccaggtttgcacgcagaaatcccatccccccatccccttccctgttcaggacccaggtatctagtctctcggaagcctgcctccaggacctaggagtctcattttagcgccctcttccctaggacccagaacccgggcttccagcctcctttcatcttaagtcaaacgaaccatccctctcccacccacctccggcttcccagcccctcctcaaggacacagcctccttgcccaggtcacaagggttcccctagtagccccgtcctcctacaactcagagttccgggcccccatccactactgtccttctcgtcaagggccccgacgcctggcgtgctcacccttgttagccacctcccaggccacttcgaagagcactgcgttctccaggtcgaattcatcctcccagtcctccagtcctggcagtgaggacatggacaaagtgcggtttaaaggcatggctggcgcaggaaggggggctccggggatctccaggtagggaccccggaggtgtctagggaatgcaccaggtagggtgcggggccgagtagctggtgcccgacgggaagcttgcaagacgctcggcttcctattgcaagaccgcacccctgccccgaagcgttgggacctaggcagaaggaggccgcagcgtcactgagcccactggcgcccctgcagtgaaacctcgcagccgccaggaggcggtggccgccccccccagccagcgccattggcccacgcccgggggcggggatttccgcgtgtcctcattggtggaacgggttggagtcgctgtgtcccggccccgcctcggccgtgagacctccagggggcggagcttgccgctgcgctttacggaaacgagtggccttcagctctgtcaatctggagctggaggcctcaaagtggggaggaggaggagggtgggataaagaggaaaggagcgtggaggacgtgtggttactcaaagaacagctaagaattttgcaatcggcctgagcggggcggtggtggggctgagcaaaaggaggaggagccaggagacattgggaatggacccaggagttccggacgcccgtcttccagcgcagcctcggtgggagggcggggcataaagtcccgccacgcccccacaatatttacatatttatgaggaaccatcgagatctttgaagaaccagctagcctagaggagccagaacatctcgctcctcgcgcgtttccgtttccgctaggactctggcagttggtgagcatcatggcaaccgttgtaagtgtgggtgcatggagggtgaggagcgagctagcagtctcgagtttgagagaggaggatgctggaggccctgactcctgggtctgagggaggggggatctgggggttcagactcctgggtctgaaagaggaggaagctcggccacccagatctgggggagaaggggacatgggggctggacttctggatctgaggcggggagggggctgggatcccagaatctcgggtctggccccatcatgctataggaactccaactttcaaaatcatcttggcgcaacggccggttccgcagtccttggcgccagtgtgtgatgaggagggttgtaggaccttgcgcttcgagccatttgggagccttggattgttagtggtgccaatggcacttgagttccaagctggaagcacaggcaggtacctgttcagtgtgtctgagagcgcgagggcgcctagtgagcctttagtgggaagaaattgtcgaggaacaagagagtcttagtggagaggactgaaggattagggacccagaaatcgggatcttgtcatgctaccgttttggccattttcatatttccagtatttcacacgggctacgtctcagtgtaaatgctcaataaattatcacttgaatatttgaatgaatgaatacatgtgaatgaaggagaggccaggaaacttggcctggcacctgctcaattacctgaataaagaagcgattttggcctggcgtggtggctcatgcctgtaatcccagcactttgggaggccgaggcgggcggatcacttcaggtcaggagttcgtggccaacattgcgaaaccccgtctctattaaaaatacaaaaattagccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaaggtaatgtgacctgaacttagggactgggctgggcttacaggtgcctcaatttccatgatgagcccagtcaagatggaggaagggagggggagaaagttgttggtagctggggatgagatttgagtctgttgctgtcaccagggcaaggaggaggaggaggtggatagggaagtagaagaggaaggctatgaccagaactaccgtggagaaagtattggaagtatgaggggacggtgtgtgctgagttttgaaatgaccttggttttcatgggaacagcgggcagcaaggttttggagagacttatgatgaaagagaaagtctttataggagacagtccttggtaaggggcctgtttatgttgagagagctacatttgggattcctggattcatgtcttttttgtggggtggggatgcctagtcttctgcttgtagtctgggggtaatgttctatgctcctgggttccagcttcctataggagacggtaggtgggaaggttcacacagtgacagggaaagcttgtgaccattgatggccagaaagtctaaacgattggctccagagggaggaggcttcctctgggctggataactgcatgtcctctctaggggaagaagagaagaaagacctgtgggctgggcacagtggctcacgcctgtaatcccacactttgggagtccgaggtagaaggattgcttgagcccaggaatttaagactagccctggcaacatagcgaaaccctgtctctacaaaaaaataagaaaattaggccgggtgcggtggctcacacctgtaatcccagcactttggggggtcgaggcgggcaggtcatgaggtcaggagtttgagagcagcctggctaatatggtgaaaccccgtctttattaaaaatacaaaaaaaattagccgggcgtggtggcacatgcctgtagtcccaactactctggaggctgaggcaggagaattgcttgaacccgggaggcgaaggttgcagtgagccgagatcgcgccactgcactccagcctgggtgacagagtaaggctgtgtctcaaaaaaaaaaaaaaaagaaaagaaaagagaagaaaattagccaagtgtggtgggacacacctgtagtcccaactacttgggagactaaggtgggaggattgcttgagcctgggaggtggaggccacagcagtccagcctgggggacaaaatgagatcttatctcaaaaaaaaaaacacaaacctgtgggaaggaaggagacctggggatgggtggcctcggttagcatgctagcttcttaggcttccttttccttattagaaattatgaactattccaaagtgtcagaaaataatgtaacagacatgcaaagatccaccatccaggattgtttttttgttttttctttttttcaagacagagtctcactctgtctcccaggctggagtgcagtggtgtgatcttggctccctgcagcctctgcctctctcccatgttcaaatgatcctcctgcctcagcctcctgagtagctgggactacaggtgcgcgtcaccacgcccagctaatttttgtatctgtgtgtgtgtgtgtgtgtgtgtgtgtgtgtgtgtgtgttagtgatagagtcttgctctgatgcccaggctggagtgcagtggcgcgatctctgctcgctacaacctccgcctcctgggttcaagcaattctcctgcctcagcctcccaagtacctgggattacaggcacctgccaccacgcctggctaattttttgtatttttagtgtagactgggtttcaccatgttggccaggctagtctcgaactcctgacctcaagtgatccacctgccttgacctcccaaagtgctgggattacgggcgtgagccaccgtgcctgacctaatttttgtatttttagtagagacagggtttcaccatgttggccaggctggtctcgaacccctgacctcaagtgatttgcctgcttcagcctcccaaagtgctggtattacaggtgggagccactacgcccagcctgttgttttttttttttcttaatagctttattgagatagaattcacgtactacataattcacccatttaaagtatacagctcagtgttttctagtatattcacagacttgtgcagccatttccacagtcaattttagaacattgtcgtcaccccaaaaagaaaccccatgcctcttacctgtcaccgctaatccttccatacctcccatcttcagttctaggcagccactaatctttctctgtatatggatttgcctattgtggctacttcatatagatggaatcataccatatgtgtctttcgtgtgtggcttctttcagtcagtataatgttttcaaagttcatccacgttgtagcatgtatcagaactccattcctggccgggcgcggtggctcacgcctataaccccaacgctttggggtgccaaggcaggtggatcacctgaggtcaggagttcaagaccagcctggccaacatggtgaaaccccatctctactaaaaaatacaaaaaaatattagccaggtgtggtggcggacacctgtaatcccagctactcgggaggctgaggcagaagaatcacttgaacccaggaagcagaggttgtagtgagccaagattgcgccattgcactccagcctaggtgacagagtgagactatgtctcaaaaaaaaaaaaaaagaaaagaaaaaagaactccattcctttttatgactgaataatattcctttgcacaaatagaccctgttttattttgccattcatcagctgatggacatgtgggttgtttctatcttttggctgttgtgaatagtgctgccgtgaacactcgtgtccatgttttgtgtggacctctgggggggtcctgaattgtcccgggtggtgtttactcacctccctcccccatgtgagaaggggtggtagctggctcctctctgtggagaactgtcaacatgggaagcctcggtatattcttgttgaatgagctcagcactttagagtatcacttagcaaaccacagacattgagtcccgaggtgaacaagagagaacaggccgtgcccttcatgggactcatgtccactggagcagagaatattgatccatccatctccctcgggaatgtgagatcacacagggagatcgggctcccagggaggcctttcatctgtctgaatgtctagaggtcctagaactagcctggcagggctgttggacagaaagggcctcccctagggggcagcacttgatctaattcagtgagagggcagggagagcagtctggactcaggggccagcatgtgcaaggcctggtggttgagaactggggccgcctggtacaagggatgctgggaaattagcaggggccagagcatgtccagctccatgcctgctcctcattggtgtctgtccttatggagctcacagttattagaaatggggaggacttgtctgggcacggtggttcacacctgtaatcccagcactttgggaggccttggtgggcagatcacttgaggtcaggagttcgagaccagcctggccaaccccagtagagatgggcgaaaccccatctctattaaaaatacaaaaaaaattagccaagtgtggtggtgtgcgcctgtagtcccagctactcaggaggctgaggcgggagaatcggttaaacccaggaggcggaggttgcaatgagctgagatcgggccactgcactccaacctgggcgacagagcagactccgtctcaaaaaataagaaaaaaaaaaaagaaatggggaggacttagccgggcacagtggctcacgcccataatcccagcactctgggaggccaaggctggtgtatcacttgaggccaggagtttgagaccagcctggccaacatggcaaaaccccatctctactaaaaatacaaaaattagccgggtgtgttgatgcgcgcctgtaatcccagctagtcaggaggctgaggcagagaatttcttgaacccaggaggcggaggttgcagtgagccgagattgggccactgcactccagcctgggtgacagagcgagacttcatctcaaaaaaaaaaaaagaaacagggaggatttcattcattcaccaaataaccaaatatgtgctggaccctgaggaccaagctgtcgatgagacagacagtccttgtcttcctggggctcaaccaaccagccattaggcagtgacaggcaagaggggtgggggtgactggtgcctgtcccatcgcctgcctgtgaggggaaggagtggaaaggaccatctcatgggagggacagaggaggggttggtgaaagctgggaccacactagtcctctgacacatcttcttgcacccccagacagccacaaccaaagtcccggagatccgtgatgtaacaaggattgagcgaatcggtgagtgagttgggtcaggaataggacctaagccctgcctgccatgtgccctgacagagcaaacctattgaggacccctaagatggagagggaggtggcctgcacaccaactgtgcccccactaccattcccccactcgccctatctaatgggggaggaggatcctcagttccagagttgggtcagatgatgcactggggaccaggctgctatcctggctatcctggtggggttcccgggtatgtttgcctggaagtcatagatatttactgggtgctttactgggtttggcctcgtatacccagtacacactgtggggtgagttccctgagggcagggacgaggtcgtgtcattcctagctgtgtccctagcacaggacctaacagagcagatgatcaagagataaccattgaatgcacgagtttgcgtcctgtggagccctcgcagtagccgcatgaggtgcatattgtaactgttagctgagggaactgattttcaggacagctaaatcactggccccggctcacacagagcaggaagttgagacgcagtgaggccagcagggtgcgctctcacaaagagctttaccggcagggaagtgaccgcattcattcatgcagcaggctcactgattcagggcatccgagaaaggcagtaagggcttctggctgtgaagatgggttttagaagcccagtgctggattcctggagcttagctctgccactttcccaccatgtggccagggactagttcctctctgtgcctcagtttccttatctgcaagacgaagctaagatagtttacctcatcagttaatgtaagattcagtaaggtagttcatataaagcattttgggtctgtgtgccaacactgtttcatctattaaaagtgctggggcactgggtgcagtggctcatgcctgtaattccagcactttggaaggccaaggtgggcggatcacctgaggtcaggaatttgagaccagcctggccaacatggtgaaacctcgtctctactaaaaatacaaaaatttgctgggcgtggtggcgcgtgcctgtaatcccagctactcgggaggctgaggcaggaaaattgcttgaacgaggaggtggaggttgcagtgagccaagatcatgccattgcactccagcctgggtgacaagagtgaaactctgtctctcaataaataaataaataaaagtgccgagactgggtgctgtagctcacgcctgtaatcccagcactttgggaggccgaggcgggtggatcacctgaagtcaggagtttgagaccagcttggccaacatggtgaaaccctgtctctactaaaaatacaaaaattagccaggcatggtggtgcatgcctatagtcccagctactagggaggatggcttgaacctgggaggcagaggttgcagtgagccaatatcgtgccactgcactccagcttgggtgacagagtgactccatctcaaaaacaaacaaaaagtgccaagtatggccgggcatgatgggtcacgcctgtaatcctagcactttgagaggtggagtcaggaggattgcttgaatcaggagttcaagaccagcctgagtcacatagtgtgatcctgtctctaaaaaaaaaatcaaaaaattagccggcagtggtggtccatgcctgagtcccagctacttgggagaactgcttgaaccaaggaggttcaggatgtggtgagatgtgactgcaccatgcactccagcctgggtgacagagtgagacgctctctcaaaaaataaaaataaaaacatttttttttttttttggagacggagtctcgctctgtcgcccaggctggagtgcagtggcgcaatctcggctcactgcaagctctgcctcccgggttcacgccattctcctgcctcagcctcccgagtagctgggactacaggcgcccgccaccatgcccggctaatttttttgcgtttttagtagagatggagtttccccgtgttagccaggatggtctcgatctcctgacctcgtgatccgcccgcctcggcctcccaaagtgctggaattacaggcatgagccaccgcgcctggccaaaaaacaataaaaaattaaaaaaaaaaaaaaaggatgaagagccaagcaccgcttgtgagctgaggacccagtagagactagctgcacccaggagcctcccttggggtgctcacagtcaagcactggggtcagcaaatctttccttattttattttatttttttttttgagacggagtctcattctgtcccccaggctggagtgcagtggcgcaatcttggctcactgcaagctccacctcccgggttcacaccattctcctgtcagccttccgagtagctgggactacaggcgcctgacaccacggccgtctaattttttatatttttagtagagacgtggtttcactgtgttagccaggatggtgtctatctcctgacctcgtgatccgcctgcctcggcctcccaaaatgctgggattacaggcgtgagccaccacgcctggaccctagcaaatctttcttaaagggtcagatggtaaatccttcctctgttgaaactactcaactctcctcttgcagtgcgaaggcagccacagacagtatataaatggcagtgttccaatacaaagattttttggttggttttttgttgttttttttttgagatggagtctcactgtgttgcccaggctggagtgcagtggggcgatctcagttcactgcaacctccacctccctggtttaagtgactctcatgcctcagcctcccgagtatctgagactacaggtgcatgccaccacgccaggctaatttttgtattttttagtagagacggggtttcaccatgttggccaggctagtctcgaactcctgacctcaggtgatctgcttgcctctgcctcccgaagtgctgggattataagcgtgagccaccgtacccagctccaataaaattttatttgcaaaaacaggtggctggcctccaggctgaggtttgctcaaccctcatctaatgtaaagcatgggaatcccatcttcccctctcgctggctgtgtggctggggcatgggacctaacctctctgagctccctccccattcatatcaataggttctgggactgttgccattttgatactcagaagtgctttcagggtgatagcagccagggctcttgtttcattttattttgttttactgagacaggtcttgctctgtcatccaggctagaatgcagtggcacaatcttggctcactgcaacctccgcctcccaggttcaagcaattctcctgcctcagcctcctgagaagctgggattacagtcatctgccaccatgcccagctaatttttgtatttttagtagagacagggtttcaccatgttggccaggctggtctcgaactcctgacctccagtgatccgcccgcctcggcctcccaaagtgctgggattataggcaggagccactgcgcccggccccagccagggctctttttttgcaggatcatatggaataaactgagaacatgtgggtgctgtgtaaaccataaacatgaagtaattgtgatcattagcccttgtggttagatcttagtacaattatgtgcttaatcaggcctcagtgacttttgtttaactaggatgcatcctcagagcagctccagttcattgagcatttaccacattcagccatcttcctagggaggtgccaatttgggatatcctttccatgtgccccttcattcccccaacccctgctccctactcccacccacccctttgacaaagaaggaaaccagggctcagaggggtcaggccacatgtgcagcaagctggctagtaactgagtctttgttctttcccttcatgtaggtgcccactcccacatccggggactggggctggacgatgccttggagcctcggcaggtagagcagaggaggctggggtgtgagggcctctccatgaaggtcttgggtagtgggtacccagggtcctggggagtgtggggactatgttacggtcttctggacctttggctacatacccataaacttcaaccacatgtgggttttcttggtactaaagaattgattaggctaggtgtggtggctcatgcctgtaatctcagcactttgggaggccaaggtgggtggatcacctgaagtcagagtcaagaccagcctgaccaacatggtgaaaccctgtctctactaaaaatacaaaaattagccgggcatggtggtgcatgcctgtaattccagctactcaagagcctaaggcaggagaattgcttgaacctgggaggtggaggttgcaatgagccgagattgtgccactgccctccagcctgggtgacatctcggaaaaaaaaaaaaagaattgggagtgggtagcaattgctttgccaccttaaaaaaaagttagactgggtgcaatggctcacacttgtaatcccaatactttgggaggctgagatgggaagattgcttgagcctaagagcttgaggccagcctgggtaacatagtgacacctcctttctacaaaaaattttaaaaattagctggacatggtggtgcacatttgtggtcccagctactcaagaggctgaggtggaaggatctcttgatccctagaggtcaaggctacagtgagccatgattgtaccactgtacttcagcctgggtgacagagcgagatcttgtctcaaaaaaaaaaaaaaaaaaaaaaaaagcagggaaagcttttttggcttttcctagaagtcccagctagtaatgtctgcttccatctcactagcttcctgatgtggtagaaatgccatggtagccccacaggaaatcacctcatgtgcgcctcccacccacaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggtaagaaacctcccagggcaggaactctcctgtttcctgctaaataactcctcctgtgtaagtcagggtcaggatgagccgcctttaacagatgacccaaaatggcagtggcttaaacactcaggattcattcttgcccatggaagaatctagaggtaggccatttggggcttattaagcagttccaggaagtcttccatcttcctgcctcaccatcctctgcacttggttccagtcaagaggacgccatgttccaagagggctgccagagctccagccttcccactcataacccaggcagcaggaagaaaggagttgccatgaggatgaaccccctcgagttggcttcctttaaacagtcattggaaatcctccatgcttctgcttatatctcattatctcattgactagaatgtaatcatatgatcacactctgcttcaggggaggctggcacattaaatgttttttaaaatttcataatttggaccatttttgccttaagaaaatgaggattcttctgttgggcaaaaggttgttgtaaaaataaaaaattaaaaaaaaaaaaacaggaaagaaaatgagggttctagaactaaggaagaaggggaaggtgggtattgaggagtcacccagcagtctttgttgcagtccgctagtggtttatgatcttttcactcccagctgttcctcttcttccttgttgaactcctatttatccttcaaaaccctacttcagcatctctgccccattgaagcttttcctaacccactgctcttcccactcactcccacctctgtgctgaggctggggccaggcagggagaatcagagtaacagccaggtcttcagtgaagataaagcagtgcctgttggggtgctcggactggacactggggacccatagatgagttagaccaaggcctgacttcaaagagctcctggtctggaggaggtggtcatggacacgatcccttccaaggcgacatgtgttacaatgcaggtagcatgtgacagaggaggctcctgaccttggtaggaaaacggggcatgtggtggcatttgttgctagaggcttccagagaagcggatacctgagctaagcctagtaggatggccaggaggctcctgggcggacactggggacagcatgtccaggcccagaatgtggcacacacagtaacttccttccctccatcctttctgctttcctactcttcttcatttttttttttttttgagacagtttcactctgtcgctcaggctggagtgcagtggtgtgatcttcgctcactgcaacctctgcctcctgggttcaagtgatcctcctgcctcaacctcccaagtagctgggattacagatgtgtgccaccacacccaactgatttttgtatttttagtagaaatgggatttcaccatgttgaccaggctggtcccgaactcctgacctcaggtgatccacccccctgcctcggcctcccaaagtgctgggattacaggcgggagcctgtagactttattttttaggcatgttgtgactgtgcccggcctcgcctttcctcttcttgtgtctcccgcaggcctcctgcaggccaaaccctgtgctgggcagcactggggtgaggctagcctcgccctggcggggacgcttcttagtctagtgaaagaggcagagaggacccctggtgtccccagatggcatgggccgtgctcgtccactcagccctcagcagatacttgctgagttctgtgatgagggccattgtgtatccgcaaagaggactaagaacaggtcccacttgacactgggcaggagggtgtggtgtcagcctgtctgaaagggcgtgccccacattggaccaaaccttgtggccagggaactggaaggaaaggtctggcgttcagagctattgctggagacagacctgcttcctgccagccaccccaggccaccggcggtagagcgtcctgccctgtgccagtttcaggctgcgcaaccgtgttactgctgagcaccagtgcctgcctgcctgcctgcccatagtcactcctaagcagggtgtcatcccatgctggcacgtgttctgttatcatccccattagacagagggggagactgaggctcagggagcagttcagatcgctcaagatcccacggcgccacctgcacttaagtggtggatctgggatgggagccgaggcagtctgccttcatcacttgtagctatcgtgtgggctccttggccttcgtccctggtccccttcgtccagctctgaggctaaacagctcgtagaggctgggagactgaggtgtggcgaggttctagggtgtaccctctgggcaatgtgggattctaagccaggcctgccggagcaacctgccctgcctggcttctcactcactgtctgcctcatggctgaaccccgctctccagttccccctccccagcgctctgctcagctcggagccaagtccttacatgtaggatggcactgaaccctctttcctggggtgggagaaaagctagtttgccacagagcaggtgtcggggacctggtgccagagcggcttcacctacacagactgcctccttcccaggcatggcgcaggccctgggccctgacacgccattcacagccatcgccggcagtgaaatcttctccctggagatgagcaagaccgaggcgctgacgcaggccttccggcggtccatcggcgttcgcatcaagtaagcgggggacccgaggcgggtgccagaccccagagcctgggagcaaccccgcaccccgggcggctcgtcctttgtcccagagctcatggaaggttgtgattcccgagggtccaggtgtcaggctgtctcctcagatctgctctctggctagggaggagacggagatcatcgaaggggaggtggtggagatccagattgatcgaccagcaacagggacggtgagtctgtgtgagtctgtaccctgctgaggccacctccagcgccagggttggagagagtagatatcaggtctgcactgaggtcagaatcccatggaatgttctagctgcagactagagccatgtacatgcctacagtaggaggtcagttaacttgacaatggcttatccccttatgaaggacattatgggcaatagaaactgaggcggtaaaataatgagagagatctgttagtgagttcccaacagacctcaaaacccaacagacttcaaaactcgttccgtggccgaaaggcatgtcctgtccatcttacatgatacaggtgatttgctctctcttttttttttgttttcgagacagagtctccctctgtcccccagactggaatgcagtggtgcaatctcggctcactgcaacctctgcctcccaggttcaagtgattcttctgcctcagccttccgagtagctgagattacaggtgtgtgcatgccaccacgcccggctaatttttgtactttcagtagagacggggtttcaccatgttggccaggctggtcttgaactcctgacctcgtgatctgcccaccttggcctcccaaagtgctgggattacagccgtgagccaccatacctggcctctttttttttttttttttttttttttacaatttctgttttctcctttttgcatagctgtgttttctgattttgtgatcaacaaaaacactttttatttgggtataaaataggaatgtcaaagtgtgacatttggcaattttgcgagacctcgggcctatgttgtttttgatagactttattttttaggcatgttgtttgtttactatttttattttttatttttattttattttattataattttttttttgagatggagtcttgctctgttgcccaggctggagtgcagtggcacaatctcagctcacggcaagctctgcctcccgggttcatgccattctcctgcctcagcctcccgagtagctgggactacaggcacctgccaccacgcccggctaattttttgtatttttagtagagacggggtttcactgtggtctcgatctcctgaccttgtgatctgcccgcctcggcctcccaaagtgctgggattacaggtgtgagccactgcaccctgcctgtttactatttttattaagagctttattgagttttggccaggcgcagtggctcacacctgtaatcccagcactttgggaggctgaggtgggcgatcacttgagatcaggagttcgaaacgagcctgactaacatggtgaaaccctgtctatactaaaaatacaaaatggctgggcgcggtggttcatgcctataatcccagcactttgggaggccgaggcgggtggatcacctgaagtcaggagttcaagaccagcctgaccaacatggtgaaaccctgtctctactaaaaatacaaaaaattagctgggcgtggtggtgggtgcttgtaatcccagctacttgggaggctaaggcaggagaatcgcttgaatctgggaggcagaagttgcagtaagccgagatcacaccattgcactccagcctgggcaacaagagcgaaactccatctcaaaaataaataaataataaaaacacaaaacaattagctgggtatggtggcacacatctgtaatcccagctacttgggaggctgaggcaggagaactacttgaacccgggagatggaggttggagtgagctgagatcacaccactgcactccagcctgggcgacagagcaagactctatctcaaaaaaaaaaaaaaaaaaaaaaaaaaaaaaaaaaaagagctttattcaccaggcgcagtagctcactcctgtaatcccagcactttgggaggccgaggtgggcagatcacaaggtcaggagatcgagaccatcctggctatcacagtgaaaccccatctctactaaaaatacaaaaattagccatgcgtggtggcgggcgcctgtagtcccagctactcgggaggctgaggcaggagaatggcgtgaacccgggaggcagagcttgcagtgagccgagatcatgctactacactccagcgtgggcgacagagcaagactccgtctcaaaaaaaaaaagaactttattgagttttaattgacatacagaaagctgtacacattgcaagtgtccagtatggtccgttgggacatacatgttcagccgcggagccatcaccgcgtcaggctggtgagcgcaccgtatgtcttccctggagagcttccttgtgttgtgcccattttgaagctgtggaagcagaggccagagcagagccagaagcttatcaacactgggggcactggggcaacatcagggccctctctgagccccatccctggcttgtccccactctcagggctccaaggtgggcaaactgaccctcaagaccacagagatggagaccatctacgacctgggcaccaagatgattgagtccctgaccaaggacaaggtccaggccgggtgagcagtcaggggccatgccaggcagccagggggatgggcgagcttgggcccattcctttccttaccctaccccccatccccctgtagggacgtgatcaccatcgacaaggcgacgggcaagatctccaagctgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccctcagcctggcactatagcttcgcatggccacatgtggcctgtggcttctgaggtcctccgggagcccccgtgaccctcagcgctctggaatgtccctagtcctgactacctcctgggcctggggtttccagatgaccccatttagcctcccagctccatttcctggagctccagtctcccccagacagagggctttaggggcccccttcatgcccttccctgccctgtctccgccgttcttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgaggcccctcctgccctgccctgccctgccctgccccaggcctagcagcctccctcgggctccctctgttcctgagctccgagtgtggcccacctgctccacgctgtttcctgtaactccggcccgtggctgcctctgttctccacctgcaagtccgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtggcgcgaggagggcaaggcggagatcatccctggagtgaggacccaggacatggccggggcgggtggtggggtggaggtgggccggggaagtggggacgcgggtggtgactctcacacacaccccaatccaaggtgctgttcatcgacgaggtccacatgctggacatcgagagcttctccttcctcaaccgggccctggagagtgacatggcgcctgtcctgatcatggccaccaaccgtggcatcacgcggtgagccggctacaggggcctctggggaaaacaggatgctctgggcagtgggtgtggtcagagggtcaatgggagcctgtgttgacaccgggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagtcttcaaactgcgtgccgaggcaccccagggtgctgcaggaaactcacaggagtgctgtgggatgttttctagtcttgagggaagcacagtgacatctgttagacataacataaactacgattgttcagtcacttcgacccagcaactccattaacagaactcttagcgttgtgtttggcctaaggatgccagggacagattcccatgacacagagggtaccgtgctctgctgaagcctgggaacctcatctcccaggtgttgccagcaccctgtgcacggggaactcttaatgttgtgtttggcctgaggatgccggggacagattcctgtgcgctgccctgggaacctcgtctcccaggtgttgccagcaccctgtgtagctgggattacgggcacctgccaccatgcccgctggctgtcttctccacctcgccacattttggcccgcaggaagcagggggggtgtgggagggcaggcagcccccataggctgtgatccacaggctgcaccccaaccttgcacccccattccattgcccggcactgcttgggctcagtgctgtacctggtggcaaagaaggctgggtactgtcagctccagccctgcagccttgggcccagctgaaactgggcggttgggatgggcatcacaaaagggaagaagcgggcaccctacagaggatgctgggccgctgggcctggctctgtgtttggctcttttaactccttggatccgcagaagaagctcagaaggtagatatcacctcagccccattttatagggcaggacagtgaggcccagtgacttgcccaggtcacaagtctagaaggtagcagggccgtaatttggtctctggatggctggacactggaagagacccccagggctgatggtgttttcacagaaactgcaggtcagggcctggggactgcccaggggcacctcctgtgggaggcagcagctacgggcagccctgattgttcgtagactctgtatctgagaatctcgcttgctaagatttatttgtaatccccaaataaatatctgccctgctttcggcaacaaattcaagtcacctgacacccactttcccagctgagtgtgaacgaggcaacactgcctgctcccttagcgctcatgctgtaaataagtgtccttgttgtattctatttagtgctacgtttgtcacttttgttctttgagacagggtcttgctctgtcgcccaggctggagtgcagaggcacgatcatggcacactgcagcctcagtgcccaccacacacacacacacacacacacacacacacacacacacaccacccctgggactcaatcagtcctctggcctcagcctcctcatcagctgggaccacgggcatgcaccactatgcctagctaatttctgtttttgttttgagacggagtctagctctgtcaccaggctggagtgcagtggcacgatctcggctcactgcaacctctgccttctgggttcaagcagttttcctgcctcagcctcctgagtagctgggattatgggcacccgccaccatgcccagctaattttggtatttttagtagagacagggtttcaccatattggccaggctggtctcgaactcctgacctcgtgatctgcccacctcagcctcccaaagtgttgagattacaggggtgagtcaccgcgtccggcctaattttttttttttttttgtagagatggtgttttgccatgttgcccaggctggtctcaaactcctgggctcaagcaatccacccgcctcagcctcccaaagtgttgtcactttttttgtgccttttttttttaaactttttggggccatttgttggtgatattgccatttaaagtgtcccctgtgcacagtgttgaagtgctgtctagtatcctaagtgcaaggaggctgtgaagcctgacggagaaaatgccatgttacagacgcttcgctgagcccaagttagaatgctgttgacacgagctccatgttagagaataaacagtgatgttacataacaaacacatggaaatagaaacacacatacatgaggccaggcgcggtagctcacacctgtaatcccagcactttgggaggccgaggtgggtggatcacgaggtcaagagaatgagaccgtcccggccaacatggtgaaaccctgtctgtattaaaaatagaaaaaactagctgggcgtgatggcgtgcgcctgtagacccagctacttgggaggctgaggcaggaggatcggttgaacccgggaggcggaggttgcagtgagccgagatcgcgccactgcactccagcctcgcaacagagcgagactccgtctcaaaaaacaaaccaaaaagaccagaaacacacaaatgaaaatacgcatagacccagattatatatatatggattgatgaaaatactgtaagccgaggctcgagagagcctaaccctgtattccagtaggagcagtggctcaggatcagctaattggagtgttcacgatgactttctagaacctcactactgtgaataaggggaactgactgtatcccctggcaccagccctgggctggccccgctgcagcagggaacaagacaggtgcagtcccctcctttgtgaagctttgtgtcgagcacgggagtgggaccttgatccagtaatcctggaggcagagatctagcttaaagcagcccagctccgcggaaaggtgcccttgggggactgacgcagctgtggaaggctgcgtcatcaggggtgatgtcatcatgtgacaggagacgcgagctaaaggttaagtggtgttgggcccagtgagtgggtggcgatgggaggtgagagtgttcccagcaaagggaatgaagagggaacatgcccctgacagccccctctttctgcctcttcctcagaatccggggcaccagctaccagagccctcacggcatccccatagacctgctggaccggctgcttatcgtctccaccaccccctacagcgagaaagacacgaagcagatcctccgcatccggtgcgggcaggaccaggccgtgcgcctgagacgcagggctggggtctaccctgtttgacaaatgctgacactgaggtccagcggagtggcatggtggctgggcctacaggagagagggctgagcgggcacccagacggtggcctccgatccgggagcaggagccacggtgggaaagggaggcgaggtacccgtgactggtgttggggccagcgccctgggggtggtcaggaggcctcggttttaggtccagcccagcccctgtctccgtggctcttctagcctcagcattctatggttctaagatgcaggcgccacatattcccagtggggaagggccagagggttgctgtggccacttctgctgcagtcagaggctgggccccggctgagccacccctgtcccccactgcttgcaggtgcgaggaagaagatgtggagatgagtgaggacgcctacacggtgctgacccgcatcgggctggagacgtcactgcgctacgccatccagctcatcacagctgccagcttggtgtgccggaaacgcaaggtcagccggccgaattagccagcagggccagatggcggcagtgagtgacacagtacttcaggggcttccagggttctgatttcatcctagaatgtacgttttcagacgcagggaattttcatccctcaggttggcttctgtatcatccagcctggcctatagtaggtgtcagtaaatctctcttgacttaagtagatgctgttaggtccaccttacagataaagaaactgaggaatgaagaggctgggcccacaacaaggagatggccaggcaggatttgaacccaggcaatctggcccagaatgccctcccctcacatgccacactctgctgcctagagcatggaggtggcatacgctggggtctgtgccttgagcctcacggagaggggcccaactgaggactcgccctccccctccagggtacagaagtgcaggtggatgacatcaagcgggtctactcactcttcctggacgagtcccgctccacgcagtacatgaaggagtaccaggacgccttcctcttcaacgaactcagtaagaatccccaccccgcacctgcactgccagagccaacctcagagggaggaagagggagctcggcgtagaaggctcaggccctgccacctgggcgacactgaccatgtggccttccttctccccacagaaggcgagaccatggacacctcctgagttggatgtcatcccccgaccccaccctgttttccaccagagttctgacactgtgactctgtataaaatggttgggaagctgcacccaccctgtgtatgtgtggttgccctgagcccacagaaagacaccgccagagtgcggattgagaagcctttattgtgggaggatcggggtgtcagggctccaggagtcgggatggacttggaaggctgcggggagggtctttagaggaagaggaggcctgagagttgggggtggtcacaggtcaaggggtggtctttgggacccccacagtcagaggtgctgcggcggcagggtccacagcgacagctgagagccacagggaaggagaccacggggtccacgccacgcgggcagccagggagccggatggactcgaagcgcacatcacggtaggtgcacaccacctgaggcaggggcggcaggaccgcctgcagcacgcgcatctggaggccgtgtgagtgggggaatgagcatgtgcctgaggccagcgcctcagctgagctcccaagctgaccccacaggtcctggactcaggagcccaggaagccctctgttcctgccttcccacaccccattccccaaccgcaggccagagaggcagaccacccttcctcccccgctgcctctgtgggtctggccctgaggtggcagcatctgccccggccccgggcagctcaccatggtggggcagtagccggcacagatggtggtgttgacggtgatgcacacggggcagccctccttctccacagccaggatggcattgatggggtggcaccatggccgaagcggctccctggatgcccatgccccgcccatgctcagcagcagcaacagcagcagcccctgggacaaggacactgcttcacccgggcctgagaccacagccccgagccctggccttcccatcccgcgtggtacaccacccacaaagacccagagacccttcctggcatctcctattcaggacccaccacccggacacctgcctttcagagcccaccccacagcccagaggacctgagatgccccaacatttcagatccccaccctcaggaactgccccacctgaagcttactgggggtcatgcccctccagaaagaggcctccttccacagctcacacgggtctgccccttctcatgccagtgatggcctggaaggaggtggaaggtgcccaggggccctgtagtcttacctggagcatctccatccttggtgcatcccctgcctcgtgtatctggctatatacctcggggttgtgggggcggcaaggccaccaggaggtgataggatgctggggtaacctggacactaatccccccgggggcgagaggtgcacatggccagggaggcgcaggagtggctcagcagagtgccccagccctctcccctcagtggtctagcgccagaggtgaggcagagaccacggtgaagtgacctcagagacccagttgtcgagtgctagggactagtcgagcctggaggcacagggagtagggtgtaggaaggcctgcctctgccaattgtggggtcttgggagccaggaggaggccatgacccgagaaaggtgctggactgaagcctcaaccctccacttgaggctttcctgcaccacagtccaacctaacaggaggggcgctgcttcggacttagcttctgcccagtgagagagggtctccccgtgactgtgctgccagggaagccacttgacccagatgcccccaaggagggattaagcccgagccccacctctcccttagggacctccgcccaccctaccctcaagccaggatgcccggagcgtccccggaagtgggtgtggttcaggtgatttaactcattatttaatacgcccgcagggtgcgtgtcttgcccccggggccacagcctgcaaggacattatctggacttagtcccctctccgtgatgccgcagctgagtgggtgtctgggctagtcccgcccccacgttgccaatagacgtaatgagtgcgactcaggctgggtccggaacccttcctagtgagcggaggtcccgagctccgctcggcagcgcg

SEQ ID NO: 17223 - DNA, 20103 bp, Human
ccccttcctaggactctcccaccccaaactccaacctgtatcagatgcagcccccaagcccttagactctaagcccagttagcaaggtgccgggtcaccctgcaggttcccataaaaacgatttgcagccagaaggaggaggatatcgttattatttatttcccatcctttagacgagtccttctgccccacttagcccttgcaccccagacccacaagttgcctcgaccctgaaggactgcagctccccccgccccccaaccccaggccttgcagcaagcaggtgcctgatgttgctagccctgtcgctgtcgccaggggctcctgggaagggtagagcggtttggcttcaccagcgcgctaactaaaggcccgcaggggagagtaaattaagcgctaattaggaggtaatggagggggagacgcagaaggccctcttactcttggccctcagggaaaaggagttttcctctcactgcctgtagaataggaaggtggctggcaagaaaagtccaaagggaagagaaagtagggggttgagacatctggatcagagggaggaggggctgaaactcctgggttttggtccgcagggcactgggggacgcagactccccagctggacccagggggggggcagggcccgggtgcgctggcgtcccccaggtgaggggtggagctgcagggctgctgcggattggctgtggccgggggggcgtgtgcaccaaccgctgattggccgcggcgggggcgggagctgtcagtgggccccgaccctacagcccggggctggcgggtggggcaggaggactggggcggagcgcagaaaaacagggcgacgccctgtgagggaagggtcccgcggtttggctgtttgggcctgtggctgttaggggtggcaggatagtgacccggggacaggacttgggggcactgtgggggtagaatttggagacagagtgtcccagggtaggattgccgagacacgatggccgagggatacgattttttttttttttttttaatttgagacggagtctcactctgtcgcccaggctggagtgctgtggtgcaatgtcggctcactgcaacctccgcctcccgggttcaagcgattctcctgcctcagcctcccgaatagctgggattacaggcccccggcaccacgctcgactaatttttgtatttttatgtatttatttttatttatttatttattttgagacggagtctcaccctgtcacccaggctggaaatgcagtggcgcgatctcggctcaccgcaacgtccgcctccagggttcaaatgattctcctgcctcagcctccctagtagctgggattacaggcgcacaccaccacacccggctaatttttgtatctttagtagagacggggtttcaccatgttggtcaggcgggtcttgaactcctgaccttgtgatccgcccacctcggcctcccaaagtgctgggattacaggcgtaagccaccgtgcctggccttaatttttgtatttttagtagagacggggtttccccatgtcggccaggctggtcttgaactcctggcctcaggtgatccacccgccttggcccccaaagtgctgggattacaggtgtgagccaccaagccaggactttttttttttttttttttttttttttttgagacggagtctcactctgtcgcccaggctggagtgcagtggcatcatctcggctcactgcaacctctgcctccccgattcaagcaattctcctgcctcagctttccgagtagctaagattacaggcgcccgccaccacgcccggctaattttttgtatttttagtagagacggggtttcatcatgttggaccaggctggtctctaactcctgacctcaggtaatccgcccgcttcggcctcccaaagtgctaagattacagacctgagccacttcgcctggcagggaccgtatttcaagtcctgccctcccaccagcgcctgcgccccgcagcagtgtccggctccctgccgacgccctggagctgggacggcctggggcgctggtcggccgccttcccccagaaggaggcgtgagcggggcgtggccggaacgtctctcttcggagccgcgccccgggcgggcacagttacgcgccgcacggatcatggccgcagccgctctggggcaggtgggttcgcagccccgcgccggggtctgggaaataaccgggggaggcgcacttccgggaagaccactggcctgcagccggtccgactcggcgccgctcctcccgccctggggttccgctgcagggcgcggaggaggatggcgccctttggaaaggagcacgaggctttaatggggtgagggggagcaggtagacgcggatgaggtggggcaagtaattggcggggaggtaaaaaaaaaaaaaaaaagggaaacatggtggaggaccctgtaatgagggaggcgtgggggtggggaggttgtgatttggggagcggagccctggggtgcggtggggcatcagcctgtgcgggagctggaataaaggggcccagacctccagggccgggtgcaggtgaaggcagagttggacctcaagtctcagctctgggaattggactcaaggtcctattttcttggaatgaaagttgaaaaaaataagagatggggattgctgtgcttcccaaactcctatctgaagctttgcacctggattggaaatcgaggcagcgtctcatggtcaaagtgacagatgctgcaggctggctgagacgatcccttctgactgtgcgatgtcaaacagcagcagcgtttcccagagtctatgatttcagagaacaaggtttctcagtgaggaaggaaacagccaaagaaaggggtcattacaagccttcacagctgcggtgtaaccttgggagaactgtctgttaactttacacctgactttatttgagtctcttatcctagctgatgaatgtcagggcagaatttcacttttttcggctcttagtgactgatagggatagtcctgggatacctggggtatgtgggcaatctgggctttagtggtgacactcctggactgtggtggggcagtactgggctttgacaggtccacttgggactgatgtggaccgtctcatcatggcacagttctggtgtcatagaatggccctgaactcatgatgggacattcctaggctctgatgaagatagagatatcctgtaatggagataattgggctgagtcctcagctgtgatggggacagtcccggggtgtggagaggacagtgctggaccatggtagggacagtctggaaggtactggcctagacagcaacatagggatagtcctggggattgaaaaagacaacaatgggattttttttttttttttaatttcagacctggtgaataggaaataagccctgatatttggcagagacaatgctggttataatggggaaaagtgctgggctttggataggggacattcctgagctgtttgggacagtacttggctctgctggggaccagttctgataagttacaggcacaatctggacttgtgatgtggagcatcttgggccatcatagaacagccctggtctgtgatgggggagagtcctgggctataaagggggcagttctagacgtgatggggtcatgtgtgggctgtgacaagggcagactgcggtatgatggggtctctccggggccgtgatatggggacagtcctggagtatggagggcactgctgggctttgacagtgacactcctggtctttgatggtgatactcctgggctgtatgggacataatggaggttctatcacattatagagacctgccctgtgaacccccaaacgtactttatttctttgtctcgtcttttctttttgaccgagtcttgctctgttgctcaggctggagtgccgtggcacgatctcggctcactgtaacctccgcctcatgggttcaagtgactgtggtgcctcagcctcccgagtagatgggctcaagcgatccacctgcctcagattacaggcatgagccaccatgctggtcttttttttttttttttttttttttttttttgagagacactctatcactcatgctggagtgtagcagtgtgatcgtagctcaccacagccttgaccagtaggtcaaggtgatcctcccaccttagccttctgagtaactggaattacaggtgtgtgccaccatacctggctaatttttaaattgtttgtagagacagggtcttgctatattgcccaggctgatcttgaactcctggcctcatgcagtcctcccacctctgtctcctaaagtgctgtgattacaggcatgagctactgagccagctgcctactttctttctttgttttttttctttttaattgagacagagagtcttgctctgtcgcccaggctggagtgcagtggcaccatctcggctcactgcaacctccgcctcctgggtttaagcaattctcctgcctcagcttcccaagttgctgggactacaggcgcccgccaccacacccagctaacttgtattttctgtagagacagggtctccctatgttgcccaggctggtcttgaacacctggcctcaagctatcctcctgcctcggcctcccacagtgctgggattacaggcgcgagccactgcgtgtggcctctttctatgattagatctattttggcatctcttgtttcttggcgtcaatttctgtttttgtttttttttttttctgtttgtgcgcccctttctgtgtttctttttctcatccttcctcttccatctcttactctctttttttcatcttggctctgagggcagctctcctgcccacaggctggctgtcgcactgtgtttgtgtctctcatactgtgggtgtcctatccctctgggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcaggtaatcagagcccagttgatcgaataccttcagagaataagcacctgtactcctgggtctggcggaggaggggctggggaactggactcctgggtctgagggaggaggggtggggcctgtactcctggatgtaagggaggagggtctgaggcctggactccagggtctgagggaggaggggctgggggcccagacttcgggtctgagggaggaggcagctagagtctggactcttacttaggtctgagggaggcgggcctggggtctgcacccctgagctctgggggagcaggacctgtcggtccttggtcttctaaggcctgtcagcacttgggtacccggaggccttcacttacctgtgtgccttccctggttgttttcttgtctgagctgatttccaggctgcgaccaaaggtctctggggtgggaggcgcttgcgtttgactttgccgcagcatggaggagggggcgggagctgactcagctctttccagcgagccctcgtcagggcagggaggggacttggcctccttcaggaccacctgccccgtctagaatggactgaaactgggacagaacaggcaggccagtgggacctccaagtgcaggaggtggcgagcgagctgccagggcccctgctgtgccccactcaccccctctctcacttctttctccacccagatctgggcacgaaagcttctctctgtcccttggcttctgtgtggtcccagaagatatgcctcctccagtttcaaggtgaaaggagggaactcgatgcttggctctgagagaggagggggctggcagctggttttgggcatctccaaaaggtccacagcccagagatggcagtgagtggtggtagcttaacagcctgccattgggccgcagacaagggatgaaactgcatgtcccagaatcctccagggtgacaggtccttcttctctatgggtctgaggcccagggcttcatgggagttgtagtttttcagctgggaggttgtggccagattctaggatacccctgtctttcctcaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcaggtggcatggcggccggcctctctccctgtccctgtctgcatctcctcctccttgctgtgtctcttgccaggtgtacctctcttggtttgtttgttgtgtgtttctcctttctgtgcattcaccatttgttttctgaggccttccatgctccaggctcatgcttggtgatgctgggttccccgagatgagcagacccggttccttcacttggaaaaccccatgctgtgggcataactcagtatgatctgtgctctgatggaggccctgtggaggccagtagagacccccagcctcacttgaaagaaagcatggcttcttctggcatagagggaagcttagagggggatggtgggagaggtgacagggtgatggtaggaaaggggacagccggggggctggcgggagagggacagccaggatgatcgcgggagaggggacagccattggggggggagatggtgggggagggcacagtcagggggatggctggagaggggacagccaggggagggatggtgggagaggggacagtcaggggagggatggcgggagaggggacagccaggggagggatggcgggagaggggacagccaggggagggatggcgggagaggggacagccaggggagggatggcgggagaggggacagccaggggaggcatggtgggagaggggacagccaggggagggatggcgggagacggacagccgggggagggatggcgggagacggacagccgggggagggatggcaggagagggacagccgggggagggatggcgggagagggacagccggggaagtgatggtgggagagggccagccgggggagggatggcaggagaggagacagcccaggggggatggcgggagaggggacagttggagatggcgggaagggggacagtcggtgggggatggcaggagtggagacagccaatccaaaccccaaacgggagtagagcctggtacatttgggagaaattgcggtgttggagcatggttaaggaggctgaaaatgtcagggccatggaggagctgaggggctggggccttgtccaagggtgctgggagccactgagggctctgaggaagggaggggcagggccatgtctgggtatagtaagagccctctcaggccatgtggagggcaagagttgcaggctaggaagccgggctggtgaccaggtagaccttgggcctgtccccacatggggacccaggaggaggagcggctttgtggcacctggtgagcctgagatactgtgaagtttctaggagacagatccaggaggcatttggttttaggacttatagctgcggctgaaagcaaggtcttcagaaggaaactttggttgagacaagatttaagtgagcatcttacagctccagtaactggttagcaggttggctgattttagtcctccagggcacagttctgtggcatgaagacttttattccattcctttctttcctttccctccctccctctgttttttcctttcttccttcctttccagaattttaaggttttgttttttcccctctcccctcccactctggacatctaagcaacaccagtcgattctgtacagagcacacacacctccaatcacagccagacactcctgccagtacataagcgtgatgggcaggattccgcctgctgagcccccaggaagctggttacttggagaccaccacacacttctcccttcagcccagcacagcagttgtcctctggctggggacccagtactttttcttcagttgagtgagagcagaggaagcctgtggccctggcagacagaacgcactgctgtgatcccgcgggtccagggggcggaagggggaggatgagggagtaggacaatgctgtccctatgtcacccacactccagggcatgtgtggattgcaggccgaccacgtgtattattttttattttattttttcttatttatttatttagagacagagtctcactctgtcccccaggttggagtgcaatgatacaatctcgctcactgcaacctccgcctcccgggttcaagtgattctcctgcctcagcctccccagtagctgggattacaggcgcccgccaccacacccggctaatttttgtatttttagtaaagccagggtttcaccatgttggccaggctgttttcgaactcctggcctcaagtgatctgcccacctcagcctcccaaagtgctgggattgcaggcgtgagccaccatgcctggccttattttttattattgtggtactaatacgcatacataataacacacagcatcaaatgtgggattccaaccattttatttgtttgtttgtttgtttatttatttatttatttatgagatagagtttcactcttgttgcccaggctggagtgcagtggcacaatcttggctcactgcaacctctgcctcccaggttcaagtgattctcctgcctcagcctcctgagtagctgggattatagacatgcaccactattggctaatttttgtatatttagtagagacacggtttcaccacgttggccaggctggtctcaaactcccgacctcagatgatccaccgcctcatcctcccaaagggctgggattactggcgtgagccacggcgcccagcctccaaccattttaaagcccataattcagtggcaggcaatgttatgcaaccatcagcaccatcaaggttcagaactgtttaatcccccatacctattaatcagtacccattgtccctcaccccagcccatgacaaccattagtctgctttctgtctttgtctacctgtatttgtttatttattatctttaaataatagggatggggtttcaccatgttacccaggctggttttgaactcctgagctcaagtgatccacctgcttcggcctcccaaagtgctgggattacaggcgtgagtcaccaagcctggccacctgcatttttgttgttgttgttatgactctttttttgagaaagggtcttgctctgtagcccaggctggagtgcagtggcacgatcttggctcactgcagccttgacctcccaggctccagcgatccacctgcgtcagccttccaagtagctgggactgcaggtgtgcaccaccatgcccagctaatttttattttattttatttttttttagggatggggtcttgttatgttgcccagggtgatctcagatttctaagctcaagtgatcctcctgcctcagcctcccaaagtcctgggattgcaggcatgagccactatatccggtgtatccgggctcttttacctgggttttgttttgttttgtttttgagacggtgtcttgctctgtttcccaggctggagtgcagtggcatggtctcagctcactgcaacctccgcctcctaggctcaagtgatcctcctgcctctgcctcccgagtggctaggactacaggcacacaccaccttgcccagttaatttttaaatcttgtgcaaagacaggatctcactttgttgcccaggctggtctcgaactcctggcttcaagcaattctcccaccttagcctcccagttctggggttacaggtatgagccatcatactgggcctggaaattcttctctataccttaaagcttaaagagctttttccatctttcttgcagcctcatgctgtatcatcctaacaatgcacctccttaggcaatcccctactgttggacacttaggttgtttccagtctattataaacaattttgcaataaagaatctagtacagggccggctgtgatggctcacctgcaatcccagcactttgggaggctgaggcaggtgggtcacctgaggtcaggagttcaagaccagctttgccaacatggtgaaaccccatctctactaaatatacaaaaattagctgggtgtggtggcgggtgcctgtaatcccaggtactcgggaggctgaggcaggagaattgcttgaacccgggaggcggaggttgcagtgagccgagattgcgccactgcactccagcctgggtggcagagtgagactccatctcaaaaaaaaaaaaaaaaaaaaaaaaggaatccagtacacacgtcccttctttagtcacttgtttaagtgcaaatgtatctagaggctcaatttcgggaactgtaggtcaaaggatatgtatgcttgtaatcttgatacgtatcgccacatctacatctacagggtgtgtcagtttccacacccaccagcagagcctgtttccataccttggacaacccttgtccaagttttagatcttttccaatctcccatgtggttttaaaggtatctcaaactaattttaatttgcatttttctccctagtgattaatgaaattgactatcttctcacgagcttaagggccacctgtatttccttttgtgtgaactgtccatttgctaggctgatttttctatcaggttaggttttaaaaaattcatctggggctgggaagaagaggcagggggattgcttgagctcaggagttcaagaccagcctgggcaacatagtaagaccctatctgtacaagaaattggaaaaaaaaaaaaagtccagtcgtggtggctcacgcctgtaatcccagcactttgggaggccgaggtgggcgcatcacctgaggtcaggagttcaagaccagcctggccaacgtggtgaaaccccgtctctaccaaaaacacaaaaattagccgggcgtggttgtaggcacctgtaatcccagctacttgggaggttgaggcaaaagaattgcttgaacctgggaggtagaggttgcagtgagccaagatagagcacttcagcctgggcaacagagtgagactccatctcaaataaaataaaaaataaaattcccaatccaagatataaaacagttatttttgtttccttctatagcttttatggtgtaatatatatatatatattttgtttagacttttaatgcacctggaattttttctggtgtgaggtgtgaaatagagattcaacgtagtttttctctagatggatatttggttatctattccattattcagtctgtccactcatatagcagtgtcactctgttttaagtattgtagatttataatgttttactacctgatatggctactccctgcccctgccccatcttgcccctcatttttgtggtggtggtttttatccccccaaaatattgtagctagttttgcttgtcttccattcatttatctattcattcatcaaaaacccactatgggaaaaaaaaaaaaagtctggctgggtgcagtggctcacccctgtaatcctagcactttgggaggctgaggcgggtggatcaactaaaaatacaaaaattagctgggcgtggtggtgggcgcctgtaatcccagctacccaggaggccgaggcacaagaatcacttggacctgggaggcggaggttgcaatcagcagagatcacgccactgcactccagcctgggtgacagagtgagaccctgtctcaaaacaaaacaaaacaaaacaaaaaaacactctgtgccaagcgctgcctaccctggtgcatgggactgcaggagaggctgtctggtaaacgtgtcaagggtaatccctgccttccaggctcttccactctgcagtggagcagatgctgaacaagcaaacttggaaccatggggcagtgatcagggacagagtctccagaaaaaaaaaactaggtcccaggctggagtgcagtggcatgatcgtggctcactgcagtctcaaactcccaggctcaagtgatcctcccaccaccttccaaatacctgggactccagtcacgtgctaccacgtctggctaattttcgtattttttggtagagatggggtcttgctataatgcctgggctggtcacgaactcctacactcaagtgatcctcctgcctcggcctcccaaagtgctgggattacagtgagccactgagcccggtcgtgtcctttgctttctagagtctccgtgtgtctctacctgtttgtctccctgtctatatctgtctctctttttctccatctctctgacccagctgctaaatctccccggtgctctcctcttggcctccatctttcagttgtctgtgtctttgtgtatctgtctctgtctgtcttggtgtctctcatgactgtctggagaagtctctgagcctccccacccgcgtgtccccgcagctgtttgagggcatgaaggcgttcaaaggcaaagaccagcaggtgcgcctcttccgcccctggctcaacatggaccggatgctgcgctcagccatgcgcctgtgcctgccggtgaggggtcccggtccaccggggtggggaggagggctggggccggggcagcaagggccccttgactcattcagaatcccacccagagtttcgacaagctggagttgctggagtgcatccgccggctcatcgaagtggacaaggactgggtccccgatgccgccggcaccagcctctatgtgcggcctgtgctcattgggaacgaggtgggcccaactccagggctgggaagctgggctgcgggggttggattctgcagggcaggggtggggtcctggaggcctgggcctggggacgggaagggactgggggcctggactcctgacgctgtccctttgcccgtcgcagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggtaagtagcacccccatccccagaacgactggcgcactgggcgttggagacacagggaccagcgtgcgtgctttcggccatgcctctggatgtcacatgaaggtgacatcatcagcaccgtgcagggctcagtgctaagtgacctccctggtccctgaaaacaaaccatggaaggaaggaggaggggattatttttcagatggacaaaaaggctcacagatgggaaggcattgggtggaggtcagtggggaaaccaggactggtccctggaagcctccaggagtgaagcttacactcagctcattggcttctcgccccagaagcctcccctgatcccccaggctgggctgcgctccccatacccagctcccacagtcgtttgagcctccaaagcccctcacccccgtgtggactttctgtgtaaatctgtctcccagtggcctcagctcagcagggcaggaaggagacagctgggtctcctgggcaaccaaggcagagggtgggcactggcgtgttgggacaggaatgtggccccagctgggggtgcattcaggtcctttcagccacatcctgtgaggtctcctgagggccaggccctgtgctggcagaagctggggacacagatgagtcagccccgagccctgctctcctgggtctcccaggctggtgggagccccagtattcggagctgcatgttctctggtgaggtgacccagggcattgtgaaagccttcacagaggccagaggcggtggctcacgcctgtaatcccagcactttgggaggctgaggcgggcagatcacgaggtcaggagatcgagaccatcctgattaacacagtgaaaccccatctctactaaaaatacaaaaaaaaaaaaaaaaaattagccgggcttggtggcgggcgcctgtagtcgcagctactcaggaggctgaggcaggacaatggcgagaacccaggagacagagcttgcagtgagccgagatcgcgccactgcactccagcctgggcgacagagcgaaactccatctcaaaaaaaaaaaagaaaggtttcacagaggaggcgacccttcaactaggtctgacgaggagggaggagggggtttcctgggtacaaaagtcagcaaactgtttccagtcctgggaaccatgtgtacagggacagaaggaataggatcacagaagatgttcaggttacaaaaataagtttgggttttgaaaaatgcttagcaagtattcattagacccaggcaggcctggaatgccggaaggaggctagggtcttgtcctggggcactggggagccatgggaggcttgttagcagctgaggggagaggctatctctgggagagagactcagaaagtcatccaggtagcccagttcactgggggagtccagggaaggtccagcacccagcctggaggtctggaaacacctctcgaggaggtgacaacagaaacggttttggagccaggcgcggtagctcacgcttgtaatcccagcactttgggaggccgaggtaggcggatcacttgaggtcaggagtttgagaccagcctggccaacatggtgaaaccccgtctctactaaaaatataaaaagtaaggccgggcgctgtggctcactcttgtaatcccagcactttggggggctgaggcgggcatataaatataaatgtgaatataaattagccggacatggtgctgcatgccccagttactccagttactcaggaggctgaggcacgagaatcgcttggacccgagaggcggaggttgcagtgagctgagatcgcaccactgcactctagcctcagcctgggcgacagagcaagactctgtctcaaaaaaaaaaaaaagaaaaaaagaaaaaaagaaatggttttgaatgacagctgaggatttggtcagtatgaaatgggtgagggctgggcgcggtggctcacgcctgtaatcccagcactttgggaggctgaggcgggcagatcaccaggtcaagagaggctgaggcaggagaatctcttgaacctgggaggcggaggttgcagtgagccaagatcgcaccactgcactccagcctgggtgacagagcgagactccgtcttaaaaaaaaaagaaaagaaaagaaagaaaagtgggaagagacaggagagaggggacataaccatttagggtcctgatgccaaatgaaaagtcaaggattccatctcaggggaactggggagccctgtgagagctgtgagcagggagacgggagagagtaggatgagcctcctctggggctgggctggggaaggatggggctcccttgccccacccaaccaggctgccctccaccaggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatgggggtaagcccacccatgacccagcccgaaccctggtggaagtgggtggcaccatcattcctggcaggttacaggccccagggattctgggatgggggaagggggtggctcttaagacggcggtgctagggggtgagaggtaacatcttccaccccttacacctgccctagtgctggagctggtgacgcccccgctgaatggtgttatcctgcctggagtggtcagacagagtctactggacatggctcagacctgggtgaggacatggcatcttctggtgatgggcgccatgtgccaggggccagggcatcagagggctgggactggggcacactggcatgtctctgccccttctcctgggtctgtctctcccgttgggcctctgtctttctcactatcctcagggagggagaggtggaggtctgcagcagggcaaccctctggggacacgtgtctctgccaactgccctgcagggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacagggtgaggcggggctgccattgtgggtgggagggaaggaggggaggggcttggtcctcaccgcaccttctgtcccagaacctccacattcccaccatggaaaatgggcctgagctgatcctccgcttccagaaggagctgaaggagatccaggtgagctgcagggagctggggaatgggctgggagcttgttccctggagaagttggtgtcccatgagcccctggactaacagccagcctccttcagtagtaccaggaacagataatggcctttcttattgaggccctggagagtgggctttccgtgctgctctgtggcctggaaaaccccttggggctaaatcaccctttcctgggagctcccggagccctggatatgtcttcagctttggaaaccccttcctgtgatcctctgcggctcctgggtgccctggtaggagaaaccccctctccgtgggcctctgaggcccctgggtgccctggtgggagaaactccctccctgtgatcctctgctgccccgggtgccctggtgggagaaaggccctttccatgaatcactgagaccttagccagccctctggccatctcagaggttggcctcccaagattccctggagccctgggctatccctttggccggagaaagcttcctcccatgagcctctggaccttggcccctctctggcaccagactgtttaatcccataaatctctgggggtattcccatcttctgggccaagatctctttcccaagaatctctgggctcctttcccagacctagagctacatttctgtaaacttttgtgcatcaggacctagaactacacatcctctgactatctgggctttctgagctgaaagtgactttttccaagagccttagaggcctggccataattcctgtcttcagaactacatctcccggaagcctctgcgccgccttagccttgattccccgttcccatcattgttggggccctctgggaagtggactacatttcccgtgagccgctggggcacagctccgtaggcactcggcctggaacaccccagggcctactgggagttgtagtgcagcttccacctcacgcactgcctccgttgttccgcagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacacacattgtcgggcttcttcagtgacgtgactctggggctttaacccaggaatcctgcttcctcagcccattttattctgaaggactcagtcatccgagcccccagtgttctgatggtttctccaacctgggggagcatttcatgtctccggcactgaacttactatctgccccccaccaaccagctcctcccctactttcccgtctcccagtctctaggccggacccctaggtgctgcatccttttctctcaaagcccacgaggccccgatccctgttcctcctgcccccgactctgctgtccgttcccccgcctctttgtcccctaggccctggcctcagctcagctgctgtcttctactggcacccttgttccagcctgcagtctgctacctggcccaaagggtcttttctacacccagacgtggcccagtgccctcagccaggactgtagtcacgggaccctagtgggtgtggagtgaggcacgatactctcacctgctggagggattaaacgtggaagagtttagactgggtatggtgactcccacctgcaattccagcactgtgggaggctgaggcgggaggattgcttgagaccaggctgggcaacacagtgagatcccatctgtacagaaaatacagaaaattaaccaggtgaggtggcatgtgagtatagtcccagctactccagaggctgaggtgggaggattgcctgagcccgggaggttgaggctgcagtgagctgtgattgtgccactacactccagcctgggtgacagagcaagactgtcttgaaaaaaaggccaggcactgtggctcatgcccgtaatcccagcactttgggaggccaaggtgggcggatcacctgaagtcaggagttcaagagcagcctggccaacatggtgaaaccccatctctactaaaaatacaaaaaaaccagctggacgtggtggagggtgcctgtaatcccatctacttgagaggctgaggcaggagaatcgcttgaacctaggaggcagaacggttgcagtgagcagagatcatgccactgcactccaacacacacacacacacacacacacacacacagacacacacacacactttattttatttttttcttgagacagagtctcgctctgtcgctcaggctggagtgcagtggcatgatctcgactcactgcaacctctgcctcctgggttcaagcgattgtcctgcctcagcctccccagtagctgggactacaggcgtgcactaccatgcccagctaatttttgtatttttagtaaagatgggagttttgccatgttggccaggctggtctcaaactgctgacctcaggtgatccacctgcctcggcctctcaacatgctgggatgataggcatgagctacccaacctggcccacatataccttttcatattataattgttatgtggaggtgtagagaaagccaggcattcggatggacgaggcacatcctcttgcagattcgaattcacagactgccttggttatcggctggctgtgtgacctcaggtgtggtgcttaatctccttgatccaatttgctggagggacaccctgtgggactattctggcaaacatgatctgtggcctatccagcagccatcggcgttgacactgaaagtccagttttttacggcgtcagcagacccattaccacatcctctcatttcccattgtcaatgatccctcaaggaaaggttagaggccaaggggatcctaagggaaacttgcctggaggcctctgggaagctttcttcccttgataaaacaatccatgtgctcacttcggcagcacatatactaaaattggaatgatacagagaagactaggatggcccctgtgcgaggatgacacacaaattcgcaaagcattccatatttttttgtcctcagcaaactaacacaggaacagaaaaccaaacaccggtctgagcacagtggctcacgcctataatcccagcactttcggag

SEQ ID NO: 17224 - DNA, 8580 bp, Human
tataaccaggaaacaaccggtgggtatagggtcaggtactgaagggacattgtgagaagtgacctagaaggcaagaggtgagccttctgtcacaccggcataagggcctcttgagggctccttggtcaagcgggaacgccagtgtctgggaaggcacccgttactcagcagaccacgaaagggaatctccttttcttggaggagtcagggaacactctgctccaccagcttcttgtgggaggctgggtattatctaggcctgcccgcagtcatcctgctgtgctgtgcttcaatggtcacgctccttgtcctcttgcattttcctcccgtactcctggttcctctttgaagttcgtagtagatagcggtagaagaaatagtgaaagcctttttttttttttttttgaggcggagtctcgctctgtcccccaggctggagtgcagtggcgtgatctcggctcactgcaatctccgcctcctgggttcacaccattctcctgcctcaccctcccaaatagctaggactacaggcgccctccaccacgcgcccggataattttttgtatttttagtagagacagggtttcaccgtgttagccaggatggcctccacctcctgaccttgtgatccgcccgcctcagcctcccaaagtgctgggattacaggcgtgagccaccgcgcccgcccgaaatagtgaaagtcttaaagtctttgatctttcttataagtgcagagaagaaaacgctgacatatgctgccttctctttctgcttcggctgcctaaaagggaagggccccctgtcccatgatcacgtgacttgcttgaccttatcagtcatttggacgactcaccctccttatcctgcccccccttgtcttgtatacaataaatatcagcgcgcccagccattcggggccactaccggtctctgcgtcttgatggtagtggtcccccgggcccagctgttttctctttatctctttgtcttgtgtctttatttcttacaatctctcctctcctcacaggggaagaacacccacccgcaaagccccgtagggctggaccctacgttagcctgccctgctcggggttggcgatgctggaggtgggccttggaccagagaaaatgctttaattaggtgacaagcgggcagaggcctttgtctctggcgccggcagccacggcccccgctgacggcgtgggaaacagaccctgttccactccggtctccagccttggaatggttgccttcgtgcagtgcaggtctggaaagtagcagtttggcacgggaccctagaattccccaaaaggagtgactaggggctgggattctggaatttgagtgtggacggtgaggcggggggtgtgggagatcggagaccctggtgggcgcgggagcacctgcaggctggaggccctcgcgcgctccggcggcagcctggcaaacaggttctccatcccccaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatgctgcggctgctcagaagccaggtagcctgccctgggtgaagccttcgcgcaggtcaatgacggggcggaggggcagggcgcggtcccctgcatccccgatctggggagcggtgggcccaggggccatcgccttagcccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggctgccgggccggatagccggacgcctggcgttccaggggcggccggatgtggcctgcctttgcggagggtgcgctccggccacgaaaagcggactgtggatctgccacctgcaagcagctcgggtaagtggggactgccccactcagttgttcctgggacccaggaacaactccttcagaaccaggaggtgcacccccaacctcttctccaggtcttcctaaggccctaggaatctccgccacctccccagccattactcctccaggaaccaagatgctccttccgctcctgaccctccagcctctcttgttttacttgaactatcgtttcccatcaccacctctgtggtggattttgcgcctcacagacaggtactcctgagaaacaggctggtggaagagtccagtatcagcggaacttacaggaggggagactcgagattccttcaggaaaggtgtaggaacctggaccactttctttttttttttttttttttttttttaagacagggtccctctctgtcgcgcaagctggagtgcagtcagcggtgctatcgcggctcattgtgagctccggggatcctcccgccttagcatccggtgtagctgagaccacagacatgtgccaccatgccaagctaattttatttatttttttttggagacggagtttcactcttgttgcccaggctggagtgtaatggcatgatctcagctcaccgcaactcccgccccccgggttcaggcgattctcctgcctcagcctcccgagtggctgggattacaggcatgcgccaccatgcccggctaattttgtattttaagtagagacagggtttctccacgttggtcaggctggtctcgaactcccaacctcaggtgatccacccaccttggcctcccaaagtgctggggttacaggtgtgagccaccgcgcctggcccatgccaagctaattttaaaatttttttgtaagagtgctctgttgcccaggctgatcttgaactcctgggctcaagggatcctcccatctcagcctcccaatatgctgggattacaggtgtgagccacagtgcccagccaaaccatggctatcttgaaaaccacttgtcttccagtccccatgccccgaaattccaaggctctcatccctgaaacctaggactcaggctctccctacctcagccccaggagtctaaacctttaacttcctctttccctgggactaaggagtgctgcaccccaggcgcctcccttaccccacatccctcctcagcctcccctcctcagcctcagtgcatttgctaattcgcctttcctcccctgcagccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttagttttttttttttttttttggagacagggtctcgctctgttgcccaggctggagtgcagtggcgtgatcttggctcactgcaacttccgcctcctgtgttcaagcgattctcctgtctcagcctcctgagtagatgggactacaggcacaggccattatgcctggctaatttttgtatttttagtagagacagggtttcaccatgttggccaggatggtctcgatctcctgaccttgtcatccacctgtcttggcctcccaaagtgctgggattactggcatgagccactgtgcccagcccggatattttttttttaattatttatttatttatttatttattgagacggagtcttgctctgtagcccaggccagagtgcagtggcgcgatctcagctcactgcaagctctgcctcccgggttcatgccattctgcctcagcctcctgagtagctgggactacaggcgcccgccaccacgcccggctaattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaacccgtgtctctgtagcttttttggagccagagccactgtgtatgtgtgtgtgggtttgtgtgtgtgtgtgtgtgtgtgtgtgtgtaagagagtggaggaaaaggtggggtacttctgaagacttttatttttttttaattaatttattttttttcagagatcgagtcttgctctgtggcccaggctggagtgcagtagtgtgatctcggcccactgcaaactcccacctctcggattctggtgcctcagcctcccaagtagctgggactacagacgttcgccaccatgcccagctaatttttgtatttttagtagagacggggtttcaccatgttagccaggctggcctcgaactcctgacctcagacaatctgcccgcctcggcctcccaaagcgctggaattacaagcgtgagccaccgcgccgggccctgaggatttttattactcgtgattgggagtactgtccctacttagatctgacagccccttgttgctggacttgtgtgagttgtggtccctgtttttctggttccctgtttctatcacacaggagagagagaccttccaggaccctaacgtctgagcccccagttgctcactcctggactgtcagtattggcccccagtcctctcctcccactgggacctccgcgtgggcagaagaggcggaggagggagcggattatcactgaactacatttcccggaaagctatgaggttggcagcgtcagtcagctacagagaaagaggccccagggcattttgggagttgtagtcttagggctaaaatgtccacttcgtggctcgacagccgtttccaaggaccgcggtgggggcggcagcggcctggggggccggatctagcccaaagcctgggtcctggggcaaggggaggggaggaaactgaaggcctgagtccggtccttgactctggaagccagagtagtcaggaggcttcctcttccctagatgctgggaaaattctagtccaaaaaggctgcagcctctgtgacgtcatggagcgatgggcgggacctccctttgttgcagtccaatcagacagagttgagtttctgggtggggccgaggaaaaccccaaggaatatctataaaggaattcgggcccctacgtgagaagctcggagggggtggtttcaggagttccttgtggagaggggatcgtccgtgactcagaccccgtcgaaaagctctcgatttcacgcaaccaaccttaccctcgtccccaacacaatccttgattttacccctgggaaaattagcgtaggtggtcatgaccccggcttcctctttaaaagccctcagaacctggaccgggctcctcaatgaaccctagtgttagaggccacaaatcgggaaccaaggtcggggagcggctgtttagggtgcatcactgttcaggatgcatcggggctcctttttctaagcggaagggtgcgccctgcaaattgggagcccgttagttttggggaagggtgaacaagggccccctaggtctagaggaccgcatggagtctcgcttaagtgttagtggggtcctcagttctaggaatctggtatgtgttttggttttgaaggagttccgagtttgataatatcgtggttgggtctgtgttagatgtttattggtttgggcattgaatcttcagcttgaggttcaacaggttttggggggctggcgggggagtgcctcggtgttgctcttaagggttggagttcaggctcacgtcaatctggggacttggaaaattccacagtttgggattttgggaaggggcgcatggggttgggagattccaggttctgagtttggggacttatgagtgattcctgtttaatagtttttctgatctctcagttgggggattcagtgagaaccctaaattttgggtcccctggattggggctcagtttcacacttcggaggcatttgatgaaggacataggtcctctttatttggagatttcctgaagatcctc

SEQ ID NO: 17225 - DNA, 15543 bp, Human
  misc_feature (1)...(15543): n = A,T,C or G
gcggggaggtagtggggaaaggatcaccctcctggggcttggatctggaggtggactcagcgccgggagatgggctggtctgaggacaggagcggggcgggaccctgtctgcgggcccaggacagggaagggccgggctctacccaacggggcggcgctggaattccggcgtggagacagagttcggtgggcggggacagattccgggggtgggagcaggactgggagggcagggacagatcccagaggcggaggcggtgggcgggggacagatcccatggggcaggggcaagactgggagggcggggacagatctcaggggcggaggccagagctcggtgggcggggtcagattccgggggcggaggcaggactgggaggtcgaggacagatcccagtggcgagggtcagaagtcggagggcggggacagatcccatggggccggggcaagactgggagggtagggagagatccagggggcggggagaactgggtgggcggggacagatcccatggggcaggggtagaacacagagggcggggacagatcccagggacggaggccagaactcggtgggtggggacagattccagggggcagagatagatcctgtggggaaggggtagaactcagatggcaggaacagattccagggggcaaggacagaactgagagggcgagaacagagccagggacagatcctaggagaaggggacacaactccaacggtggggagagaactcagagggcgggggcagaactcaggtcagcgacagatcctaggggaggagacaaattcagagggcgggtgaggatgccagggggtgcggatcacaatttagggggcgggacagatctcagggggtggagacagaactcaaatagaggaatggatcccccggagctagggaagaactcagagcgcggacagatcccagaggagcagagaaataacacaatggggagactatggggtcgcagctggcactggcggggtgtgtgaaatataactgtggggggcggaagccagagggaagaaaatcggggttagggaatgaaactcagggagagaagcaacagggaggagagagacgccggagggagaatagagctggaggagtatgggattcaaaggggaaagatggaaactaaggaggagatggagctcaagggtgaagaacccgggtggcgaaagggactagagggggacgacaggtggatcgaagtaggcgttggacttgaggggaaagaatttcccttgaatgagaaaacaaagaactccctggatgagactattggaactggggacgaggtgggatggggatggaattgcggggtgggggcggggaggagtgaaggaactggaggatgaacgcagagggaaagtcagagaagacaggattgtaagggacgcaattagggggaacagaagtcggggagagaaatgatggggatgagaactcaggagaggagagaaaatctgggtaggagccaggggtgatggaacagggatagggggagtagcctggggaaggaacagaattggggggcgtgaactcggaggcgtgagttcagaacccacaggcgtggtcttggaaggctcaggaggggacaggacgaggatgaaagggctgcgagagggggcgggtctgacagacgaggggaggggcctgggggccccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcggggccggccgggccggggcggaccccgggaaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccggtgagcctggcgggggtcccgggagaagagtgggaggatctgaggaggatgctaattcccacctgggcgcagactgacagatgaacgggcgataccccggcatgggggtccacccatctgtccagttttctgccgtgggctccgacggcgctgttctccctggtcgagccttgtccattatcctgttcctttttctgcaccccaccccacccggctccactctctctggtgctgtaaatgcctctctcccgggtctctggctcctcccccaccacttctgggtctctgtccccgtctctttctggatgtctctgccccttttctctctgggtctccgtctccctctttttccagatctcggctcccttctctctgggcccctccttctccctagatctctgcctccgcttctttgcgtctctgtgcccctctctctggttctctggccattgctctcactggatctctatcaactcctgactcagagtctctgtccccctctttctgggtctctcctcttccctggatctctggtccccacttctctgggtccctgtccccgtctctgtgttttaattctcccaccatgggtctctccctctctctgtgtctttttccgtttctgtctggcatggagtttaatctgcagctaaagcggattggggctcatagcccgttgtccttgagggggtgaggctgggtggaagaagtcacagcaccctgggtccctgggagagaaaggagttagaggccaaaaatttcggctcctggggtaggacagccttcccaaaggatacaggctggggctgacagggactccctcccaaccaggttgatgaccccagtgaaccgagtgtccctcaggataatctggacacctccccacaggctctcacccccaaccccagctttggctctaagtcagataaattactcagctgcggaaaagcctaaaaatatatctggccacagtgcacgaaggagatggcctcatcagcaccatgcccctgccgccgtgccctcaggccctgtccccttggcccacagccctgaccctgtgtttcgctgagcttcagtccacctcgctaggccatgggggtcctttgctaagtctaacatcagtcttgcttgctgcagatcacctcttagctccaaagttaccccaccctctagtaacatgagagacaagaataaggctggacagaagtggggggaggtgggcaggaggatggtgcagtgacggaggttggtggtggaggggaagctgagataacctcaccccttctttttccaattttccagcccctccccaccctttttctcgcctcctttcacgagtttctcaaaatacatcagtgtgaagtcaggagaatgagagagagagaaagagacgtgctggtggagggggctggggggtggcagcgggagggatgtattcctcaggcccctccctcagtctctgcctctgtttctcatctgtgctagggtttctcacagtcaatctctctggctctcactctctgagttacctcttgggtccccagagacccccgggctctggccaggaccatcagcagggagtttgtgcagagaaaagcatttgcttccaatgcctggggtttgctctgatggttggagggagaggggaataccccatattagagacaacaggttgatctcatttaatcctctagacaaagatggggaaactgaggctccattctggggttggggagatcagtggatgagtatgagccccatgatttgaacccaggtcagtctccctcccaagcctagaacagagctcttccttgagaagagtgatgccacagctggtggggagcttccttgcacccagggtgacttggaacaaggacatgggggaatgggatgccagagagatgagaacccaaggtgcctcctttctgagagccaggtcttgggcagggggatgccgagggccagtaagggatcaggtcccattgctgttcttgtctgtgaccttgcagtgccacttcagctccccgagcctcagtttccttagttgtacaatgggaagagaagagagagcagagggacataaggagacaaagacgtgggggagtggacagagatcctgagagaagcagagagagagagagggagagacagagaagttgagacatctcaatttggggtaatggcctcctaagtgttgtttttcctcatcgccaagtccccaggcctgagtttggggtatccagggaggggagggggatttgcatctagggtctcccttctctgtccttgtcccctgcaaagcatcagggccaccttcatctctgtgtccttggtcctcttgctctaaaatgattgatatcaccttgaagttccctctttattctcttgcatttttgcccttgtcccattttatagatgtgggatactgagaccccctgtttagacagccttgattagagatctgacatctcctcatattaacaaggaatctcacatcaggggctgcaatcacatcttgagtttcagggtcaaatatcatccgatgtcaacctgggtcagtctaatctctttgggtgatgggttctgatgggtggggggagttactgccatcctgtactattcgtcctagtggcttcaatcccccctatctctggctctctgtcttcttcctcttggggtctcattcctactccttctgggttctgtccactccctggcttctcccacccctgtttcttaactgcccctccccacctccttaagttctaggatggggaggggttgctgtgttctcacagctcttccacctccctccccctggaccgtctggctgttccttcctcccccgtcccagtctccctcgcctccatctgttccagccccttcctgggatccagcccgatcccctggctgcctacccacctcagagaggggctgcacctcacaaatcacgtccccagcctgtctatcctccgtctcccaggctctccatctttctcttgcattctggatctctgttctcatctctctgcatctatgttctatctcctgggtttctgtccccgcctctctttgggactctgtctgcttccttctctaggtttccatctcttccctctctgggtctctgtccccctatttctaggtctctctccccctctctctgggtctctgtctccctctctctgggtctctgtcatcctctgtgtctctgacccctccatctctgggtctctgtccccctctctatctgggtctctgttcctctctctctgggtctctgtctccctttctctctgggtctctgtccccctctttctgggtctctggcccgctatgtctctgggtctctgtcccgctgtatctctgggtctctgtccccctctctctctgggtctctgctcccctgttattctctctccctctctctgggtctctgtccccctctctatctgggtctctgttcctctctctctgggtctctgtctccctttctctctgggtctctgtccccctctttctgggtctctgtcccactatgtctctgggtctctgtccccctgtatctctgggtctctgtccccttctctctctgggtctctgctcccttgttattctctctccctctctctgggtctctgtctcttcctctctagatctctgtccccctttcactggatctctctcccttcttctgtctgtgaccccctctctctgggcctctgtacaactccccccatctctgtcaccctctttttgggtctttctccacctgtctgaaggcacctctctctctctgcagcctctctctgggtttgaggcagccctccaaataccctcttcgtcatcacagacttgattctggatccagaacgggcgggggcgagagtcacgctggggaatgagccaatccccctaccagggccatctgtcccctgccaggacaccacccgccactccccctccctaccccctaggctggcagcctggactcaaggttccctagggatgcctgggacgggctgctggattcccagggtcctggacatctccccaccccctagcaaacgtggctgagaagcatctgttcttttgacacctttgctgaagcatctccttagcaccttttgcttcctcgaatagactcttatccgggagaggcggctggagagtctttgggcctcggagtgggggcacaggctcttgaatcccaaagggttgtctggggtctaagtctcctgagttgaaggatttgacagagctgggagagggggactgaagaccgtcaatgtgaagaaggagggggctgggggcctgaattcccggtctgagggagatggaggatttctggatcaggggggcgaagggagccagggacctggactcttggtgaaggaggaggtgcgggcttagaattctggatgttgaaaagcaggttttgccgtggatcctggtcttgggggtgagggggctgggggcctggacttccgagtctctggctcttgctgtcccgcagccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcaggtagctcaaggcctgagcccttgcagagccccgccccgctcaccgagctccgcctacgcccccatgacgtcacactcacccaccagacgtccaggccacgccccttccgaaacgctgtcggaatagctccgcccaatccgtgcgccccttagttctgacctcgccttaggggccgcctccgtttcctaagccccgtcctgatctaaatgaagtcccgcccttatttccaggggcttgattgaaaaatgtagagtccgccccaacatcaggttccctaggggttgcccctgccccattttggacctactagcaattttgctcacgcctgtaccccaagctcatgtccccgggtcacatctatttaatctcagtcccatctcaggttcctccctgaatgtgatccttttttgaaaccctgccactgcctacgtcccactgcatgtgttgtgtcccttatctaaagacccacagggtctcccaggctacggtgcagtggggccattgctctgtcgcccaagctggagtgcagtggcaccatcactgcagcctcgaactcctgggctcaagtgactctcctgcctcagccttctgagcagctgggactacaggcgtgcgccggcatacccagctaacatttttatttttatctttgtagagacaaggtctcactatgttgcccaggctggtctcggactcctgggctcaagcgatcctcctgccttggcctcccagtcctgggagtacaggcgtgagccaccgtgccctgtcctttctcctattttaatttcagcataggccttgcccctgcatcagaaaagagtcctgatttgtgcctttgtcctacctgaagttcctccccttgctcccttccaatctggtccgcccccttggctgcttcgtgtccccgcctggaccctgtgcaggtcactccgcaaacgctcataagctggatataagtggagagagtcatcatcatacatgggcccctaggctttcatggaggcaaggaagcaggcaaagcaaggcgtctaggtggtgatggactctgttgttaaggcagcataggccctagcaacgtggaagagcggagtttgtagactttaattgacagaaagatagtgtgagctttgattggcaggcttttggaggtgggaggggttcctcgttgctgataggtcgagacgctaagtctgtgggtgctgattggtggagcggcagagcctggacagggcggctgatttaatgtacattttggcccgcagaaagcccagttcagctgggatccagagactgtcggcctcatacacggctcctttttctggggctacattgtcactcagattccaggaggatttatctgtcaaaaatttgcagccaacaggtacagtggtggggtctcaaagtgggcggtaactacagttgtgtgggtggagttagagggcgtggtcttgaatttgcgggctggctctggtaaatgggagaagcctggatttgggggtgggtcttagagaaaggtggggcttgcgattgaggaaggtgtaagtcagagaggtggtgggacctggggtcccggggaccactgggcctagcttgctgtgggcgggaaaggcagaatcccgggcatggctggatagcttggattcttttctctgacccttcccatcagagttttcggctttgctattgtggcaacatccactctaaacatgctgatcccctcagctgcccgcgtccactatggctgtgtcatcttcgtgaggatcctgcaggggttggtagaggtaaatccccgcctgatatgaccctgccctcgctcggaccctgcctcttctcagtgaccttggttttctcctctttagggggtcacataccccgcctgccatgggatctggagcaaatgggccccacccttagaacggagtcgcctggcgacgacagccttttgtggtgagaggaagagggatcctcactcctgaatctgagggaggaggggttggggcctggactgttgggtctgagcggggaggggctgggggggctgaactcctgtgtctgagggaggaggaggagactctggacctggactcccaggtctgagggaagaggggctggggctggactcctgggtctgagagaggaggggctgggggcctggactcttgggtctgagggaggagggactggaggcccgcactcctgggtctgagaggaggagctgggggcctgcactcctgtgtctgagagaggaggggttgggcctggactcctgggtctgagggaggaggagctgggggcctggactcctgggtctgggggaggaggagctgggggcctggattcctgggtccgagcgaggaggggctaggcctggattcctgggtctaagggaggaggggctgtggcctgtaattcagtgtctggaaagggggaagcggtgggggtccgcactccttgatctgagggaagatgggcctgttctctcccccgcatcctcccccttaggttcctatgctggggcggtggtcgcgatgcccctcgccggggtccttgtgcagtactcaggatggagctctgttttctacgtctacggtgagggacccggatgcctggttccgggtggcgctggggcggagcggggccggtcctcacctcgctcccatccccctcctgacccccccaggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacggtccgggaccaaatcttcggggaaggggcggggagagatagcaagccacgaacctgcacagcgtgtagatcagggacggttcctgcagactctagaggagacgggactggaacgcaaagagaggggctagaacctaggaggcgggttgcaacccgcggaggacgagattctcaggtgctgggggcagggttaggtcgggagttgagcaggattagaaccactgacagggcatagttaaagccagcagagaagggattagaatgtgggggttttgcttagaccttgagttgaggctgtattttgggagcatttttgataaaaagagactcctagggcaggctcagtggcttccgcctgcaatcccaacactttgggggtggaggctgcaggatcgcttgagcccaggagttccagaccagcttgggcaacatggcgaaacccccgtctctactcaaaatacaaaatacaaaaagtaaaaataaaaagaaaaaaagaaaaagacaggtccctgaggggcccggacacctgcggacctgagaggctaccatagggccaggaccccttcatcactcaagtgtcaccttgaggctaggatccctgggtccccacggcaacatggtgtagcccgcgcctttgggtccatagaagtttcagtgcggtcgggatcctttggtttctgcagaactacactgtggtccctgaagggacgcggagaagccctcagccccgctccccgtcttagcggccctcccctcgcccccacagaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtagagcccaggaggagagggcaggggggcgcggaggggtcggcgggagggaactggcggcgatcccgaggcagggaggagccggtggtgcacggaccgggcagagacgccgagccggcggccccgaaccctagtgtcccctgtacacctgttcccgcaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggtgagtggggcggggcctgggccggctctaggacagcctgggtggagcagagccggattgagaggtgatggggagtggttacaggcggaaaccatccagcctgccccaggagtccctttctatgcaaagggccgtggccaacagggtggagccggggcagggcaggcctggatgaaagggactgtcacgcggccgtccaaggggccaccgcgcggaagggcagggtgggcgagacttcccgggtggagcagagagaagaccgagttgggcctggagggacaagacctgcacaaagttgggtgtggtaggacatgaactaggtgatgaagaggcgctaagagcaaggcacctggagagacagggtcctagggggcctgctgtctaacaagtgagatttgctaggcgtggtggcgcgcgcctgtggtcccatctacttgggaggctgagaagggaggatcgctggagcccagaactgcgaggccgcagtgagctatgatcgcgccgcagcactccagcctgggcgacagagcgagactttgtttctagaaaaattaaaattacaattaaaaattaaaaaacaggcagggcatggtggctaacccctgttatcccagcactttcggaggcgaaggccggtggatcacttgagctcaggagtttgagaccagcctgggcaacgtcgtgagactttgtctcttaaaaaaaataaaaaatcaaaaattaaaaaaaaaaccccaaaaactcatgagtggggattgaggggaaggtgtgaacgtgcacagcagggatcctgcgtgttcggggagtggcctagtcaaggggtggagctacgggaggggcgatggagctggtgggcgtggtcagggctgggtcttggagaagtaggggcctggttagggtgggtgcgggtggcgtggagggcgcgaagaggcctgggcgtggaggtggccagactggggtggatagacgcggtttggggctggagcaggtctggaagggcggtgtggggcagcctgcgccttgctccggccgacactcaggagacgcgggccccccccgcccccgtaggcttcggcatggaagccacgctgctgttggtggtcggctactcgcactccaagggcgtggccatctccttcctggtcctagccgtgggcttcagcggcttcgccatctctggtgagaaccgcggatccgcagcttgggggactctggtcagctctgtagggaacttcctggctcaggaacggggcctctcagcctcacaaaaggtggaacatgagtggcggggaggggagagggttgagaacgtcccagtgggaatcactcgagtgagattccggtgtgacgccttccgacttgtctctccgccagggttcaacgtgaaccacctggacatagccccgcgctacgccagcatcctcatgggcatctccaacggcgtgggcacactgtcgggcatggtgtgccccatcatcgtgggggccatgactaagcacaaggtgggtgccgcagtcctgactcagtctgcctccaagtgtgtgcttcgtacctaactgaccacgtggtggcactgtctctggggtgccatccctgccttttcagcctccctgggtctctgcctcccttcctctaggcctccccctctctccgcctctgtttctctgtcctcccatttgacctcagccctattgtcccctgcagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggctcagttgttcttggctgtggaggtcacaggcatcctggtccccagccccgtcctccctcagaccgaggagttcaggcccctagctcctccttcctcagttccagggatccaggccccagcccctcctccctcagacccagggtttcaggcccccagcccctcctctcccggacccaggagtccaggccccagcccctcctctcccggacccaggagtccaggccccagcccctcctccctcagacccaggagtccagacccccgcccctcctccctcagaccaggagtccaggccccagcccctcctccctcagacccaggggtccagaccccagcctctcctccccaagtttcagcggtctcagactccagcccctcccaccccagggctcaggccagaggaggggtctagccatgggaacatgatatttattcggtctcagaccttgttctctgatcacagcgcaagcatctctgtatattagaccctttatccggggcactactctagctaagcataccagaagcgcagggttttccttcactgtggggatgtgcaggtccggcagaactcggtggggctcacacgaagttgttggggagcgtggcgggggacagggcctccagacgctgcgggcgacccccgcggggcggcgggggcagctttggtggcagaggaggtgtgggcgggggctgcttggtggcgatgtgggaagggacccaggtatccggagcataaaagtagaggtcgtaggggtctttcggggcgtccaaatgcagaactgtgggtgcaaaggggcgtggtcatctctgggctgaccctccaggcccccttccagatcatctccagggccgcttttgtgcggccgaccgatcaggaggccggagagaggattccgattctgcatttgaactgagttttcaataaaaagggtgggggccgctgcagaaaccaggaggcgtggcgtccgatcagcagcggcggggcctgcagtggagggcgggacgtacagggctccgggccgcgtacctggaggggcaggggcggggctggcggggacggccggctctgggcctgaagccgtttccaaccgcattgggagcggcactggactcttgggtgaaattgcagacatttagggggctggacgttgccatggaagagccagggctttcattgaccttgggtgggggacctgtgcttttttggctggcgccctgtagtgccgggagagaccaggttatggaaaagtgcaggcattcaaggggcagggcgctcacccggttcatctccgtcgtccggaagccggtgatgtgcgaagggccgctgtctagctgcccggcggtaaagacaccacagcagcacaaagatgccgatcagcagcgcggtccccgcgaagaacaggcagagggccccgcctgctgcgccacgtggtcgccccaccagagtcacgcctgaagggggataccagcaatctaagctcctaaccccctcctctctcagacccaggggtccaagctcctagcccctcctccctcagatc

SEQ ID NO: 17226 - DNA, 203475 bp, Human; identical to SEQ ID NO: 14516
  misc_feature (1)...(203475): n = A,T,C or G

SEQ ID NO: 17227 - DNA, 203475 bp, Human; identical to SEQ ID NO: 14516
  misc_feature (1)...(203475): n = A,T,C or G

SEQ ID NO: 17228 - DNA, 203475 bp, Human; identical to SEQ ID NO: 14516
  misc_feature (1)...(203475): n = A,T,C or G

SEQ ID NO: 17229 - DNA, 203475 bp, Human; identical to SEQ ID NO: 14516
  misc_feature (1)...(203475): n = A,T,C or G

SEQ ID NO: 17230 - DNA, 90776 bp, Human
caggaaaaaaaaaatgaatactaggtttttaacttgtgtcccgggttgggtaaagaatgacaactattctatagtttgtatagactttcccttagtggtcattgctatatgacataagaaagtcagtgcctgggccaggcactgtcacaggcctgtagtcccagctacttgggaggttgaagcaggaggatcgcttaaggccaggagttcaaggttacagtaagctatgatagcacaacctgagtgacagagcaagaccctctctttttttttttttttttttttgagacagagtttcgctcttgttgcccaggctggagtgcaatggcacaatctcggctcaccacaacctgcgcctcctgggttcaagcaattctcctgcctcagcctcccaagtagctgggattagaggcatgcgccaccaaacctggctaattttgtatttttagtagagatggagtttctccatgttggtcaggctggtcacaaactcccgacctcaggtgatcctcctgccttggcctcccaaaatgctgggattacaggcatgagccactgcacccggcctaccctgtctcttaaaaaaaaaaaaagtgagtattataatagaggggataaggaataatgtgtatgtgaggtctatttctgagaccagagccacaaaacagaatcctgcaccttagccattttcttaccacacgcgttttcttggatacttccatttttccagtctatataattcaatacttctgtgacagagaggtgttggagttttttgttttgtttttgttttttcgcaactctttacatacaaacagctatggtctcccaggaaggaacttcctctgttgagtacagaagtctgggaaaagactggtgaaattgcatgcgaggaagaaacaggtctaactaaatgtgaatctatacttttaaagcaagggaccacaaagggtaggtcccaaggaagttgcattgcttgctgcacttgtcacacgggctgtactttcttctctcatttatttccatttacagcgttgaaaactgaggccttaggctttggttgaaaaccgaggccaagggtgaccagccagtgagttaaggaggccccagccgaactttgctggaagtgctccagcataaagcctctctccagaaccagccgccactgagacgtcttgaagtcaaagtaactcacacccttgtccacctcgccctgcggtgaagaaacttcggtcgcacaggctccagaactcatcttggcgtgggctgtgacttactgggggatgggcctccttttcgttctagctcctaaatggagcggagcgccaggtggtgtcagagggggcggcggcccctccaatggtggcaccctcagccacggataaggttccaattaggtaaggacgcaagtaatgctgtcgtttcggctgactgctcctttcattccttggaggtggtcggtgtcacaaaacgaattttcatttactctcaacagtcacaccagccctgctaactggatggtcgcagccccgtgccttcgccggacgccctcctggaaccttcaggccaccctgaggatggagactcgggtgcccgctctcctcccctaccgccgcgggcctgcgccccccgccccggaccccgactcggacgttctagccgcacgtgcgggcgcccctgggtgcgagccgcggactcacgagccgctgcttgttgctcccgccgccgcgacctggggaagcgaaaatgaaattgacttttccgagaaatgatgaaagcggcgctgcccgccaatgagctgctgcggcgaacttccgcacctcccggccgggccgctcgcgccctccctccgcctccacctcccggttgcacaagcttgaaacaaacactggggaggaagggcggagggaggagggcggagaggggaggcgagggagggagcgcggccggaggagggcggggggtggggggatttccagccgcggctcttcgcagtttcctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagaggtaacatttttcaaataatagttgtgactgtgtgtgtttctctcgagggcatgtttctggggactgtggggggccgtgtgtgtatgcgtgtcctgatgccttgacacgatgttttgcagacggaaaatgccggggttcataaatattaatactgatttttggaggaacagtcggcgcaattatggatcatctgattttaggggaagcaggttctgctgctgttgctgctgctactggggctgctgaggctgcgaggaggaggaggaggaggaggtagagagggaggaggaggaggaggttggtggaggtttaatttcacttttggatttgcagatgcggagaggtggctccatggacacagacctgctgtgtgtgcttctgcgccccaggtgttgtgtgtgggggtgcaggtcagctggagtcgggcctcatttaaaacaaaattgtgtgtatgtgcgtgtttgtgtgtgcgcgcgtgtgtgtgtgtgcagccaccgccgccaccggatccgaaggaggggagcgggtccttctcggtgcccgcggcggcgcctctccaggctgcctccagcgtaaataagcaggcaccgctccccggccgggaggagcgcctccagccacggccagaggaaacttgctggggcgccccgcggcggtccaggggctcgcctgcctgccgggctcggggtcgggtcgcgggcgtcgggtgccagcggccggggcgggagggcgggctcggagccgggccgggcgccgggcctggccgacgcgccctgcttcctgggggctgggccgccgccgccgccgctcagaagggacgccgcgtcctccttcccgccggccagcgcccggtcgggccctggggctttgtcattgcacttgtcccagcgcgccaggggctcgggcggcgcgtcccaggaaggcaccgtgccgaggggtcagccgcccgggccgcggcctagcgccgtgcgcccccgggtccccgcaggcgcccccggccggcctcgcgcgctgggcctgacccgcctcggctacggagcgggcgaggtgggggcggggagcctccggggaccgagcggcgcagtgggggccggcgtcccctcggggtcccggggcgcgggccgcggcggggtggggacgcgagtgcccgccccgtgccctccgacccggctccgggcgccgggtgacattcgcccgctggccgaacatggttggtgcaaagccgcggcggccgccacttcctttccgcctcgccggtagggctcgcccaccgagtgaagccggccgcggccaatcgcggcgcccgcctgctcccagtggcacggcctgggggccggcgtccgccggggctggggaagccgttccaagttccaagggtcgcgggtgtaactcatgcccctcccagcacgcgccggcgtctccccttggcccccggtctgggtgcgtttgccaccctctcctccttgttccctaagaagcgggggaggggaaggaggcgggcagcctgggcagggcgccagagccgtggtcgggcaccaggtgaaacgcccgggtcagtctgtgtaggccggacccttggcgctcggctgcggatgtgatcccggggactggcggccgaggtagctcagaagagcgaggtggctttcgctcgtttctgacccgctactgtctgaaacttggggacatattgcccgccccctccctcttcaacctcctccctccggtggctccttgtccttggttatggaaggaaaaaactcagttgttctaaatgaggaaaagtggtgctggcattcgtcttcagccaccggcctccttatggctgtgactcggtctgcttttgatgaatggccaggaggtatggaggatagttagatttcctgttgtggattttcaggcatcaccgagactgctgtcaagcctgcagtcatttactagttttcatatcgactgcaggttctctttgagcagttcagtttttggtgcttaagggcaggtgcacaacggggtctggggttagaccaggcggtggatagtcttgatgctaggcagatgcagttatccctaccaggcccagagggtgactctgtttaacttcaccacgcacgcagattcaggattctctgatttccccaactttcctttattcttcttttagtgggagaaggggcaaaagtagaaacctaaaaaatcctgggaaaaggagccttttctgaggaaacttcagcagatgaaatatttaagacttgaactgggatctctagggggaacgttggaacatctattgattgatgtgtcaaagtccggaatttcactgtaattagtgaacgattataacttgtaactttgtctgttatgtaagaaattacattttggtctcttagatccaagagttcttgtctgttacgatttgtaactgcttgttaaaattaaacatttacatatttcattctcagtgagttgtcatttttttgttagagaaagttccagttatttcagatttacttacctgtaaaaatgtcagcataatcaaaagtaaggatctgtagtcaaactggaagcaaattatggcaaacacatgcgtgccatgaagttctgacagccttatgaacaatggtcccacttttatcccactttctgaaacactttattaggcaaatagtgcaccagagcaaaagatgtttaaacttactggaaaaatagacactttggatgctccacatttgatgtgcatcaattttctcatgttaccaacgatgttatatttttattcttaacatcatctcgtacaaaactgttgtttttagagcattttcacataatatccttttgatagtgaaaaaccactgtactctatctaaatggagtatctgggttatagttcccttatctgccttataccaaaaagggcttaacgcagacaagagaatttatgtacacactcaataaatatccttagaacatctattataagccagacacagtgctagcctctgtatactcaactgacagcgagaaagacagcatctttacactaggttgtgttctggtgagtgagctgaccattaacaacaaaaaatatagttattaccttttggggttagctgtaaggaggataataataatttttaactatatctcgtaagtgttgctttcatgaacaattgagatactgtatatgaaagaacattgcataaattatggcagtctacaaatgtgtaaggcattaactttcaaaattatatcagattattcttagtgtaaaaaggccagataatcatgactggattagacactatctttctcatagaatttccagcaaggagggattttacttctgagcatatataaataatgataaaagattaaacatggaataacttttatataaagtatcaaaaaaatttcacagtggaatccgatattgtcagtgaattttttcctgtcagaaggaaagttaggtggtatccatggagaccaaatgatatggaaataacagtgattggaccaatgtattttccctctttatgtcagataagaaaatcttcccaagcctctctgtgctttagtctgaatcttcttcactctcgtgtcaacttcttcattatctgtcattgcaggtgtgcactgggctgattgtagtattttgcttttaccaccttttttttcttttctttttttttttttgaggcagagtcttgctctgttgcccagactggtgtacagtggcacactttcagctcaccgcaacctctgcttccaggttcaagcaattcctgtgcttcagcttcccgagtagttgggactacaggtgtgcgcaggcgtgcgctaccatgcctggctaatttttgtatttttagtagagacggggtttcagcatgctggccaggcttgtctcgaactcctgacctcaggtgatctgcccacctcagccttctgaagttctgggattacaggcatgagccactgcgccggcctgctttaccatcttggctcatgtgcatttattgaatgcttactgtgtgcccaacactgtatatgtgacaacatacatgaaagtaaatattaactgatagcatatatttataacatatattacaatacgtaatatatgcaaataaatgaaactgcggtgaaatgtcagttattattagtaaaaattagttcttcttttcatctgtatgagacatgatgttccttcctgcacaggggtaggaggtcaggaccttcggtctctgcctgccccgtcggccccctgtgtttggcctgagtgtaatcagtggtcggtgcacgatgccagcttcatgcacagtgtgctgaattgaggagtggctctggtggcgggagtgactgatggaaaagtgggtgaggaagttccatcaaactttaatttatcaacaaagaacaaagaatgatgaataacatatagggtccagatttgaacatgaagacagtattttttatagagtaccaaggaaaacacacaagcaggaaacacagctcacaggtcccctttgtccctgggactccgtctgaggctcgttggattcagagcaagcagcaggcctgaagtcttggcattgaccttcaaagatcccctaaaaataattttccccctcagaagctccatcttatgacaaactgtctctgaaacaaattgtgtttatttaagtagacttcatgtatcctttttcttttattagagtcaaagtctcactctgtccaccaggctggagtgcggtggctcgatcatagctcactacaggctcaaactcctgggcacaagtgatcctcctgcctcagtctcctgagtagctgggacaacaggcatgtgccaccccaaagcccgacatacatttttgtgtagagacggggtctcgctatgttgcccagactggtctcaaacccttggcctcaaatgatcctccctcctcagcatcccaaagtgctgggattataggcgtgagccactgcacccggccctagtgcccatttttattcctcagaaacacatatgacttccagtcagaactcctgattgccttgagaaaactggtatcatcaaatctcactgatctcattatagccaaaggtagagacccgtggtgtgttggacaggctggccggctccgtgtgagagaaactcaccatcccgttaggctttctgaggcactgaaactagccgggaccctccatcaataacttggtctgcttggggatccagggaccccatgcaattattttaaatgaataattgattttgttaaatgtagtaacacatgcaatggttttcttaaatgcacacattgtgttattatttcatttgtttattaaatatttcttgacagccagctgtgtacaaggctctgcggtggaaggtgcatgaactcagatgcctagagtggccttttagttctccaatcacttcctcctttggaagttttcactgtaaaatgtggctggataattctgtcatcctcaggagacagaacctgtgtgtgttgtgaaaatcacctggggaggggacttttagaaattacacgggaccttttagatttgagactatctgtagccccctttcccttccttccccttcctgccttgatagcgagcctcttattcaccattggatccctgctccccagcctccctcaggtgtgtggccagagtagaaatggaaagccactgaatcgaggatctcttcccagggccaaatagttgatcttttccttggctcagatgaaacctctttccacattttaaaaagcacttcggacaggggcctgtggtcactctgttggctctgcccacttgcccttgcttgccatacagaaatgggactcatgttaagtttgtgatacattgaattttccttttttttttcttttttgagaaagagtctcgatcttgtctcctgggctggagggcagtggtgtgatctcggctcactgcaacctccgcctcctgggttaaagtgattcttctgcctcagcctcccgagtagctgggattacaggcatatgccaccacgccgggctaatttttgtatttttagtagagatgaggtttcgccatgttggccggctggtctcgaactcctgacctcaggtgatctgcccgcctcagcctcccaaagtattcggattacaggtgtgagccaccgcgcccagcccagttttccattttgaagaggcaagaaggactttattttattttatgtatttgtctctttgtccaggaaggccatggagaattaggcgtttggttttgttttgtttctattttggtttataactcctttatcagtttagtattcccttctgataagcaagaaagagcggagttgacaaagaatggctgcagatgagaagcaggtgtgtgaggttccttctgatgatggattctaagtatttttatcccaaaggcaagactaatttagttcagcaaaataccttaatttaggattttgtgtgataaaagcctgtcctgttttcattaaatgacgatttttgagaattaactacttgctgtgtgattttcataaataatttcatttgggcatacttaacactgttgctatctgctgaaggcatttgatactcgcacacctaatgccatcaaaggagagatgagtatacactttaatttgttcttattgagtgtacattttaattgttcttatgaatgtcagattttgggaagatccaaagaagtactctgtagacagaatacgctgtcctggccccctaagcttagaatcctaccaattttcccatttcatgagattgacctttcagatgaggagggactgcatacaaattgctttatttcaagtaatatctaccatgttatttttgaaagaattcttttgtcctttttaccctagatctattggaaaagatgagaaaaattacagtggtgataagagtgtcttaacacctagatatgatgggtgtgtcgggtgaaaggatagcaatgggaggctggtggaaagtgagagttgggggatggggtgatgagaaggaaaataggtgactagtgactcctggattcttgaatgggagagagtgaagagacaatcaggcagggagattttctgtctttgcataaatgtcactgaaagagttttagagatcggaggggtgaggtgaagttggttaggcaattagtgataactcaaggaccagttgaaagactggaggaccctccactgctgactgtgggatcagatccttttatcctggggatgagaaaggctgatgggaaaactgctaggcagctgctgacattataccaccaggaaacatgaagttgtgagtagttgtcacttggacatggctgaagtcaccttagggtacagtgatgttgctgcatcacaacgtttaggtcatcaatgggccatacacatgactgtggccccataagatgataatatcatacttttaccttttgctatgtttagatacacagatacttgccattgtgctacagtggcctacggtcctcagtacagtaacctgcagtacatgtttgcagcctggaagccataggccataccataaacctgggtgtgtaggaggttataccatgtaggtttgtgtaagtacactctgtgatgttcacacaatgacaaaattgcttaatggtgcatttctcagaatgtataagtgtgctgatgttgatgcattgtttggggatggggaaactgatactcactatgtgaggccccaaactcaatctaaaattgcctttggaggcaaccacggaaatacggtaatagctctcttaggccttctccccccgtactgatcttccttggtactgttttattttatttttaaactcttgaaataatacataatagatgtatgtattttcagggcacatgtaataatttaatgcattcatatttgtaatttgtaatgataaatcaatgtaattgtgctattgagattgtgggaggtaaatatggaatcagggaaatagaatgggctgataatgtgttttcctaaagaacagatgggattggccgtgcgcggtggctcacgcctgtaatcccagcactttgggaggccgaggcgggcggatttcctgaggtcaggagttcaagatcagcctggccaacatggtgaaaccccgtctctactaaaaatacaaaaattagctgggcatggtggcgggcacctgtagtcccagctactcgggaggctgaggcaggagaatcgcttgaacccaggcggcggaggttgcagtgagccgagatcgcaccagcttgggtgacaagcgtgagacttcatctcaaaaaaaaacaaaaaacaaaaaacaaccagatgggacaagttaaaactgaactatgaattccataagtgggtagtgtgggtcactgagtggggcactgagtactccacagtgactgtagtcaggattctacattgaaataaactttctggaatttaccttggtgctatatacttaaagtcttaaaaatgttaagctctctgttccagaaattctgcttcttggaacctacttacgtgaagtaaccagagatgggaacaaagatgtatgtacacggatgtttattgaattagcttttgttatgtaaaaacttggaaacaagctaaatatccaacaatagagacacatttgaacgaattacggcacatccagacagactataggtagcttataaagctcgtgttttcgagcagcgtttagtgatgggaaaatatttatgatctatgctgattgggtggggaaaaaaggatatgaaattgtgcttctagttttatttttaaaacatatgtgtatattggggtatttttaaaaacctggaagaaaacatatctttttgatggtgaaattgtgggtgtttggcttttttttttccttcttgaaacatttttgtattttccaaatttaaaacagcaagcacaattaccaattacccttttaaccagaaaaatattctcaagagagtgctaatatgtcatctctgccctcacctctggtccacgtaaggttaggaaaaacacactgggtgctgccgaggaggaggctgtgcatggacggggccattctcgagcctttctgcctccatgtgtggagcaggctctagagccagggctttcctggccaggctcttggaagcctttgtcctcagacagctgtggctacttggagacacttagattggtggctttttggtgaggttgggacataatgttttgtcagtaactgtgaagggcttgagatatgatttcacttcacagttaacattctttatacatatgaatactgcagaaacacaaaacccctgggtaggagaaaagagttccttgttgatatttacaactggggcaacagcctgagtgacactattgtgtcaggcccctaaaccttgacccttaggtgacactgaaaactaatggaatgtacatgtgggctacactttgttgacagggacagagcagctgtccctctcccgtcccaaaaggagagagagagaaaaaaaaaagaagaagaaaaaggaaaaccaaacagacaaacaccttagctcccctgacatgggatgaaaaggttccaggggtcttatcctaacctttcagaatgtgagacacttgtaacctggggatgtctccaaggtctgtttttcatgctttttgaaatacacatgcctagggagatacgtcttcccagcaccttgggaaccaaggtgaaattatttggtcctcttgaggagattagaggttttattatccttttggaaaagagcatttaatgtacacaaatggctacagatctaattctcatggtaagtgaagtataaaatgtttgtaggggaagtgagagtgaacattccctgtcttcatgtcctgtatagtccctatcttcatgtcctgtacattccctatcttcatatgctatacagtcgctattttcatatcctatatggctcctatattcatatcccatacattccctatcctatacattccctaccttcatgtcatatatggtcctatcttcagaccttttatggtccccatcttcataccctatacattccttatcttcatgtcctgaacagtctccatcttcatatcctatacattccctatcttcatttcttaacagtccccatcttcatatcctatatagtccccatcttcatgtcctgtacattccctatcttcatatcttcctatcctatacattccctatcatcatgtcctaaatggtcgctgtcttcatatgctgtacattgtctatcttcatgtccaatacattccctatcttcatgtcctatacggtccctatcttcatgtcataaacggtccctatcttcgcatcatatgcattccctatcttcgtgtcctatacattttttccctttatattctattcatttctgtgtgttaggaggtgaaggcattttataggagtctggaaagaagcctgagaagttgtattttcccctcacacctgcctttaccagacccctgttggagaatgacagtagagcttaatcagagtgtgacctctgacttttcaaactgaagacctcaaatctccaatttttatctgaaaaaatattagaatagtttcactctctttatgaacatggagacgtttttggattgctacggaagtaggattgggcatgaccattatgagttcagaggctgaatgccgtaccacagcccatcaaaaaaaatatatatatatatgcacgatattgtccaatacaaatataatgtgagccacatgtatagttttaattttctagtagccacttagaaaagtaaaaagaagtaggtaaaattaattgtaataatatatctcatttaactaattttatctaaaatatttcagtatgtcgttaatgtaaaaatactaatgagatattttgtatccatttttcatactgagtatttaaaatccaatgtgtcctttgcacctatagcacgtcttaattcagcccagccacattccaagggcatggtagacccatgtggctggtggctaccatcttggttggtgcagcataaggaaatcaatcaaggtgtgaagacaatacaggggaaagttgtagtacagtcctgaaaggactgaaggaaagtagagttggagtggttattttggtcataactgtatgaatctccctgtggctctccccacaaaccatacctgatctcttcagcctaaaacaatgaaatgctctgaatttctatagaagcagcatactctacatcccattcctagggtagttagctatctgcatcttgatgagatgaatgtttcattctagactcttgaactgttatgaaaatcttagattatttgaatttttccatttgtatcacctatgtggtaagttatttgagagccaggatccagtccgatttatttgcattcctcaccggtgtttgacacctttaagacctagataaatattagtttatttgattttcagctgtaaagcaaaggttagcttgaaaggctgaattccagctcaggaagggtggcacagatctagtttgtactagaaacctaatggtatatgaattgaacacataaacattaggatttgtcactttgcattaggatttgttactttgtattaggggttccacacccagaaggtgaaaaattgttcggtttttctcctttgtatccagacctttaaaaaatattatcagtttcttcttttgatgtttaagttccaatgatgatcctaatactttcttgtagggataaataagctatatttggtgatgacctggagataaacatttggaagctgctactttttccatgggttctttgttaacaataactttgttattaacaaacacagcccacaacatctaggcgatgaaattcttttgaaatcaagtatagtattttacagttgccttcatttgttctctttgactgtaattgttgggttgaagcaacagacttatccagagagccaaggcaatttatttttactgaagactacctaagaactgcttaggtagcttttctctgcaagattaaatgcgaccttcatggaatcatgttagcagggccagcagctagaaaaataaagactaaaccaaaccttcagcagcgaaattcccagctgctcagtggctcagagctttcctgattgctttcttccaatgaaaacactgtagattagttttaagtgaattctagtaggtttggggatttgcaactgacagaagaacagcaaagtgtaatctcactttaaaataatagtcctgaaggtaaatctctattggctctttcttaggatgctgggatttttgttcatatgggaaaacttaactcatacacactgtttagctgacctttgaaggtaaggccctagaaggcagacggaggctggacacctggggatgtggggcaggactgctgctcctctttcttctctccattgtaggcgggtggaaacttgggaagcctgcgaggaaggtccctgtagggaatgtagctgacccgttttttccacttttgggtgtggtcatcctgactattggtgaagtcagggtgaattgaaaatgttacaggagaggatttacttaacttacaggtgcttttaatgcattgcgatttttgtttttcttgaaagtcctcgcagtttgggagatgggggttgggggttggggggcggtgggggggcgggtagaggagagtgctcagctgaaaccgttgactattttgatcattcatccattcagtcatttatttagcaggtgtttattcagtgctaacgatatgtagagggaggtataaaacgaaagaaaattatcttcgatttgaggtagccaggtaggtagatggtctgcattccttacagttaggagcctaattcttccagatagagaaaacacaattaggcaagtaagatgacagttccagaaacgattttacttatctgtgaatcccttttatagttcttccatgggccctgtggggttgtttcagattgtaggggaagccgcagtgctaatgtgacagatttttttgccaagtgtatacattttattttttttaaaacagactcttaatagattgtaaaataggcatagaacaacatattgttttgttgttctttctgtttttccacaattctcccacatttagtttggaacatggaactatggtctggtgtcattaaggaaaactgatggggttaaatcctgataattatctcccctctctacttccccttcccttgtggggagacactgtaaccagcagagctgcagaatcagtactcctgccccccgcggtaaagtgaaggaagctgatgaaagatatccaggaactcttggcactatttttgaaatttttatgtggattggaaataatttcaaaataaaaaggtttttttaaggcttcccattagtgctctagagttactgttgcttatttaaaataacagcctaatagagtatatttgtaagttcctttgtttgcttccccacgtcgatctaaaagggattttatgtagctctttttctacgtaggtcctactttagatatcatttagtaccctctcctcacagggcttgagaagacattgccttgaaggggaaactggtccttacttcattttgaaaatgcttccttttctctcttcgcgtgtgtgtgtgtgcgtgtgcatgtgtgtgtgtgcgtgcatgtgtgtgtgtgtgcgcgtgcatgtgtgtgtgtgtgtgcgtgcatgcgtgtgtgtgtgtttggctatagtgaatactttaagttgcctgaaattaaggaataattatcatccataaaagcactgaaggaaacagtggcagcaagtagggaattcataaatgcatgttgaagcattctttttaaaactgtggtaaaatttacaaaacaaaatttaccattacaatcatcttaaagtgtataatttggtgacattaattacattcacaaggttgcctaagcatcaccaccatccatctccagaactttttcagtatctggatcagaatctctatacccattaaacaataactgcttcccgcagcccctggcagccagcattctactttctgtctgtgaatctgaccactcgagatgtctcatgtaagtggaatcatacagtctttgtctttttgtgtctggcttattttgcttagcagaatgttttccaggtccacccatgttgtagcatgcatcagagcttcattcctctgtaagactgagtaatattcctagattgtgttcgtccattcatctgttggtagatactgggattcttattaatttggctattgtgaataaggctgctgtgatcattggtataaaagtatctgtttgagtccctgctttcagttatttcaattctgtagaatggctgggtcatacggtaatcctatgtttaacatttgaagaaccaccaaattgttttccatagctgtaccattttgcatccccatcagcaatgcacaccggttccagcttctccacaccttttaccaacatttgttattattatctttttgttttgatagggccaccctaataggtatgaagtggtagctcacgatggttttgatttgcatttccctggtaattaatgatgctgagcatcacttcatgtgctcctagccatttgtatatcttcttaggaggaatgtctattcaagggctttcttcatttttgattttgttgttgttgagctgtaggtttgagtcattcattttgtggttttgaaaatgacacactagtaagtctgaaaaactaagcttctccccattacagtatatgtagcatgtggcaaaaagttctgttttagaattttgagatgctgtgaagctgatgaagcacactttgaggaattaacttaggctggagtgaagtaaatcagagcgcatgggtaagtgagaatcagatagaatctcgcaccatgctggaattgggagtttctgtagcaacgattgcctgccccttcccttcattttttcagctggagaaatcaagtaacctgctcagtgtattgtagccaggttaagtacttagtatgttttgttgaactgtgcagtaaataattattttttttctgttgtattttgaatccagaaatgtcttgtgagaggagaaatagcagtgcttgaatatggtagtggatttatcctcgcggctgcccttgtggtagcctctctgcttgggactcggatatggtagtgaatttatcattgcggctgctctgtctgcttgggactcatgaaaaaagccttagagttcttcacttctgtggtatttcaggataaagattagtaaaaacagcctcagagtaacatttggggacttaagaatttaaatataatccattcaatcatggttcaatagtattactgagtggatgaaaaaaaaatattgccgtaataacagatctgttaagtaaaatggataaaagcatttgtgtatttattgtgaattgttgacagcaggagaagccattcatttgttcttacaagagccatagtagataaagaaattcagtgaaatatcacaactgtatggaagcaaattcattgttggtttagttttatgtcctgcggaaatttttcgttttgctcaatccttttgaagagttgaactttattgaaaactatagcctggcaaggtcatgtgtggattataactgagttgtaaataattggaagaagatgcataatatatgtgagaaacagagaaataatatatgtgttgtgaagcagagtggtaagaggagttgcaaaaatttttattctcttcaggcttggggcaacgattttaaaaatccttaaaattagttttaagtactgtgaaaacaaacatgataatgatgaaattaaattgaagactctcttctacaaacaaatatcttaaataaaaccctcagaggaagtcattccttcagcagacaattttgaacagctgtgtgtgaagccctatgctgcgaagatgtaaggttgaaaatttcagatccatgctctcaaagagcttatcatttggttagagagacaagcaggtaaataaccattcctggtcatgaaaagaacgaaagatgggcttcatggaagcacagcaagccaaaggctaagggagagaagaggaagaagcagtatcttctttttattctttttaatttactggagctacccatcatgaactaagaattacgtctttgaccagagaaactggggcgtgcctcaccactgacttctgactggccggaaggagggaggcaatgtcatctggtggccagtgggtgagcagggcatttttggttgaaagaacagcaagagcaaagacatgaagggttgacagtttcttccgttcctggtgcatggaccactctccagggtggctggaacaaacagatgaaggagggagtgtcagagccagttcctggtggccacaaatatctcactcagtgcatgtgttcctgtttcccagtaaggaagggttttgttccgaggatacagccagcttttttcttttttttttggaaggtttttgaggatttggaacattttcccctgtgcatttcagaaaatgatagctaatgactgttagcagcagggcgtgtcgcagctgtgcacctgcagcgttggagaggagctctgaggcgtgtgcatttgtagtctgcggtccattgcgggaaggactgggttgtgcctttgataatagccaggcctgtctttgaggtgcttttatataagtttctaagaggaaatgatgaataggtacaaaaatattttttgtactctcttttgtttgttttgaattggtttgtaaagagagtgattatagtaagtttataatcctcaagtgaggaggaattaaagacagttggctcaaattcaggtaagaaacccaagttagagaatcaaggataatggcaagacccccagaaacaatgccttcatagggcagaagttaggacagggcttcctatccgcccagagtgtccccaggtcttccgagtgacgtcacgccgggccacagaagggctgggcgaacacctcaggtgcaaaccttagccagtgggactcaggaactggagggagccccagagctgcccgtgccatattgaggcttcttccctgcattgggaccacatggatgatccaggaaaattcccctctgtcaaggtcaacagacaacctttaaatcacctgcctccttaattcccatttgtcacataacacagtctattcacaggtcgcagaggctagcgtgtgggatacttgggaggcattattccacctgtatcatgtgttaacccaaccacctcacactcttcatccgacgcagctacagagtgtttggggagatgtggccatcaggggccgaggccctcacagctggggtgaccggctgccttgatggcattgactggatgtttgccggactcttcacttccctggggcgataaattggaagatgttattcaaaggcctagatattcctgtggtttatttcagtatttcaccgtctccactgtattatcactaactgccgtgtttgaaccggttgtatgttgtggagggccgagccacaggactcgcgtagactcggtaccctcagtacgtgttggctgaattcagttgcagtgactgacttggtcctccaattgttatttgctgtccagacacagaggcgcctgcaggacattggtgcccctgggctcaggcacccggtttcccggtagggagggcggaccgggccgcaggaaagcgcgtcagccgggtgtgtgccctggctggaccgaggggtttcctccgctcagtcggcagggaccctcgctgaggtgcgaggacacatggctgactctgaactcgcagcttcagggaaaccttccagcagtttctccaccgcggctctcacgttccccgtggcgcagcttcttcgtatcaccaatggctcggacacgcgggcgccacccctctcttgcccttgtcgttgttcttccttttgttgggaatgttctttcttcccttccacctgaggatccctcggcttccaggcccagttcagatgccccctcttctaggaagccttccagagtcctctcttctgggtttttacataaaatattaaaacttccccataggcctttgaaaaaaattcatctatttgaagtgcagagtcacatttttgtgaggcgaatgaactaatgggggtgagtctgatgcagagagggaactcgaacccagtgtgtcagacgcccgtgatcagtgtgatcagtgatggtgggtgtgcggccgcagggcaggcacccactcgggtgtgctcttcctggcaggcttcgagtctcacctccgggacaccacgtcttgcttgaaagcttgctttaacactgacgtgcccaccttcgtctttgcagggtaagtcctttgaggccagagatcatgtcttcatcatctttgtatactccacagagctttagataatgcttggcacacagcgattttcatgcggttggctcggggtaaggtttttggaatgaaaagttgaaccaacgtaattcaaaagtgtattaacatccttagccggattcacccggaaaatggcatgtaaatagtaaaatttttttttaggttgcatgctttttgtagtcattttatttcctttgcttatcatttgttcataagtttatccatcacaacgtatagttaatatcatccgccttatcctcctcagcccttgccctcagtgagttttccaggagggattcatccactttcttatcaatgagtgattactacatgtcattatgtgcaagctactgtgctcggtattttgggatgagtgagatgggactcctcctcacaggactttatacagagataagcccgttgccaagtacctgaagctgtaagctttggttgcatcagaaggtggaaggaggctgagtgcggtggctcatgcctgtaatcccagcgctttgggaggctgagatgggaggatcacttgaggccaggaggttgagaccagcctgggcaacatggggagacgcctttctctacaaaaaaaaaaaaaaaaaaaaaaagaagaagaaggaagggagggggaggggagggagagggagggaagggggaggggaggggaggaagaagaaaggaatcagtgggataagaggttagaagaagaaggtggagggaatcagtgggaacaagaggttagaaaggtgggatggggatgaattatggtggccaggagtccagattttattcaatgggcgttgtggaaccatggaaggattttctgcaaggtcaggagccatttggggagattaatctggccaagaatgtgcagggtggagaatatgcttctattacagaaggtggaccctggacatcgtcttgctccttgtggaacactgacttagtcactgcagttaggtggagcacgggccctactgtttggaatttctttggggaagtcttaggggagaccaaggaaatctcacctcatacttttcctcctaacataaactagcctttatctgtttcttctcacggtagctctgctaagttgctattaagatctctgtttagtgatgaggaaactatggcttggcgaagttgaaggttgtgagtggtgaggttccagttcaggtgtgcttgatgccaaatctgagctcccactaccatattatgctttaacaaggagagggaaagaaaagaaatcattgtggtcctgggaggggttggcagagaggggaaatagtgaccatccaatggatgccagatccgaccctcccacctctggctaccattcggaaactggtgagaggcagtaggtatcttccaaaaatatttgaagacagttctgcagcttgcagaggagacatggattcttgcttcggaggtattcctgtacttagagtggtagcaattttggctctttttccagttggaattcattggtaattgggatggtttatcccaggaatagaatcaaactagcggaaactgtagtgcgtaagtttatagtttgtgtgctggagcttgaccagatttgaacataaagagttaaattggatgtctccataataattaataataataacaccaagaatagctggtaacctttatggagagctccctggcagaggggacagcttaaaggaaatcctcaaaggaaaagtggcagcaagaagcagatcctgagggccagcctgtggatgtggagtgtgggaggaaatcatttactctcatccaggggaaaagatagtgcccttcaaatcaacctttcagaacaggttattttcaggcaactggtttttgggaaggcgttggttttcaaggtagtctgctagtgatgtgattgaagtcagaaagcagcaattttgttgctctatgcaaataggttttcttaggttccagttccagtatgctggctctttgagtttctgttatttgacttttcacaaatactgaccacattgacatctcctctctcttgtccccttgtcttttctgtgttcctgaaggggcaaaacacaccttttgaggtctgtggagctcaaaaatgaagtcaaaggtgactgggtgacacaaacagctcaggtaattcaggtcctgccgtttctgccacgctcctcctcctcaagccagcatggctcagttatccactctgatgtctacccttttcccacgtgcctcctcttattgaacttgttctctatactgttacgtctccagtgtctgcatcagaggactgagaggtcttttccggcttgcatactgcaggctgacacagtcttaaaggaacttcctactgcactctgaggaggaggagctgtgccttctcgaggtcatgttacttctcctgtactgcaaaggcagtgctcagaggacgtgctgattaagggaaatataggatcacttcttttcccattttccatatggaaagaagctttgaaaatgcagtatgtgctcgagtccatatgctttgaaatctgtgcatgattcttgctttgctgaattgcagaggctgatgccatctagatgctgcgacccagggccaaacacacctaagggtcccagcatgagtttcaatttataaaatacttttaaaagtcagtctacccttttaggtcttaatggccttgcataaatttttctagaaaatgctctttaaaaaaatgatggagtaaaaaatactcttagattttcataatttaaatgtatctggaaggtaatttatctgcaattcacagttttctcatgttgtctgttttttacagaaaagaatattacatgtgtatctgcatcagatttcaagatcattgtagttttttctttttttaattttaagacagcatgtttcacacatgattagattacttgggaagcattcctagaagtgacatggctgggtccaagggtgtagttttaaaatttttaataccttggccaagctgctgtttggaaattttgtacctattttatactcccatagtgcatgtaagatgcaaaacactattctagatattttacatgtttatttgcttttttcttctctctctatttcttctttctttctttccctttttttttttttttttttttgagacagggtcctgctctgttgctcatgctggagtgtagtggcatgatcatagctcactgcagcctctacctcctgggctcaaatgaacctcctgcttcggcctcccaaagtgctgggattacaggtgtgagccaccgcattgccttattttacatgcttcttcatttaatcctcacaaagcctgatgagaacagagaaggtcagtaacctgcccaaagtcacagctaaatgatagagctgggggcgaaagcaggcagtgccgcagagctccacggtccatgttgttgctgcgcccggtctgcacttccatggcagccggcatgagaacatgagcaaagagaggctgtgatgagactccttccttctgggagcctctggatatggctatggcctcgtctttcactctgcttcttgattcatcaggtaggacaggtgcagaatgcttttcctgggccgaagcctatggtcttcgcattctttgtgcagcggtataatttggaaagaagcaatggtcactttggagagccagcccctttgctcagctctcctgtgcccctgtgctgctgtcgttgcccctgtcacctctgccagcatcatttcccatgactgcagtgctggggggacttgggcctggcctgggtccctacatcacctgaggagggtctccaaatagaggtgtgaaggttttacagagattgtgtagggatttcaggctttaaacccttgcttgtctttgctgctgcatttggtgtgagagattgcaaaaaatgtgtatgtttttatcggtgcaaccctagggtcatacagggtcaaaaggcttcctcttttaggaagagtcccagacagctgctaacttatcttcttgttccatccctgtttatgggggatttgtatttttaattgcctttcactctgaacaaagactgagcaagcagaaagtgttgggaagggccccagggaacattctggcttgtgttttctttctgatctgtgggcctgggggacttcaatgttcactttcctgacaggaggagacaaccataggaactagtgtggtgtccagtgccagctggggaaggaaaccagtttcctagcatttatgtttcaggatcaatggcacatgtagaaaaatactatatcccaggggttctatattaccaagaatacccctgaagatgaagcccatttttggatcctcagttctcatgataatggagtttgatgacctagagtcagctttggcatgggctaagccagagcacccttttaaaatgaggatagtaatgagaacgaccccatggggttactgtgagggttaaatgagataatgtatagagtttaatgctgagtgcatcatgggtgcccagtgaatagtcattgctctcacaatccccaccaccactattatctccctagacatcaggagaacaattttgtgaagcaactttggacttttgcatgtatatatttataaacaattcagtgcctgcaaatgtagaagctgatttaagtaccttggcccttatggtaggaaggtctctggggccccttcaccttgaccctctttacctttagagtttcttctttcttcacactttcatgaggaagtatgtgcctctttgaactgaatttctacccaagtaccatggaatctaaacagttcagtgcttttcaacttctcacgttgcataatatttgccatttgattcaaaattacgtgataaaagaaatggaggaggtaaacttgccagacaattcctgtgtctgtttttgcatttgtgcctctgggtatttagtcttttcggtttgcaccagggcttccgtggaggaggagggcatgtgaaatggagcagttgcttacgtactggtctcagtggacggtgtggatgtcattcatagggcatgcacagcaacaaacaaacaaacaaacaaatgccatttaacgtgatccttggaaaggtatttttataataactttagtttttaaatcaaatatttagaatgtcatggagaaagaacaatgatattacaaatgccatcataaaggaaccttagggagactattttaaagaaattttgaatctaaatatttaaagcttttcttattttataagtattttatgtatttgattggtaaggtaaagcacatacgtattgttaggtaaactcgacttaaaggaaataatacttttaaatggctacttaagatttcaaattttataaaaatatttaggaaaagtatttttccactttctaataagcagaaatagtttgcattacattttttcatttcagaactaaacagtgctattattcactacattaagcctagtgtgtgccagattaatgtgtaatataaatacagtttaaggaaaatgatgctgatttttcgtgtagcgtgataacaataatatattccaaagattgaaataacttgaaatctactgcaagccccaaatcccttatttgcaatccaaaatgctctgaaactgaaagttattatcatgactcatttggcaggatagtctgccctgaattgacatgaagctattcatagcttttatttatcccaatcagtgtgaatgttcgtgtttcactgcagaaatattaactgtgttggattaaggggttctgccctaattactttccggggtgttttgttccttgtggtatatggtatgtgtaccgcattatcttgctaacatccacacacttttgaattctgaagactttatctggccccaagattttgaatagaagacggtgagcctgcgtcagtatacctagcccctacaaccagaggcttctcacatcctggtgtttccaggaacagtcgctctttatatctgtttcaggtgtcagtattaatgagaccccattcacattcagaagtgctccattttggcttggtcaccatactaaccacataccatagttcttggtaacggccagcgcagtgttggtgaacatcagtacatttctagtgaattcccatgtataaaataaacaagatctacataaacaacattccagattgtatcttgaaaacctaaagtcatttaaagcattattggtaaggtatccccgactgcctgtctagatggcatttcccacgcattggtgcacgcttcttttgatggcagttcatccttctcctcactgtgattgcctgtgtccctgtcttctctttctaggctgcaagctccttccgtcattgcgtatcactgtgctgggcgtatatagcaagttcattatttagtcaactaatatttattgagcgttggcctctgccgtactctgggccctgggaatagcatggtgaacaaaacagaattgactttggtcctcatggagattcttgtctacagatttgggggcctggcctggtgaaatggagaaggtttgctgtcaagtgactttgaagccaaatctgaaaaatgagtaagagttagcttgtgagaggggatgctcttgaggctgaggggtgacagacgcagagacttgggacggacccctcgctggaggcttgtggggtaaggacaggctttaggcagtggaatgatgagagtctgtttgtgcttttggaagggtgttctggctgtagggcagagctgggttggggttgggggccgaggagagcagtctgaatggctgcctggtccaggctttgtggaaggaaggatcggttcttcacccctggtttcggtttctgttctcagtgtgggagctgttcttggacagtgctgtgtgctcttctccggagtccgaggccaggggagtaactgcagtgttcagccaagtacgagcaagtggaactgacagttgttcaggcttccgtcttgcacacgtcgaggaaacgttgtaaacaagaaacaaaaagcaaagcccttactcctagtgggtcttccctgagccaagtgcttgaaaagctgtgggagtgggaactgttgtcatgatcgaaaatgaaactattctgggaatgccagatttggggcgctgggaaccctgaagtgtcctgcagagaactggtggtggaggggcctctggaggacaaacatctacaatttgcaaatctatcagtgacccagcgatggcacttctggcggtttttcttccaccttaactttgaggtgaggcagagtgacttggaaaccaattctgtgctttaaaatataaaacataaataacttctattgaattagcacagaagtttggctggaggtaaatctttggcgcctaaatctgagcgcttttctctcaaatacgcacgagagctctttggccgtcttatttctcctcttctacacaactgaacaatttaaatgaattatggaccatcactcctcatctcccccaggaaatgaagcttagagcctccttgttcagctaattgttgcttgattaagctgccccttatggatggatagataaagtgattgatgcatgtgcttattaataccatcctggtgcatggaggacgaataaaccgccagcagcttcatttaagcaccacaaagggggtttcctagagtttgttgtatttgcagaaaggctgtcgtcgtctttccctctgtactggaaattacttacctacttggtattgtctttctggccaagtcgttttcttttgagctaatttcagacttccaccacagtttaacaatagtacaaagaattatttttctacatctttggagagtaacttgccaatactgatatcccatcactcctgagtacttgaatgtgtctttgctgtaacgaagatagtctccattgagaccctggcacggccatcagaatcaggaaactagcaccgctgtgtgagtcgcctcccaccggcagaccctgttcctgttggaatgtctcagtcatgtcccttgcagcaggagaatctgatgcagggctaggtgttgaatttcggtgccctgcctccttcattattccttgacttccatgaacttgacacttttgacaatgacaaggcaattttcttagagaatgtgtatccgtttgggcttgttgacgtttctggttatgcatttcttacaagaatatcacggcggtgagactttcttcttcttgcatccttacaggtgatacatgcttttgacttgccccttaattcgtaacgttcatttgatcttttaattaaggagccatcagtcagccttctccatgataaagttagtctttttccctttgtcataaaaaatattttgtgggaggtatttttgaggctatgtaagtatcccatttttcaccagccttttactcactggttagcatccattggtatttcttggctgagtactactttgatagctaccaaatgtcgatcttctaagtccatcattcttcctacatttatttgtttgcattctacattatgggaaagctttttcattcccctatttatttattcgtagattccaattttgttcaatgacagaaatacatttcagtcatgtatttgggtgctcagattgtcttagatgtggccagtgggagctccatcaggttgggttctgtgacttttttttgacatgttgctattatcttttgagcccttccttatttcctttcccaggcttatcttttgctttccctgccccagctctggagtcagccatttctccaaggagccctgattccttttggtggaggatggtgtttggaaaccaagatttgggcactgcctgtgctcattgctgttggggtcttgctgttcccaggcccttttagtgtcaaggttagagaatatgtgtattagttgcatatatacttacacatatgcatgctttttttgttttttttgagacggagtcttgctctgtcacccaggctggagtgcaatggcgcgatcttggctcactgcaagctccacttcctgggttcaagcaattctccctgcctcagcctcccgagtagctgggactacaggtgcccgtcaccacgcctggctaattttttttttatttttagtagagacggggtttcaccgtgttagccggggtggtctcgatctcctgacctcgtgatccgtccgcctcctatgcatgcttttttacctctgtatttatttctgtgtttatcgagatatatgaaaaagcacaaattcaaatcaagtcctcctattctagtgccacagcctgggttattgtagttttctttctttctgtatctgtaacttccttctccagtagtcaaaagcctcacttccattaccctggtatataatataatttactcagttgcctgtgtgtatgtggtcttatgtccccacggttgccccaccacaatgacgatgccctcctcacctccctgttctggctcccagcccctgcacagggctgtggtctccctcctgtgtctatcctcactgcccacatgggcttttgtattctgtgtgccaggtggctgctgccccagccaccctaacaggtgctctctttctgccaatacctaccctggctgcacctgcccctctacccctagtgtctactctattagtttcctgtggctgccataacaaattaccgcaaactgggaagcatgaaacaacagaaatttattccctcacagttttgaaggccaaaagttggcaattaaggtatgggcagggttggttcctattggggaccctgagcgggaatctgcaccatgcctctctcctaccttctggtggctgctagcaatccttggctttctttggcttatggaggagtcactctaatgcctgcctctgtcttcatacaacattctcctttcttctatgtgtgtctgtgtccaagtttccctcttcttaaaaggacaccagtcatattggatttagggcccattctaatctggtatgacctcgtttaacttgattatatctgcacagactccatatgcagaaaaggtcacattcacaggctccaggtggacacgaatgttggggggccactgttcaacccagtacatcttctttgctgcgttgcatcaaatgggcttttggagtaaatcattcataaaggaagggtggaggaaggaagggaagaaggaaactcagttgttttgagaagaatgttctctattactgtattgttcttcttcttcttcttttttttttttttgtgatggagtctcactctgtcgcccaggttggagtgcagtggcatgatctcaattcactgtaacctctgcctccagggttcaagcgattctcctgactcagcctcttgagtagctgagattacaggcacacaccaccatgcccagctaatttatataaattttagtagagatgggctttcaccatgttgaccaggctggtgttgatctcttgagctcacgtaatccgcctgccttggcctcccaaagtgctgggattacaggtgtgagccactgtgcctggcctattgttcttattttctcatctaaaattagggcaccctgctgacatcaggacagtcttggaaaactcaggacttaagagtgagcacaggatggcacttagtgtgatgacactgggctgttcaggaaacacgttcaccttctgttctgtgccaacccggggttggggcacacccccgccccccagaggcccagttccaggtcaaacaactgtctcttggtgcatgttgtcagcccggcgcatgctctgagttctgtaagggtgagtgaacggggaactctgactgtcattggtgctgtgggggaagagagcagcgtgtcagcacgtggactcagctggggactcatggggaagccaccatggtacggcagggcctggaagtttgcgcgtggtccttgattgccctgatggttaaaaccacctgctccccgacttttttcacattatgctctgtgcattcctgcacaaattaaatattctagacagtagttctcccttatctgtggttttgcttttagtggttacagttacccatggtcaactgaggtctgaaaatattaaatgggaaattccagaaataaacaattcataagttttaaattgtgcactgttgcaagtagcatgatggaatgtaacatcccacctcttcctgcccaggacataaatcatccctttgttgagatgagggaatctgctgtagtcccaatactctattatttgactctattacattttctttaaacatcttcccactgtctggtatttgggttagttttgctatataaataatgctctttgaacaatgttgaccataaatttgtgtctgcagaaactattatttgttaaatatcaactattgatggatcaggtactaggctaggcatgttacacatcttatttaatccttaccgcaaaccatgcggaagttatcccattttacagaggagaaaactgaggcatagggtcttgggttctgttaccttctgcgtttggttcctgaagcagtgccctgggaagtggctatagttgccggatggagacctgaatggcttctacagttgtggagatggtgaccagcaccaggggatttctgaatttttggggcaatggcttgttgatttctcatttaaggtctcatttttatcactatactgtatatgagataaggttcctctcctcatctcatatacagtatagtgataaaaaagcgtcactagccaaggctggctcctgcccacttgtcatggatatgggagccgccgaggtcttccctggtctctgccctgcccttagggggctgtgctgtcctggagtcatgtggctgtcagacctcgggtgtcatcctgagtcctgcattgcagctgccatcctactccatgatgaataagggtaggcctatgaagggcctaatcacttattaggaatttgcatgttgccaaattaataagctaagggtcagacatgattgatcaccattaatacccaaaccatttcctagggctgtcatctcagcaggagttgtggtcatagatgagcttacactggctagggaaagctttctgggatgggtggatttaaaactgtctcctggatttctcaaagaactaaaaatagaactgccattcaacccagcaattccattactgggtatatactgaaaggaaaagaaatcattctagcaaaagatacctgtacttttatgtttattgcaacactattcacaatagcaaagatatggacttaacctaggtcctcatcagcagtggaccggataaagaaaatatggtatatatacactatggaatactatgcagccataaaaacaatgaaatcattcacaataagaagcatggagctggaggtcattatcttaaatgaattaacacagaatcagaaaaccaaatactaccacatgttctcacttataagacggagctaaacactgagtacacatggacatgaggatgggaacaagaaacagtgaggattccagaaggggagagagaggaagtagggcaagggttgaaaaactacctattgggtactatgttcactacttggacagcaggatcattaggagcccaaaccccagtatcattgcaatatacccatgtaacaaacctgcacaggtacccctgaatttaaaactgaaagcaaaaacaaaaacaacctgtaatcccagcactttgagaagctgaggtgggtggatcagctgaggtcaggagtttgagaccagcctggccaacatggtgaaaccccatctctactaaaaatgcaaaaattcaccgggcaaggtggcacgtgcctgtaatcccagctacacaggaggctgaggcaggagaatcgcttgaacctgggaggcggagggtgcagtgagcagagatcgtgccattgcactccagcctgggtgacaagagtgagactctgtctcaaacaaaacaaaacaacccctcccaccccgctgcccccaccacccccacccccacccccacaaagttatcttctgaagaccaagagagaagtacttggtatcaagtggtaaaaaacaaacagggctgagagatttaagtaggttggagaaaggagttttggggcacggggtttttgtacttcttggaggtcctgatactaaaaatgaggtcatttttagagtgggaagcaaaacggccccataacgaagtgtttgctcttcatatgcactgaaacggcaggaggtggaaactgacaaatattgaggatgcttactacttcactggttttcagcaccttaaataaatgttaatgtgaaattaacattaagatagtggcgcgtttgccttctatgggacttacttgtgcttctgaaatagttcttcaggttaatcggttatgggctgggcagggcacactttcctccccttctgccttcaaaagaccctggaagcacccaggtggccctgctttatggcagaagcagcaactaaaatgaaacaactgattcatctgcatccaggtgatgcaaagccaggaaaaagcccctctggttctctcttgtttccttaaagagagcatggaggtgaaggggtggagagagggcgagtatctttattttggagtatgggagtgttttcctagtccggactacaaaaggaaagctcgggttggccaggaaacgcagcatgttttgttgatgcccactcgctgggaaagtattaaatggggcaggaagtgtgactttggaaggggctgcataaaggaggctgggaaactgcttcctgtgcacccgggccagctcaggagctggaacgatgtttggcaggctgtggggatcttgctgccctggctgtgtccccttccacacaggctcccagtgcagatgccaggtcagacggaggtgtggggccctctctacctcttgatgtgaaccccagtttggcctgcctgtgcgagcctcatatccaaatgctaagtcagggcctaagactccagttcaaatatgagttctaccactcagtagctctgtgaccttgggaagttacttaaccttacgtgcctcagtttcttcatctataaaatggggaccacagtagtacccacgttcttgggatgctgtgaatcaggtgagcttatcctcttaacgtgcttagaacttgcctaacactgctaagcgcttaatactccttagctattgttaataccctcatggtggaggatattgacaacatcctggtaagtgggacactccctgctggccagctggtatcattttcaagggtttgcaggtctagatctggatgaggcagttactcacagaaaagctcccttgcttaccaacaggttgtgttccaaaggtgattaagtttgcagagtgtgcatcaggctttttaaaactaagcttttcccaaaacaaagctgtttcagtagcaggaacattacaggggtgtcacgagcaggtattttctttccaccagacacctgaccactcactgtgatttggaaagattagaaccggccgggaaacgatgtttccatctttgatgacaaagctttcctcattcatggtagccacatttcaggtattcaggagccaccttgttgactgccctgataaataacaagttaatagttgcaaaatgtctactggatagtgctggtctacattcattgggtgtttgctgggtgcagagtacaaggcctatttaggcctaaggagcgttggtctcagtggattaaagcacatcacaatgaaccagtgactttaggacagtgtaagatgcgtgctaactcactgttagaggcagtgagttttatgacttcaagggaagggggcatgtatgtgtcttgtgttggccaggccaagtattgtggaaaagagacatttgaacaatctttcaaggtatggcgagacgtttccaggctaggcctttctcctgagctccagcctcgcacagctagtagcccagccatcacctctttttgggtatcccagagatctccaaccctgtaggccccaaaccactctcagtatctctcctcaaacatcccacatcttctgttgcagagtggcactcccacccatctagtctaagaaagggaaaaaggtcacacccaagtgagtatgaagagggaggcgaggtagacattcagaaagaagagcctcgcagatctcttttctctgtgaagctggaggcagggagggatctgaaattgcacctgtggaaaatgggaacaggacctggggagaagaaagcaaaaaagatctgcagaggcagagactctgagagctcagatgaggcgatcagccgcccatctgctgcgaggttctccagcctctcacaaatgtttgcagtgtgagcaaacaagacggaggcatgaaggcccgtttgtagtgggaaagtggccaggccactgtgtgggaaggagaatggggccggggaggcccctggagctggaatcccatgttaacgttgctgcccacgttaatatataagcctacgtagtcttgtactctcacccagcagacacgcagtaagtataggcctccgctgtgtggaatgtggaagtggattgaagggagggtggccgggacagggacgctgcagcagctcggggcagagcggagagcccctgaacaggctgccgcgggagcatggaaggaggccgtgggtaatggggatggtctgacagatggagactgcaccccttggtggctgacatggcaatgggtgggagggccagggaagtggctactgagccagggaaagtcaagaaaatgtcagcagagaggtctagctgctttcccattcgtgttcttgcactgtgtttcttacatctgcctagggaactgccctttgagagtttgtggggacctttctcagaaaagtacacatctgggtgaacgttaacacactgcatgtatttttaaggcttgatctctggacgaagagctgctgttcttgttaggctgcattgagaactgttttctagagtgaccactgggtcatctgcagaaccaagaaccagtgatagacaggtgacttttgtgcacacacacataggggccccaagtcagtttgctcgattatggttcggatgcagcacacatttcaggtaccagaggagtctgtggtcagagacaaggtaaattttataaagcagctatgggaatagcttccgaaaggatatagaaaacgtgcctaataggaaaattgtgcatagaatggcaaatatgtaaaactgtaatctggatgattttcagcctggaaaactagttttgtggtatttaaaagcattttagacttttgatttcatatacgtttctattccattaatgatgaaatctattcaccactggcctcctgttttcccatgactcaactggagatgtttattaaacatctggaatctggaagtccattgggttaatggatactaaataacagtgattttcatacttaattgcttatcaaaattattctaggataataaaaaaaattcccggttcttattagagtggggccagggaccttttttttttttttaagtacccccgctccgccccgcttttttttttttttttttaaagttttaaggtaatagcattgcaaggcagttttgggatagtggcatgaacagaacagaaaagaataaaggtgggttatgatgtatttggagtagcagtcctgcctcatcattcatcctgaaaaatctacgtagtaggagaattggtggttgaattgcttgaaaccttatgaggaagactggctggagactcccattcttaaatgaacctatgactttctaaagttcaacaaaacataaaaatcagttttgcattggtgcagataatatgtacactgagaggcatggttttttccgtatctagccctccatccaaacgttaaacgtctttctgatttcaggactggcaatggctgacttcagccgtcagggtcccatgagagtctggagagtgatttgaatgtcgcaggcagagcaggaggaagcgtggccgcataggaaggtctcaggccatgcttcctctctcatatagggggtcctgttatctttgctccgaacatactattttcatgccatgaagttcttgtacattttatttctacctcttagcagtcagtacagctcttagggtatgcttctccttgtttccctgtttctacaaaaatgttaaaaatattaggccaggcgcggggctcacgcctgtaatcccaggactttgggaggccaaggcaggcgaatcacatatcctcttctgcattctacttcccacagtgccccctccctctctctgccgtccacatgctcgcacacacctgcacacacactgtcgggaggcagtccagcctagtgcaatgtttttataccccttcaaccccaggaccagtataatataatgtgacattaaatggaagcaaacgtttcataaaacaatgcttacctcactttgttcggggtgctccctcattttccattctatcatattgtaaattaaaattaagttaaaagtgctgatcttaatgcaacaaatgatcccacgaccctctggtgggttgttagcagagacttgcaaaacacaggtctagaggtttctggcatattctttggagtcagacggatgtagatttgaatgtttgctttaccacttaatggctgtaagtggagctttgtaagtagcttcatttcctcatctgtagaatggagagtagctactctgcctcatgtggcttgttggaagattaagtgaaataacgcatgaaaggcatttgggctgagggtcaggctctagttagggctggaatggtattaatgatggggatgatgatgatgatgttcaacttctaactccagctttcaatttacataactttcatggaaattcttacttttgctgaaaaagcacacagaagtcgttgtgaggaacttgcaggaggaacttgcatttgggaaaagactattgtgtgcccaggaaaaattactactaaacactgctgttagattcctatacgcgtgtcatcgtgtgtgtgggtttttttttttttttttgtacgttccaatagccactgtcctgacccagagcagtagttctagctcacctccttccctccatttggctctgtatagagtgctgcatgactcgtgaaactgaagcatggcttttcccaagtcgtgcactcagaagtcattatagcagcctgcgtaaacaagctcagactctagctgggcatctgagaccctcctgaggttcaagtcctgcctcctcatctagaggcgtgggtgacttagacattttcttttctttcttatttcttcttcttattttttgtgggggctgcctttttggctatgcttttcctaatctctaaaatgatgataataggctgggcacggtgacttatgcctctaaccttagcagtttgggaggttgaagtaggaggatcacttgaggccaggagttcaaaccaacccgggcaacataggtagtgaaacccctgtttctacaaaaatattttaaaaaattaggccaggcgcggtggctcatgcctgtaatcccaggactttgggaggccaaagcaggtggatcatcaggtcaagagttcaagaccagcctgaccaacatggtgaaaccccgtctcgactaaaaatacaaaaaaattagctgggcgtggtggcgcatgcctgtaatctcagctactcaggagactgaggcaggagaattgcttgaacccgggaggcagaggttgcagtgagccaagattgcacgactatactctagcctgggtgacagagcgagactccatctcaaaaaacccgaaaaacaaaaaattagctgggtgtagtggatgcacctgtagtcctgggtacttgagaggctgaggtgagaggctctcttgaacccaggaagtcaggactgtagtgagctaggattgcaccactgcactctagtctgggtgacagagtgagacctgtctcaaaaataaaatgaaaaaataaaatggggatactagtatttaactggttagagctgttatgagagttaaagatgattgatgtgaaatacccagtgcttgcttctcacacaccagtgactcttatgaagacacccctgttggtgcataagacagttgctctgctcacatcagcaaacacatcttcagtcctgctttggccgccgataccaaccttttacctcccctggcttgcctgccaccttctccctgcctagacagcacctccccatccattaaggtcttcctttaccataaagctttcctttgccataaagctttctcttatatgcccatttaacaatgatttatgtattccttatgaactacctaacttagttggcaattaataatacactaccttctgatctttattgcatagtcttttattattataattataggattattagttagctttatgtgatttatctctcacatcctcagttaacttatttgttccttgagggtagtgatcatgtcttaccgtctttgaatcccccacagcactcagcacagttccttgtaacaatgtgtgtttaatgaatttttgctgatccattgggtgactgggtaataagaaaaggcgttccatggccgggcgcagtggctcacgcctgtaatcccagcactttgggaggccaaagtgggcggatcacgaggtcaagagattgagatcatcctggccaacatgatgaaaccctgtctctactgagaatacaaaaattagctgggcatggtggcgggcacctgtagtcccagctactccggaggctgaggcaggagaattgcttgaacctgggaggcagaggttgcagtgagtcgagttcgagccactgcactccagcccaacgacagagcgagactctgtctcaaaaaaaaaaaagaaaaaagaaaaagaaaaagaaaaaagaaaagctccagagataatatgaatcctagggtaatgttatgttcctcaagatctgatttctatttacttttggtagttccaggtcattttcattagatcagggattgagatgattcaaagctgggcttcagcctttgatattagtttatttctacttagttgtattacttacaaagcttgtgagggtgtttccaggaaccccttttcctagctgcgtcctgatgttcaatttttgtctcctcagtcacctgagtgtgtcaaaagctctgctttcaaagccccacagcctcctcttcagaaaggagcagctgtccctgcgctaggacgacagcagccctaaatgtcaggttcaccttcctgggtttctttttctcctagatcttgcccccctaatttttaactaccttgttagctctctgatgcatttaaatggattttaaaaatatattttgtccatgtttcttagttattcagcctgggagtcaggtctgaattacctactgtaccattaccagaagcaccacccccctctcagctaaggaatttattaccttaaatccagcaggcacatttagaagtctctggaacagagaattaacatgattaaatggtattttaggaagatgactgtcagtggtttgcaagacggagaggagtttggaaagtctcagtaagtagaacaattaagaggtcttcataactcagtgctttctaaagtacgatgaaggcagaggttagagtggataagcctgggtgtttcacgttagataggcctgaatttaaatgagagtcttggctctccacttactagcaggtaataaaggataataaagtccctatgtcctagggttgtaagggttaaatggcaaaacttgtagaaaaccctaggttttttattttctatttttagagaggggctgtctttctgccacccaggctagaatgcagtggtgtgatcatggctcactgcagcctcgaactcctggcttcaagtgattgtcccacctcagcctcccaaggagctgaaaagacaggtgtgtcccaccacacctagcaagaaaaccctagttttaatgcccagcacatagtaggtgctctgtaaatggtaaccgttgctcttactattccaagaaccaaaattcagttatttgggtgaaaattcaacctcactgttaatagcactaatcatggatagtactgtcaacttcatgggggatcattcgtgacttacgaatcacaatgaatagcttgcatgccttatatagcaggcttggcaccagtgatattctcagtacccaccatgggctgaattgacttatggccagatgccacagttttgaagccagtcccagcctcaaatctcaaaggtgtaaaggtagatgattttacaacgtgcctttcgtcaggctccagggtagatgcttcaactcttttacttactttgaagtacaggttgctcatatattaggtttgcagaaccataaaattttagcattttacttctaaaaacaacctgatgtgcaagaagagaagcttacagaaaaaaaaacatcagattatgattcatcgtatcatggataaccccaggaatcatctgtttaaaacgtcccatttttctagatgatcaaagtgtgggccgggaagatggagggattagcccaaggacacacaccagcaatggcagagtcaaggtcgcgacacaatgtcctgatttctgtgcattttggttcttagacaaacatagccgctctgtgtcatctccactgagctacctgccttctctaactctgttcgaggttcacgtggcctgactgttagcgcctgtgggaggcttgccttacagaaagaccagcgtgtcaccttgactttcgataatggaagctagacgatacataccgagtaagcatctttctttccagtcctcagtcctctgaccctctgtgcctgtcatctcagtcttttaatctccggaaacataattaatctgtttttagtgtccaactaaatgatccgtttctggtgctaggcttgaggtagattctgcctttgctgtttttcacagaagtaaagatgtacgctcaccctcggctagtcgtgagaaacctgtgtcaaatggcaaactttgtaccgtgtcgcgaggcaagcgcactggtaatgcactacctgcccagggcgtgggagatgggtcaggggagaaaaatcaagtcacaaaggagaagggccttcatgtgactgggttagcttttcattgagtctcattggagatgtcctagctacaaacaaaccaaccaaccaaccaacccaagcaaacaaaacctgaaataagtgtagccctttttaagtttattttttactctgatgaaatacttgttcgattttttgctttttctaaaagttacctataattagtaacagtcctgattgaagattgtgaacttttctaataagtttgcggtttggctgagctgcatccttactagacaggcatgttgcgtaagtgaggaatgcacccagccggtggatgacaagcccggcacgccgaccagtggaggagtctatcagaatggccaaaatgaccacacggcaggagcatgggagagccaggccattgagcatgaacaataaggggactctagagctttgcttctcagagtgtgacccaaggacctaggggcttgtcagagatgcagaccacagcggtcgcctggaatccactgacttgggattcctgtgcacgttcaagttggcgaagcgctggatttcaggatttcacactcagctcttccctttacgttggccaaactgaccctatcattcttttgctaaaatccttcggtttcctcttcagtcttagatcgtggtcatgaccaaaatcctaggcatggtcttctgggtgagccgggtctctgggccctccctgtcactgactgctgtccacaggggccaccttgcctcagggcctttgcagctctcccttctctgttagttgctcagggctgccgtaacagatggctctcacacaacagaaatgtattccatcacaattctggaggtcagaagtctcagatcaaggcatcagtagggccctgctctgcctcaagggtcttggggagaatccttccttgcctcttccagcttctggtggctccaggcatggttagctgcagcagcctcactgcagtctctgcctttggcttcacgtgcccatcctccctctgtgtctgtgtcttcacgcggcattcttctctgtgtctgtgtccacacttccctcttcttataaggacatcgggttcctgcgagctactggtcacaatattttgtcagctgatcattgtataaccttgtcttatgtgtttctgtttgaagacaccctctgtaatatttattgttgattgatgagcattgaactcacagcactataatgcatgcctgagcaaagcttatctaatatacgtattttccctgtaaggcgcatcatagccttctggttcttaggaacccgggaaggcacttcagcacaatgcctgggggccattttaaacagcaaagtcaccaaaaaaagcacaacgatgtgacaaatgtcgcactctgtagcctgtgaaaagaacacttgtctgccataggagagcaagagcgggaaggcagagtgtggccttgtccagcctcagctgggaacacgtgcatcagatgacttgaattcagcacacgtccccgagtgaccaccaacgcatctgagtattgatttgggggttgtggatatgtttcagtgagtaggcaaattcacagatacagaatctgcgaacagtgtggatcgaatgtgtcttcacacacaggctttagttttaaagacagaaagttgggttttttgtcttggtgctttgctttacctgacaattgactttttcaactactgtttccgtttaaaactgatcttcgctgtctttcagagagatgcctgtctgtgagaactttaaaagccatcactaatataagaacgggaaccactgtgggctggagggggtcacctgaataggaaccataccatatggctttttgaactatttcagatgtgaccattgtttttttttttttttcccccaactggttatttgtgagaaacataatggaggaaatattatattctgagtactagctggaggcagggccacttccacacgcctctcgtgtttccatattgccaggctcaggctcagctgcagcgccagggaccacgcacagcacttctgcacgtcaggctgtcaggagaactggcgtctgttgctctctactcgtgaccactatacctacccctatcctgtaactactcttccctcgctcttccctctattttcttgaccgctctggatttagtggtctccaatctgtgtcttgaggtcttttccagagggaagatcaggctgggctggtggtcaccaccctggcgggcagagctcttgcagggtgagcctttgaggggtcaccagtgcactcctctgtgcacagcttttcccagcactccctagtcttttctgaaactctttatcatcttcatggggcatggtacctcccttctttccagtgtcctgttaggttgggagttcctagatggcagggaatgtcatctttccctgttcctggagcatcattctcaatacatgacctttgaatgggtggatgaacaaatgaatgaatggaacaaatgaatgaatgagaccaagagcagcagtatctgcaactccttgtggccattccgtgttcttgtgaaatatctctaaggttcccgtttgtgtctcaaagaatggtggctggagcctccatatgagtggaggaggccaacctctgacggcaccccacctaggccctcagagccgtcttcagagctggcctgggcctggcagtgagtgtttcctatgtggaaggcaacatttgcgctttgtaggactagcaaaagacctagaagagggcggagcatgggagctcatgtctgtaatctcagcactttgggaggtcaaggtgggaggactgcttgagcccaggaatttgagaccagcctgggtagcatagggagaccccagctctacaaaaaataaaaaaaaatagctgggcgtggtggctcacacctgtggtcccagctactgggaggctgaggtgggaaaatcgcttgagcccaggaggttgaggctgcagtgagctgtgatcatgtcactgcactcccgtctgggtgacagagtgagaccctgcctccagaaaaaaaaggtgatgctcttcctgcggtagaacttaaatttggttaggaaaagagagtggactatacacagctgagaggtgtataggtaaggcaagggataagatgaaagactttacttaaaacaactgccctaaagcaatgtttggtttttcaaaggagcagtgtaagatcagtgagtaacataggagctggaggcagagggactactttaggcgggagtggtctgggaagcccttgtggaggaggaggctaggtcttagagggcggataaggacctgcaaggccagggaatgaagagcagagggcacgggatgagcacggagcaggaggtgtctgcagcagtcagtgggccagactgcaggaggcatacaaggaaaaggctgggccagactgcaggaggcatacaaggaaaaggctgggccagacagcaggaggcatacaggcccagggtgaggcccaggggctgggggtcacggaaggatgcttgtaactctggcatgttctgggcgcagggaatagaggagagaggaagtccatggcaagctgggaaggagagttattgagacatcagcccaaatgccaaggaatagaattttcagagctcaattttggaggaaatgaacaaaagaaggaagggaccaatcaggattgagaagaggattacagtgtcacactgtctgtgaggtcctatagaatggaggcttgcacctgacccatctttgcttttggagcccagattagatgtgaatgcaggcatagatagggtgaagatgagtgggggacagtgtggaaggtactttgttagtgattcccctctggatctattccgatggaccaggagaagtctatcttagaaaggaatctggaagcagcagggaggcattgtgtggactggcggaggaagggtggtcagactatgaaaatgatttccaaagggaaagtaagttaaaggaaaagggggtgatgtcaggtcagcggggaggctggcattgaagaaagacacttgggtgagagactgcattcgggtaaaagcaaaagcaaaggagatacctgtgcagggttccaggggctctggaagtaaagtcaggagggacgggtagttggtggaaaactttgggaaagccaaattaactgattcctttcgagctttaaatgttaatattgggggttgaaagcgtttgtataacccagattctcaaaaggaatggcttggctatcataattttttcccacaactgctttgctctgcccaccccttggctcttggaaggatcatccccaaaggcgttggggcctctgagcaacggaagcctcaaaacacggccagtgcagtggggataaagcctccctctaggcaaattcctggggaggagtgtgggtcctggtctccaatgtccataggaccctcccagcggagggcaggcctggaccatcctgtgtccccagatagccccctggccggtgcgagggctgggcttgcacaggtggcacagcccctgagtacaccgaccccccagccccctggtccccagccccaggaaaggagagaaggaaagagtcaggcggggtgtagaactctgcagtgcagacaccacactgagtggcaccaacgcctgacgctgtgtttctctccctcaagggcaccatgccggtggaaaggatgcgcatgcgcccgtggctggaggagcagataaactccaacacgatcccggggctcaagtggcttaacaaggtgagtgggtcagggtgggtgtatgtgtgagagaggtcctggctgaaacacgcccatgcggactgctgaaagtaaaatcgtgtgtattcaaaatcttaggcttattcatgacaaaaaccagccaacccaaaatgatcataaaacatcaagttatcatctcaaaggctttttttcttttagagacagggtctcactatatggcccacgctggagtgcagtggtgcagtcataactcactgcagcctcgacctcttgggttcaagtgatcctcccacctcagcctccagagtagctggaactacaggtaaacgtcaccacacctggccaatttttgtatttttttgtagagctgggatctcgccatgttgcccaggctggtcttgaactcctgggctgaagtgatcctcccacctcagcctcccaaagtgtggggattacaggcatgagccactgaacccggtcacaaaaggatttgtatcctgtacgactgtagcctcagcctggagtctccaatgtctgctcacctttggtgttttggctgactgcctctcgaaagctccttgctttttttggaaagctccttgcttctttgaggattcttaccctcttccttctccaaattccttttttttgcttctcctggccttttaggactagaggacatggaaactccagggttttatattaggaatggagcatttccttttccatgttctctgtttaaagaaagcttgtttttgtctttaaaaaaagccttctttttacctctgtaatgaagccctatctgtgtgtccacctttcctaagaaagcagccagtcatttacaacctgccccttccaggcacaaacactcccttactttgttaacctaaaaactcttaatttaattgatcctagctgttaggggtgaatcagaaagagataatgtcggcaaaaatgaaaaacttctagaactatataatctagaaaagcaactaaatatatatcatgccttctttaaggaggcccaggagagaagttcctctcctaccagaacagttctgagtcaatgcctttttcctcttctccactccctccccttttcttttttaatcttaaggacacaatgaataatttagctggccaggctttatctttgtatcaggtacaagagcttagagccagattgcagattgtagcctgcttccaacaagggaacaggatattgcagtataattttttttaactaatatcattcctggccttattgggtcttttcagatatctttcaaatcttatttctttttactattttccttttatccacttattttgattttttttttgttttctttagacaaggtctccctctgtcacccaggctggagtgcagtggcacgatctcagctcactgtaacctctgcctctgtgctgaagcgatcctcccacctttgtctcccaagtagctgggaccacaggtgcgctcctggataatttttatattttttgtagagatggggtttcactatgttgcccagactggtctggaacttcaggactcaagtgctgcccgccttggccttccaaagtgctgggattacaggcatgagccgcagtgcccagcctgattttgaatttaatgttactgtgttgaatatgtctgtctgagcctttctgaaacaaggtgaggcactaagtaaatagaaatgaagaaaccatctgcttatttcctgtgacctgtcccatatctcaaggtcttaccacaatgtatttttctagggttgctctatctatagtgttttagatttacatatgtaatcagcttcttccaaagaaacaaacaagaaatggagttgctccttggtcagctcagttagcaggggtgccgtggaggtataaggaaggggggaccagagtaaaggggagctggagagccagggtagcaaatgacactgaatgaaagctgacttgtactcagcacttactgtgtgccaggcacccttctaagcaaggtacatgcattagctcacgttccgccaccatggggtaggtacagttaatattttccattttacagacaaggaaaccaaggcacagagaggttaagtaagattctgttttgaggaacaaggtagcattactgtttgatgtggagtgggagaggaaagcaaatgctcctgtgttctaaagagaagcaagtggtctgcttctgcttttcctttttcaaaaatacctccactagttttggttggcaggatgcagtggagaagagacagtgtctcacacctctcctgttgagcaggtgcctgatatgttgaccgctgtggttggtttagactaaccattagtcccttcttggtgctgtagtagatggaactgtggctcccggagaagatatgtccacatcctaacctccagaacctgtggatgtcacctcatttggaaaaagggtttttgcagatatagtgaaggaccttgagatgaaatcatcctggattttctgggtgggccctgatgccaatgaggagtgtctttataagagacagaagaggagaaggcacacacagaggagaggggcatgtgaggactgaggcagagactggaaataggcagccgcagccgagggactccaagaagaggcgaggaaggatccttcccagagccttggaaaggagtgagccctggctgggcgcagtggctcacgcctgtaatccccgcactttgggaggctgagttgggcagatcacctgaggtcaggagtttgagaccagcctggccaacatggtgaaactccatctccactaaaaacacaaaaattagctgggtgtggtggcaggtgcctgtaatcccagctacttgggaggctgaggcaagagaatcacttgaacctgggaggttgaggttgcagtggtggaggttgcgtgagctgagattgcaccactgcactccagcctgggtgacagagcaagactccatctcaaaaacaaacaaacaaacaaacaaacaaacaaaaaaaaaccggagtgagccctgcagagaccttgattttggacttctggccttcaggactgtgatggaatacatttctgttgctgtgagccacccagtttgtgtaatttttcatgacagtcttaggagattgatgcaccctctaagggtcacttcctttctgggactctcagttgagatgccttttcttccatctattttgtccatgtttttctgatacaggaccagaaggcaaatggatttccctttgtgcaaatgaacacttggcccctttcaggcagtccttacctgctgagcgtcactcatctggctcttggctcgagagttctcttcccgaggcatggaaggaaaggagacctctgtgtcatctcacagggctcctccgctacagctggacctgagccaggctgatgaaggagagcgtgcccgtggctgccggcccgtgccgcctctcagcaccgccctggaacagaggccgaggcctgcactgtggccccgaggccctgtcaagctgcatcctgctgaggcctagccagagtgggcacgtggcattgctcgtgcacatgggcactgccatcactgtcactgcaggcctcggctggggtcaggatctcttctctccatacctacactcccacagggcatttttttataggtttccgttaacttaggcttgttggcattcatctgtccatataaatacttaactgagagcctaatgttcttccctcccattcacaagcattctgcctgggaatccttgtttatattttgagtggtttgaggtcattccaagatctcttttgccactgaagattgttgtaactcttagaatacactgtccatggggctgtgggactcacttctgcttcagtcggcattcaggatgtgttcatgtttattgtgaagtgctccaggctgggagccccatgcaccggtgccttggctatcttcttcatgtctgcatgctcagggccaggcctagtgcctggtaagtgggaggccctctgtcaaaattgttctgggaatacacagatgaatgtcatggacttgaaggggagcaacattggtggtgtttttgttctgttaagataatcagatttatggacactggcttggcagttgtcacatggctctcagaaagtccattcaacctactccattcttagtaagagagaaagagttggttaattaatgccttaaatttgtttccatcctctattgtcttagtctgttccctgttgcttctaacagaatacctgactctggataatttgtaaagaagaggaatttatttcttatagttatggaggctgagaagtccaaggttgaggggctgcatctggtgagggccttcttgctggtggggaccctctgcaaagtcctgaggcagtgcaggatatcacccggtgcggggaaagagcatgctcacgtgctagcacaggtctctcttcctcttaaaaagccacaatcctacccctcatgacaactcattaatccattaatccctgaatggattaatccattcatgagggcagggccctcatgactcaatcacctcttaaaggcctcacctctcagtactgccacattggggattaaatgtcaatataagtgtcatagggggcaaatattcaaaccatagcacctacttttaataagtttgaaggagggtgggaatggaatgggtcccttggattcctctgaaggaacagcgaggaagtttggaaaagtgcattataaccagctcatgaatgagaccttggctggggcaatttacctttggttatgggtatttgcaaatgtgcatagcatgtttgagtagcccaatgacaaaaagaaataggatagcaaattttcatatgcctgtatctagatgtatgaatattttgccttatctttgtgtgtgtgtgtgtgtgtatctgtgtgtatctggtatattaaagcagctccctgacagcatacattgtaagacataagggcattttcttatatatccacaatataccattgttaattggacaaaattagtactgtttaatatcatcactgctccattcatattaagaatgccttgagtattcccaaataatctttttacagttgatttgttcaaatcagaattcaaagactgtccacaggttgtgtttggtgtttatgactctaagtctctgctgactgtgggcctctgtttttttccttctcgccattgacttgttgagaccaggttagttttgggtttgtccacatgcttgcttgtggttccctgggccatttcttgaggaaggaaggaggcagtcacatccggggtcctggtttctctcgtggctccatgtgacccccaactctggtggggttattgatgttcttagttcttcctggatccatgcactaaggcaggggaatcatcagatctttccctttttttcactttgagagtagacttgtgtttgtgtaaacatcaggctatctctgaccacggtaaggagtccagacaaaaatagcacactaattggaacgtcttgcaaatgttggggggaagaagaggcagaggagataacagaactagtttccatgtggggccaaggaacattgttctacattgctcaaaataatgtcagatgcttttctgaagtcaagcagcgctcatctctcctgccttccttcagatgggcagagttgtgcacacacgtacaaatggtgggccctggcatggcgcgtctgtctatacacagcatgtaccaccaccacgtgtgcaggactggtcactcggggatgagacacctggcacatactgacgtcacggggtctacacacacatagcaacaccgtcatgtcccatggaacacacaacttgtgaccagaatgtttactggtcagaatctctttcagttttaaaatgaatcttgctttctcttaccttttcatatggtcttcttcaaaaaaagaatctgtgatacaattttaaagatatttctgataagtttattagtcttttcttttttttcctgaagtatgaaaaactaggtaaaggtgacatgtagtttaaaaaatatttaccattttaaagtgacattcacgatgtcatgcagccatcaccactgtccagttccagaactttttatccctccaaaaggaaatgctgtacccattaatcagtcacttcccatttccctcccccctagcttgtggcaaccagtaatctgctctctgtctctatggatctctgctctctgtctgctctctgctctctgtcttttctggaatatttcatgtaaatggaatcattcaatttttggccttttgtgtctggcttctttcatccagcataatgttttcaaggttcgtccacatggtagcatgtgtcaatactctattcctttttgtggctgaataatattccattgtatggatataccacattttgtttacccattcatcagctgatggacactcgggttgtttccatcttttggcttttgaaagtagtgctgctatgaacatttatgttttggtttgaatgttggcttagaattctttgggtatatatccaggtgtaaaattcctggatcatcaggtaattctgtgtttcactttcttgaggaatggccaaactttttctccagagtggctgtaccattttgcatttccacagcgatgtgtgaggattccagtttctccacatcctcaccaacgtttgttatttgtgtatctttttttggagacatgtctgtgggttagtctgtttcatgttgctacaaaggactacctggggctgggtaatttataaaaaaacgaggcttctttgggtcagggttctaggctgtacaagaagcatgaccttggcatctgcctctgttaaggcctcaggatgggaggcaaagggcattacatggcaagagagggaggaagagagaatggtgcaggcgacaggctgttttgaataatcagctctcaccggagctaatggagtgagagcttactcattaccacgagaacgacaccaagccattcttgagggatcctgccccatgacccaaacaccgtccaccagaccccacctgcaacactagcgatcaaattttaacacgagattttgaggggacaaacacctgaactattccagtctactcaggcctgttgcacatttcaagagggtccatagtgtatgttgctgggtttggtcagcgcttttgtagttgcatggcttttgcggtttctgtgggactaggtttggttgtgtgtgtgtgtatgtgtatgcatgcatgcgtgcagatgcttaaaaagatctactttatctgtatcaattttgtgtcttgcaagttagatttcagattgtgtcaccctagaactcctttgatctagaaaaaagtgcaacagcaaattcttaagaatctcggtgtttaagcataaagctttagattctgggcatgcacttcaggaaaagctctttcacgaaatgaattttcacttgtattcattttcatgtgaacatcaataaatggcattaagtgattttgctgtcgattttcatctacattaaagcataaaatgtcactcagcccctttctgatcactgtccttttgaaattggctaacccgaagccctctctgtggatgatacagaatgaacaccgaggaatttatgaaaaagtctctcactttcagttctcctttaataactgactttttagaagatggtagaattttccttttaacaggttttgggaaactctccaatgttctgaaatagtctttgttctggctttgtgattggttctgtggagaggcgctgaatctctttggggacagctgggaccctttctgtgtttcactatgtgagactgaagtggtggaaactccctgctgacatttcctctccttcctcagcatctagtgcagggatccgcatacctagcaattaccagaactgccttgagagctttgaaagagtacaacctcctgggctttaatctccacagaatccaggtctcaactggtctgtcataggacagggactcttccaaatctaaaagctgggagacaatgagtgggtgattaagtaatagcatatggagtcgcatgacctgggttttgaacttagacacttattatcctgcaagttccttgactaaatagttaaaatctgcttcttggtttcctcagctataaaatggaaatcgtaacatatacctcactcagtaggctgtgggaggaagacaaaactgaggtccctgtggatgtgggtagtcagatgcacagtgccaatgggaccttagtacctgccggtaccgccacaagagctgcttgggccaggttcctcatctgtagctttactaagagtacggctttgttactaaaccatgggtttccaatcatgtgtttttcagggttgcttgaggcggttttgagttacagacctcaacactgagagagatgtagagatagtctgatataaggattgtattgagggatgtttctccagaaaaatgtgtcatttcataacctctacctctttgtttgcacttcttgctatttcttgcaggcagtagacccacagggattcgaacattactttctatttctgttggatgcacaagcaaatggagatatttggtttctgtgacagtggcctcagatgtacccgacttttctttagtagcatcaagggttttggaaacttgtctaatttttaatttacctaagatagctggagttactatttaccaaacgacgagaataaattataagagtaagcattagaagtttcggtaggtggccatttttctgtggttttataaaaaaaagaggcacagggccgggtgtggtggctcacacctgtaatctcagcagtttggaagcctgaggtgggcagatcacttgaggtcaggagttcgagaccagcctggccagcatggcaaaaccccatctctaccaaaaatacaaaacttggccaggcgtggtggcacatgccagtaatcctagctactcaggaggctgaggtgggagaatctcttgaacccaggaggtggaggttgtagtgagccgatatcgcgccactacactgcagcctgggcaacagagcgagactctgtctccaaaaaaatatattgaaaactagaaaagaggcacaaataatggaacacacaaggtcaaatcatcacctttgaccttggaaaacattcctgctctgcaagacttcacgagactgactgtcactcggggtagtctatcaagatttgggatccagcgggggaagtgggtttggtttacagtagattttcttgtcagcagtcaacacattcagcgatgcttgctggggaatcttgctggctagaccttcacaaccttttgcaatggtgggccaaaacccatgactccagttctttaccttttttttttttttttttttcaggaaaagaagatttttcagatcccctggatgcatgcggctagacatgggtgggatgtggaaaaagatgcaccactctttagaaactgggcaatccatacaggtactaaaactccctgcggcgtttatagaggaaggcactcttgcttagttttgtttttattacacataaaatagcctggcttatgacctcatgaagatggctctgaaaaacctgtgacttgtccctaggcacatccaggacacatggggtacaaactgcagccctcagaagtaatgctcccctcatcccatacactcttagtccttcaatttcctataaatgtggtattctaagaagttccctaggtgttaccggggaatagaaactcagttgttctgatgctataaactttggtcaaatttatctcccccccaaaaaggtagtcagaaatacctgtatttattacaacctttacgtagggagctgtttacaggaatggactttgttggagcgtcagatgaaaaagaggcactcagcttccctctgcctgttgactttgcagcctctcagtcttctgtatttttcttacgctgatgctccattcttccagcatttatagtttcctcaagctgttcagtagaaccagggtgaccaacttgtcccagtttgactggaactgttcaggttttaaaaacaaaattcccacatcccaagaactttctcacccccaggtacaccaggacgattggtcactggaggtatagcatggagtgaaaaggtttccttatactgcctgaccagcaatactgtgtttccagaaattccttcctctgtatctaatgttttctctctttttcttaatctttgtctcttttgttaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggtaaaggcatttacagactaaaataaggtaaatcaatttgtgtcatcgtgccttcgtgatctcttcatttctacatctgcagtcagtttgcaggtagaatagcctgttcatgctgtaggggatcattccgcccctacctggcttggaaacaagactttcgattcaccaaaggcagtgaaagatacatgtggaattttgaccatgtacagattaaagcaacaggttcattgagagtttcagaaagaatttaatttgagggaaatgtttctctggaggcccttcgtgaattaatccaaaactacatttttgttgccacaggaaagaaaccaaagacagaaaaagaagacaaagttaagcacatcaaggtaatcttgggtgattcagagagaaagccaaagttgggatcctattaatgactcatattctgccttgtaaagatgagtcacaggacctcagtgtgtcctctttcttcctttgcttgtgtcttctgtgctttacatgtttgctcttcagcatgtatccacttgcagacatggaggtacacagggccctgcctcatcccgtttctctgggaaatttatgaatgaagtcacagattctcactgtgctcggcaggctgaggcctccatctggccaccacagccgttgccagtggtcattttgtgccagctaaactccacaacagcttatgtctcatactattaagtatattttcaggctattaagtatactttaatatgtattaaatgttatagacctctatacgatgtatgaactctatgttacagacattccgtcacaggcccttcggtgggggacagagtggtcaatgtcagcactctatcagcacagctctcaatggctgccttctgtccactgtagaatcatctctcacaccccacaagggttttccatgggatgtgcatgtgtgtgtcagcttctcactaggctgtgtcgtctgaactcccctacagtctgaggatctttatgcatagattaggtggcccttgttaaatagtaagagaagagccgaatatgccctgcaaaactggggacgagcttcagtggctgagcagagagcatacactgcggtcacagacccagggatctcagagagattgtcgagctccctggcctccctttgcagatgaagaaatttaggcggagggtgtttttgcagtgatgctttcagtttcacttttactagtttttatttttaactaaatttaaatattgtactgtattaaaggcctaattttgttttaacttttcattgtggaaagattttatgcacataggaaggagacagttgagtaaaatttaccccataggccatcattcagattaattttaaccttaatcagctcctggccagttttgcttcatcaatagcccctcccatttcctgacttctaacatgaaattgcagcccttcaaccatttttgacttacagaagtaatttatttatttaattttttttaaactgagatggagttttgctctattggcacaggctggagtgcaatggcgcgatcttggctcattgcaacctccgcctcctgggttcaagcgattctcctgcctcaacctcccgagtagctgagactacaaacacgtgccaccatgcccagctaatttttgtatttttagtagagatggggtttcaccatgttggacaggctggtcttgaactcctgaccttaagtgattcgcccacctcagtctcccaaagtgctgggaatacaggcgtgagccacggcactcggccccaaaacaattttttatagttcagctttttttttgaactattttttggaatttgaagcaaattccaaacctcatagcatttcttccataatagttcagtatatatatttaaaagataagtgctctgtaaaaataccatgatgtcattactgtacctgaaaaagttcacagtaatttctcaatatcagtgaatatccagccagtggtcagagtttcagttgtttcatacatgttataacattcgtgtagtttgttacttaaattaagacccatataaaatccacatgtgatttttgaatgtcttttaagtattttttaaggatatatgtttctcctatattacctcttaaaacatttttttttttttacaattgaacaaacctagttgttagccatatcgtttctcacagttttttttttcgttttttttttttttgttttttttttgagacaaggtcttactctgtcacccaggctggagtgaagtgacgcgatcatagctcactgcagccccaacctcccgggctcaggtgatcctcccacctcagcctccctctagtagttgggtctacaggtgtgtgccaccaagcatggataatttaaaaaaattttcttttatagaggtgaggtttcattctgttgcccaggctggtctcaaactcctggcctcaagtaatcctcttgcctcggcttcccaaaatgttggaattacaagtgtgagcctggctgagtttgtatttttaaggcctacgttttgattcatgttatttagtcagaaaagcacagctttctcacacatgtgtgagaatttgctacaatttcaagtgtgactgaatcgtatttactactcttttcccattatctagctcagtgcctggcccagaacagatcactaatacgtatttgataactgaatagatgcatccgcatttgttgactaaatagatgtataaataagtaggatatgtggggtgggagtgaggggttttccattaggatgcagatttaatttcataatcgcagttaatggagaaataagaacggagtaacagatgttgccttttcagcacactttgctcacatgtacccactgtattccatcgaacgccagatgccaatgatgctaagatgcactgttattttatgtatctcttagaaaaactgcttgcaatgaaaccatgacacgtaatggattgaaaggcatgtcctctttcagggatgtggcaatgcgaggaaatgtacatcttagtagttcatgccatgtggtggtcccgtttgtctgggatctctacagccacatgggcactggtggtgtcttcacatggccctgaaatgagcaagttgtggaaggcacggtcctgggtgggcttgaccatcctggcccagggaagtaagtgagagatcccgttaggtgcagccgtgtgggtcaagagccacctcagccaagtgtgttttatgaaatccttgtgccgtgaagatatgattcatacctgaaacttttttcttgaaaggacctgattccttcagcggaaggcaggtgattcattaggcctaaacacagccttacttttgaatttagatctacttgcattgtgctttccagtgtagcagggaagctcagaagaggccagtgggcttcccgagttctgtgcttcctggctgttcaagctattgtgtggactcagtgtctctgtagagtgtttgaaaagtgaactccctagggcgtctggaattggaaagtcagaggacaattactagctattaatatattactttttaattgtgtatcaaaacacccaagcactgagttaatatatcctgtgcaaatatactaaacctacttagtctatccaaatatgtaactggatacactacgtaggtttcttctactgaggaaatttgtctttcatatggtaactaggtatgaatatttgctgttgaagcaagcttttcccaatcttcaagttgaagttttaattagcaaacaatgtttacaacatgtaggccaagtattagaattttcttggggtcactcatgatttatctccatgctatatgtcccccaacaaatagtctccccaagactggaacacccaaggcccattggccatgtggcaggtgcagaaacggcctcagcatcctctgacatttcgctttgtgagcatatccctacaaactcagtcagccatgttttccttgagctaagccccacctgtgcggcggtaactggttatctaaggaaataagaacaagaaaaacagctgggtacagtggtacatgcctgtcccagctactcaggaggctgaggtgtaggaggatggcttgagcccaggagtttgaggctgcagtgagccgtgattgcaccactgcgctccagcctgggcaacagagcaggaccccttccccacctcaaaaaagaaagaaaaacaataatgagaaatcctggattctacatcatcagtgcatgtatatgtttcagaaaatatcatggaacggtttgctctgagacttcagacaaggccaagaacagtaagaatagaagtagttaaaacagaggggtgctagttgatatttttgagctgattccaagttcccagctatgatttttgtctcactgagttctccctgtgatgggcaggtcatttcccttttatacatttaggaaatgggtgcacagagaagctgattcattttcccaaggctgcattgctttacagagctgagatttgaatccaagtttgtccaccgggtgcctcgtagcctttggggcctaagccaggccttgaggggtggacagggtcaaactggtccttccgcagcactaggggcatcaggaatgaaggcctggagattacagttggtttgtctttcctggatgagacaggaaactggcttaattagagcaggagtttgtgtgagagggcaatgggaaatacaggcatgtaggtggggcgaatagaaatgggtacttcctgcttcggagggttgtttgcagctgaaacatacatgcttgaaactgtaaagtgcttccggatcaaagtgttagtgttatgaaggagacagaattgggaagggctgccaaagtcgcttggaaaagattaggcctggtctgtattcgttctgagcacagacctatgggtagaagttacagaaaagcagataggggttcggctgctctttctcatagagctgttggctctaacagtgacctgagctggattaaaacacagcacactccctggcagggctgctactggagtgatcccttcactagttggaagaggtcttcagtttttaaactttaatcaaatgaaagcacacaccagcaactcacttgaaaaacagataagatgagagatgccctgggtgaagcaggttatcaggcttattctgcctgcccgggatcctcccttcccatgtggtagctcagaacgggagctccgaacccagttggaagagcttgagggacagttttacggaatgagacacagttgaactccttgtagcacacttagagcaggcgggaattgatatgtaagggaggcctttctcaccgggatgggaaggagtgggaggcaggagagactgctgtggaaaggcagtagctggtgccactggcatggagggaggagacatttctccagaaagtggaagagggtacggaggatgcagataagagcggcctaaagaggaggccccggcgttttgcaccttcagaagcgagtgttgggaatgcaggtcgttttgtggagagggtgtttcgctttggacatgctgcctttgaagtgacagagagccctgaaggtaaatgccagctagaaagttggagggtacagcacttgagtgagtgcccaacgggcagatgtgtggtcatttacttgagaatggcgttggtagctttggaaactgatgccttctctaagagatgcagacaaaggcccgcagagaagatgcagagaaaagtgagctaagggaaaaagtcaagagggaagctgcagtgagagaagggaggaagagaatgacgatggcctcattccaagcaaggagcagaaggaaggtggttctgggaccgggcaggaggccccagcctgtcttacgagagcttctgttgtcagtggcattgcgcctctgtgctgggtgtgtgcactcgccaaggtccagttccctgacctgctagtgaagtccagctgtcagcctacacgttctgttagcagagacttagagatgtccttaaatttgatgtccttaaatctggcttcaaagagactggctttgcacagatgagttagagcattttggaaggtgggaggtgggctggaggcccattaaatgggacttcagggacaaggggcattagcacagggttgagacagcatgggctcggagcagaggggagtccctctgctgtcctctaactctggtctgtccccaagcccattcagcaagtgtagcttcaagaccagctaaaggtgtattattttacaggtctaaagaagtgtgctcctgcccctgaactctctcttgtgccagtttgcttttgcttaaaatcccttaaaccagagaccaaaccttggattctgtaattatagcaaaggttcttgagcgtcaatgtttggcggagttcatgcacccacgtagatcaatccttggattctacaattagagcaaagatttttgaacataaatgtttgctggagttcatgcaccgtggagaagtctggacccaagcagagtcttttttttttttttttttttttttaatctttggagcaaggggagaaaattaaaagccaagaaagctatgggttacttgatttacagaagagcctctatctaaagtgagaaagggagcagacagaggggatgtgaatcctgaccaggattaaccgggccaggttatggtgcagcaaagcaggagttgagccagggcaggagtggggcatcgggggtccaggagaggcttcgggcgaagagtgttcagggcctgcaggatctctgtgtttattttacatagagaactccacaccccttttcttcatttgagatccttggatttttaatataccttagatttagatattcctacttctaatcatttcaaaaattgtgacccagtttagtgaagatccttctctcctgggcctgttctgcaccctggatggaggtgtttcgggaggtgctggctccgttttactgtgccattgactgtactgtctgtccagagtgacggtgtcagtgagatgattggcactgatggctctgaaatgacagggtttcttttgaagtggggtgaggggagtaacacagtgtttggaatagtctctcctagcctccatcggtggaatatatgatgccattatagaagtggtcagtgcaggatacagggtaagaatggagagagtagaaggctgggcatggtggctcatgcctgtaatcccagcactttgggaggccgaggtgggcagatcacctgaggtcaggggttcgagaccagcctggccaacatggtgaaaccccatctctactaaaaatacaaaaaattagcccggcatggtggcaggcacctgtaatcccagctacttgggaggctgaggcaggagaatctcttgaacccgggaggtggaggttgcagtgagccaagatcacgccattgcactctagcctgggtgatagtgtgacaccccatgtcaaaaaaaaaaaaaaaagtgtggagagagagtagaacagtgttcaaaagagtgtctcagtctccgctggaattagggcaggatacaagggcttcttaagacagaaagctcctggaattgaaccatatttcgtgaccaaagacagagttcagttccggtgtctctgcaggctaaaagtagcgtgatcttggaaaattaatttagtctctgagtcatcgttttctcaagtgataaaagtatcacttgtcactaattaaactgtagatcatgtgtaacacttagaggtcttcaatggagaaatcagaattaatttagctttttaaatatatgcaagcctgactgcctcattacttttataagaaacctagaaacagaatgactaaaaaaataaggtcagacagcaaaggaagcccatacaaatgagcagttctcttgtaacttcttcagaggcctgtgcttagttctttttgagggagttgaagagatggaggtggactagtgaaaggtggggcatgactcggggtggggaaactgaccaggggtcattgaggacgccattgagaaaggaggctgctgttggagaggtggagaattgcagcagtgtcagacagttcaggccgccatggagggacagcatggtccatcagaggtcagcatatggggctgggggaagggatttgagaaaaggccattggatttgggagagcacagttttgttggtgacctttggtaatggtgagtgcttatttactagtaagtgccatgtacgtagttagctcatttaatcttcaccttatccctatgacgtgggtcctattattgtcctcagtttacaactgtccgcagtgccctagggtggcttacagaggttaaataaggagctgcagccagtgaggagtggaggtgccaggctttgctccaggcccttctgattccaaagcccgagctctcaagacccttctgggagcttgattctgcaggtggagaggaagcgagaccacaggaactaatgggggcccaggtggagaggcgaagtccggaaaggcagacagcgggtcggaagtttggttgtgaaggaagggaaaacctgctgactcacccaggtcacaggcaagtgggttttttttgttttttgttttttgttttcagaaggggcagactttttttttttttgtctttaagaatcaggctctcgctctgtcacccaggctggagtgcagtgacatgatcatagctcattgcatccttgaactcccgggctcaggagagcctcccaacaccgcagcctcccaagtatccaggacaagaggcgtgcaccaccacacccggctaatgctttcattttttgtagagacagggtcttgctatgttgcccaggctggtctcgaactcctgggctgaaacgatcctgcagcctcagcctcccaaagtgctgagattccagggtgagccaccgtgcttggcccaagaaaaggcagacttcttatttagaacttgtaagagagaagagtgcaagatgctgggggagaaaggagtaaaaatcgtgcctggtagggatggatattctgggcctgcccttacgctggaccttcgggacatctggtaaaccaggcagtgtatggtttgtttaaaaaccgagctatacagtggagtgatgcctttgaagtcatgttattaaggtgggagtttgccaggtgggattatgaaggaggaggttatttcccctccttccgttagtgactttttgaggattttggggggattgattccaagtagtgtataaataagctgatgagaacacccaccatgtttcagagccgaccactgttgacttttccaagcacagtcacgtctacttgcatgatcctctgcttccagtcctgtgttccttctgctctctaccctcttccgctttggattccttgggtgttgtcctgtgtggcttttgtctgacttgattgctatcgtagcagcagatgcaaacttaccttgagagctgaacgtccacaggcacctcagggctggcttttgcagagctgtttagtacaagggagtggagggttctggtgcacttgaaaaaaaagcacacatttagagctccaataagggaaaggaatttgttctcattatttcattagtgtgcacgtgcagaattcttgggctggatgagatattcagccacctgaagggcatttatgtaaagcccatggtgtggggttgcccggctggactcaggccagggtgatcagccagccatccaatgcagggcctcaggtggccagaggccatggcaaaacttatctgcagagaattcatctacaatgtcctctgggctcctgttcttgggccagtcactgaggcagagcttttcctaagaaataattatgaaagaggtagcatgattcctccctggtgaaagccaggcattgattcttttgagcaccccctcagaggaggagagtgtagaatccacgcagtgcagcattttacagagacaatgatgcagctctgcgtagccccaaagctattgtctgcaggtggaagcatttcctaaaggcaagccagatgggccggtaccgtttccttgaaggaaaatggaaggagctgaatacccagcagtgcaccctgggcagaaatgtgctttaaaacaggccagtttaaagaagcaggggatgaatgtattcggcagctgaacatgaatgaccctagcattaaagaaagtaggcagagggtagaatttcagctaagagaagggaggggaaaggaagtgttctcaattcttttttcttttcttcttcctagcaagaaccagttgagtcatctctggggcttagtaatggagtaagtgatctttctcctgagtatgcggtcctgacttcaactataaaaaatgaagtggatagtacggtgaacatcataggtaaactgttttgacgtctcattttttatacataccagcagccccctggggcctaaaatttgtaaaacagagaacttcaaataacatagtcagtgggaggaggtcttggaatcatctcagaatgcaagttccagcccccagatttcaaggctgagaaacgaaggcttttgaggatcagataaaggaacttagacgggtcagcctccgtggaagaaggctggggtgacctcccaggaaaaatgtttgtttcccggcggcttgtggctagcgatcccagtctttcactatttggttcacgtgggcaaaagagtatttatttaactcgggaaccaaggagagggaagatggtcctcgcgagtcctctcagcaactgcttcctggcagacagagaaactgaggcacagagacatgttgccaaagggcccactctgattcagcagatatttttgagcaccttctgtatatcagactcagtactaggagcaggaaatagacggaggaggcccaatttcttttctcatggagggacagagatagtaaacaaagacacccccagataactgcagtgttaccatgtgtggtaaatactgcaaaagaaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaagaaaaaactcctttttatttttactttctttcagcattgaatttttgttgtgtgtatggtgacttctgtttttgggaaacggaagaagccagcagcatgctgaattgtcctgacaggcctccgctggcctcttgccgaggttagcagtgctttttttgtatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatgggctcctgaaggcacaggagagcagattcacagcttactgaccagtgttagggtccccacgagggccacccatttgaactcaaggttggcagactctggccccagcacttgccgtggtttcaggatggccagcggtgacacagggctatggaaccctgggtcttcatctcttcccatatcctttgtttcaccttctttttgccatattttattgtgcttcagatagaaattttatttataagataaaaagtagctctgaggctgggcacggtggctcatgcctgtaatcccagcactttgggaggccgaggtgggtggttcacgagctcagcagatcaagaccatcctggccaatatggtgaaaccctgtctctactaaaaatacaaaaattagctgggcgtggtggcaggtgcctgtagtcccagctactcaggaggctgaggcaggagaatcgattgaacccaggaggcggaggttgcagtgagcctagatggcaccactgcgctccagcctgggtgacagagggagactgcctcaaaaaaaaaaaaaaaaagataaaaagtagctctgggtgagtctttagatggaaggcaccacctcttaggagatcacccatgctgtcagctgtgcccatgccttcttcctggaagctgagttgttcaccccttaggagaaggggcctgagacaaggcattcgattttatccacacccctagaatgctcttagcaagatgaaactccatatgagatgtgaacccttacatcgcaatatgcccagacacagaacccacaacaacatactttattcttggctgtattggacctggagcacctgggcactgaggtgagactgtggggccactcctcagtcaccaggtgccaaccgagagacctgggcagtggagttgggctgctgtgttttcagccttaagaagtttttatttactcaagaaagctgtcatctttttgtgaggctatatattattttctccttccctctctccctggctgccgctgcctcgtttataattagctgtcagctcctcctatcttccctcaccgtacttctcaagtccatccccttgtttctgacactgtgtgtgggcctgccttggctgtcacctgggctctgcttccattctgctccccatttcttcttctcacaaaataaagaatgccagtgtcatcatgtcaccactgcccctaagagaaggagctgagttcccccaggtccccggggtctggcatgatctaggccctgcccactgctttcatacctgtctttgaacttgaattactctgaacgagttaagctccctgtggctgctcatagagacagtgaggttggtggtgggtctccttatggtggagcagctgcaaaggctttgtccacagggcacagtgaggggtggacacgtggcagttccagcaggaggtatagctccagcccaacacgtctcatccacacttccgctcccagatcattgacccttgagacactggttacctctactgagttttgttttgttttgttttgtttttgagaccgagtttcactctgttgcccaggctggagtgcagtggcacaatctcggctcactgcaacctccgcctcctgggttcaagcgattctcctgcctcagcctcccaagtagctgggattacagggatgcgccaccatgcctgggtaattttttttgtatttagtagagatggagtttcaccatgttggtcaggctggtcttgaactgctgacctcaaatgatccacctacctcggtctcccaaagtgctgggattacaggtgtgagccaccgcgcctggcctctactgagtttttactgggatacatcctgtgcttcccttcgtgtagtagcctgagatgctgttttctcacggggtgcaaggtgcacgctgccctgtcccactcttgcctcctcctgcactctgtcaccctggtgaggtgtatgcagcctgtagtcagggacagcctggcccaggcacctacagatccctgtctcggagtcaccggccccgcggtgaccttctctcccaccatggctctcgagtgcctaaaccaaatcatggctgtattttataccgaaagagcacgagattagaagtcaaaaggcgtgggttctagacctgcttctgaagttttttatttaccatgtgattttgggcaaactccttaatcttttgaaattcaatttctatatagattggaaacaatatataattatttataaaatggaaatatttaaaattatatagaaaatggaaataatcgtactgatcctgcccatctcgcagagttattgtgaggatgaagtgaaatgtacagataaatcactctggggctagaagggggtaaaatgatatgattatcatattaccaaaatcatattaaaatatatttgattaagaaaagtagcctccatctgtgccatgtcatcaaggctggtgtgaagtttaactcctgaaactttcagaggggtcaggggaaatttccctgcatgatgctctgctgatggcctgattttttatgcctgctagtaagtttcattcttgactctgcagctacatgggtgaccttagcaatttacctgagctctgggtttcagcttttttcaactgtaaaatggtaggaccaaaccacctccaaggacccctctgtttctaataatctgcttttaagcactttctctgaggcatgggagcaagttgctttctcaggtggagacctacattaagtcaacaattgctaataaagtgagaatgaccttttaaagaagcaaaccggttcatcagtaaccagccataaataatattgttataattctcagcaactagattcagataaaattgcattcctgtgggtgactcttttcagatgtgctgactttaataaactggagaaacttagtggatttctagttcttctgtttgagaatttccctggcacacaatagataactgttgaaaagaaatgtcactattagttctgagcctggagactcactaaggtgagattcaaaagtttttatcctgagaggggctaagaaagccctcagtaactcagtttggacttcattaactctctctgttagggagagcatattataaagagttgaaatttggagttgggtaaggctaacattgaatcccggttctgctgctgattgtctgtctgaccttgaattagtcatgtagttctgtcttgtatggttgtttcagcatgtctagaatggggatcactattgtgccttcctcatgggttgtgaggtcttgggaggtggtagggagaggcaaagatcagtgctcagaaagtcaggttttgtcattattcagtcaggacactctttggtacccagaggagtgccacttctgactgtttactgtagcaggtaagtttgttattcctgtcttttcacctgtcaggagtcagtgttgctgtctgttttgccgcttggtggtccagggaaatcagttcacatgtcgagagagagagagagaaacagatagagactggttagtgagagtgttgatgctcatctgagagcatttcgatattgggatttccctgcttctctcatgggctttcactcgagagctggaaagtttctaaagtacccacgatgtctggatggagagaagccattgtcccttaccagggcataaagcaacacactcctatgggggaatttggcctgagagataacgtaattatattaacttggtatccagatcatagcccagaaaacagactgacttttctctcctggtcagccgcattcaggatacacctaaaatctgcatggacgtgcttatctacttttttccccaagtcatgtatattaagtgaaatacggtaaaattcaccccttttaaggcacacggtcctataaatgttgacagacgcactcagtgatgtaactaccaccatagtcaagacagaacattttcatcaccccaacacgtttcctccctggccccagccctcgcacccacagccggctgtctttatcacttcccaaaggtttcaagagtccacttgtcagaagtcttgacatttttctagaaaacattaattgtcacgtcccgtatttgcagattgtcacaatcccctgcaggactccactctggctccagtcagtgagcctcggccccatcacatgtccatttattcaggggagagtccctgagcgcctctccggtgggagttgtgagcatgtgtcatgactggacacaaaaagttcatactttggttgaggagagatgccattgaccaactcaaagctccatacgggtatatagcgttaaccagcaacttgaggtcagaagtgtcacaaggtcgcggcccatcgtagtttcggccgagtgacggggacagtgagtgagaggcacccaggggagagaggccagtctgtgctggcgggtcaggaaggggctccagaagtcaggggcatggtgaatgctgcctgttgctcaacccccactcctgtgccactacctcattgaagcctttgattcctcaaactggaaaaaacaccccacttctctagcttccattgtatggcccccttctttttcttttctttcttttcagtgctcacggccttaaactgactctctagatggttagtcgctggcctatagccatgtatatgaacttcttacaaaccggatccttgactgcatcgatcttccgctgctccttctagccctgggaggctgggaggtgcaagcaggtgttccataaatctctgttagttgaataaccgactaggacgtcatggggagaagcagtgagagaaagaattcctggttggaacaaagggatctgactagggggatacttgagctgctgccattgtttgtagtcccagctggcttgccctctttctgttaggagcaacgtgcaaaggagagatgagttttgaaatattggaagttaaaatggcttcgacttaagtcacatttatctaagaccttcactgccttagtatgcaaggtatcgctgcgccctccctcctcaaactctcacaccccatttggtttctacctccacccaccagctgcttcttaggacttaggatagggcaggccattatcttgttttcctgccattttattttacttggctggaagaggcagaggaaactagagagaggttggtgtaggtcagcgtcagtctgtgtctagtgacctgcataattgatgtcctcaccctcacgtaggataatccaaaggatgaaataaatgggcttgggagtctgcctgccatatatagcctgcctgccttttctttaattttatccccaccaggaaaacctaaacaggatccggtttcccttccattctgtatgctgtggcttttggactcttgtatcacagccccaaatcccctttctgagcctcttttgtgcctttcctttctttattaaagaacctatgaattgccactgccctctaaaaccttccctgcgtagaaatcagataatgtgcttgtcactccacagacagcaattaaaacaggaacctgtttataaacaaaaatacttcagaaaataaaatacttggagtgattaaaacgagcctctccatgacgcctggcgtctcaaggagactggaatgcgttctaacctgaatactttgccgattggtgagaaaatgactgcaacatagagcaccacatatactccaagctgtgcgagtctggacaagtcactctccctctctgtgcctgagtttcttcatctataacaggataacgatgctttctctgtcatccttatgggttaaaatgttaaaataacagatacaggtatgagtaaaacgttgatgatggtggcaaagtgctttgaggaccttgggaattatttcttcacctttatttattgaagctaattttcagggacatttcatccaactaacagtggtatgaggtcagtttcattcaaaatgagggcaggaccttagggaccttcaaattaaaatggccatgaaacatcatgacttacctatgagaatggccaaaataaataaacagtgatgacacgaaatgctgccgaggctgtggagaaatttgatcactcagacactgctggtgggaatgtaaaatggcacggtcactccgggaagcagtttggcaattttcttgtaaaattaaacatgaaattaccatatgactcagcaattgcattcttgggcatttatcccagagaaatggaaacttatattcatacaaaacctgaacacaaacatccatagcagcattatttgtaatagtcaaaggcttgtagcaactcagacatccttcagaggggagaataaacacactggtacacctataccgtggaatactactcggcaattgaaaaggaaccgatgactgatacacacaacaacttgggtgactctgcggtgaattatgctgagtaaaaaaaaagccagccccaaaagtctactgtatgagtccattaatataacatccttgaaatgaacaaattaatgaaatggggaacagattaatagttgcccaggggtcatggacaaagagatggatggggaggtactgaaggaaggtggctatggttacaaagagtaacgtgagagagattggtcgtgatggaactgtttggtgttttgacagtggtggtaggtacatgaacctttatgtgtgataaaattgcacttagtcctggtgcaggtacacactcacacaaaagagtgcaagtaaaactgaggaaatcggaacaagatgggtggattgttatttatgtcaatactctggttgcgatattgtattctagctttgtagcctataaccattggaagaagttgagtaaaaggcacacaggatctctctgtattatttcttacaactgtatgtgagtttacaatgatctcaaaataaacaatataagaaaaatatttgaggcagttttcagagccagggtggtcagaatccatcttatcagtgttccggggagctgatgctactaatgtttgccagaattggagatctgactctattccattgtgctgatatttcagccagttggacatgttgcctgtagagcaggaagagagctgggagcgtaagcagagcgccacccagctagatggggaccttgggcatttatcccagagaaatggaaacttatgttcatacaaaacctgaacacaaacattcacacagctagatgtgacacaattgggtagattttcatggcccttcctctttagtaaggtttgataatgtctccctggattgtagaacccagaaaataagcacagcgccttcttttggagcaagagcagggagcagaaatcggtcaggttcaaagtactgtcatgtctggccctggggctggggctggatgccgcctctggtcctgtggcctcggctgtgacggggttgactgtggaattctgctgagctggaaaggacatggccaccgtgcgtgccattggcaggcatgctggagatagacctggggagccaagtgctggccggctgctccctgggagacatcacaccagagctacagagctcaggcgtgttcttcagccccatggcaggggacagatggtgatgggagcctggcgacctggctcttttggggaagactctttcttgagaaagtgtgctagaattgtgaggtcagcagactttgcatgatggctgtcttttctttgaagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcaggtaagcgtcagcgggaggctccgggaggcgtgggaaccggccgcgcagtcctttggtctagggtcacccatctcaccaccccacggagcatccctcctctgtcctaggagttattctccctggagtttttcatactttaattatcttgatcaacatcttcttggacacttttgttctcaggtagaggacaggatcacagcatttctttactcagttggccatgacattttttatttatttatttatttattttttttttgagacagagtctcgctctgtctcccaggctggagtgcagtgggatgatctcggctcactgtaacctccgcctcccaggttcaagagattcttctgcctcagcctcctgagtagctgggattacaggcgcacaccaccatgccagctaatttttgtatttttagtagagacggggattcaccatgttggccaggctggtctcgagctcctgacgtcaggtgatccgcccaccttggcctcccaaagtgctggaattacaggtgtgacccacagtgcctggcctcccataacatttttatatatggttacagataagatttctttagggcagtagttcatcagagtctaatttattagcccaagttattagaaatttggcagagtgttttaatggattctcagtttgagcaggctggataggaccttagagatgatctcttcctgttccttcatttctgaaagggaaggggcttgcgcagggtcgtacagtcagcaagtgtttgggccaggacttgacctcagccttcagaccccaagctcattgctagatccattccatccaccaagcgtacttgtcctttccacatattttctctttctttttatatctagtacaggttctaattaggccagatgactgagccatttccaattctccagggacttggctacataatgacaggagttggcccaggcagagtcacagggggaggaacagatccagttggttcttccattcttccagagtaaaaggatggctcctctcgttcgccaacattacttcatcttctcctctcttcctgatgatctccattgaattttgtggaaatcaattgtaattaggaaatataaattctgagtcagtgttactgcttgcagatattaaaaataaaaagcagagtccccatcctgggaaactgcagttcagctctagcaaatagttcagggattcttccctgtgctctttacacgctgccaaatgggatgtcctccagtaggtgccacccccaacactggctccgaccagcgttggaattagagttgactcaaaggactgttgtttgtgaattatcagccactaagtctaatctcattttccctgaatgccaactttcttttttttttcacttttaaaaattgtggtaaaatacattaacataaaatttaccattttagccatttttaggtgcacagtttagtagcattcagtgcattaatgttgtcgcagccatcaccagcatccacctccagaacgtttttcatcttgcgaaactgaaactctgtctgcattaaacactaagtcctcttttccctcctccaccccagcccctggcaacctcctgcctattttctatctcagtgaatttggctattctaggtacctcctatgagtggaatcatagtgcttgttgttttgtgactggcttatttcacttagcataggtcctagtgtgcatttatgctaggagcgtaagtggaatgtgagaatagaccttggccacaggaagattataatctgtcaaacaggataagcttgtcatcggtgctttattcagcaaatgcgttttggactcttacacgtgccagtccctgtttggtccttgccagagtgcagtcacaagaactactatgttttgcaaatttattgtgccctgggaaccatgctcagtgcttgggtacagttgactgttgttgttgttgtttgttgttgttgttaatagaaatagggttctgccttgctgcccaggttggtctagaactcctgggctcaagtgatctgctcgcctcagcctcccaaagtgctgggattacgggcatgagctgccatgcctggtatgatacagttgacttgtttaattataattagagtaaccctgtcagcctgggtatcgtcatcatcccgtttttaaaagtgaggaatctggctgggtgtggtggctcacgtctgtaatccctgcactggaaggctgaagtgggaggatcacttgagcccggaaattggagaccagcctgggcaacatagtgagaccacacttctacaaaaaataaaaaaagttaaccgggtgtggtggcatgtgcccgtagtcccagccacttggaaggctgaggcaggagcatccccttgagcccaggagttcaaggcttcattgagccctggttgcaccattgcactccagcctgggtgacagagcgagatcctgtcttaaaaaaaaaaaaaaagaaaaaaaaatatatatatatggatctgcggctggcgtgggtagagcagcgtgtctgagggaggaacgattgggagcacagctagaacccatgagccgttgatgccaaaggccggtccttaacgcccgccctgtgtcgctgccctggacagcgcacgggctctgccgttcagaacacagccacatcccgtgatctcatttgattttcacaaggacccaccaaaggaggcagagcagaatgtttatgcctaaattttacagtagagctaaccgaagcgtgaaacactcagccactttgcttatatttacatagttatggctaaaaacccatgactttcttctatagcctgctgctgcaggcatcgttacactccatgtggttttctttctctcttctttttttagggggttggagctttagaatagacttctatgtttatctgttgagtaagacttttctgaggtcttcttggggattctggaaagacctcttcttgctgttctgccagcagtggcatttgctcaagcaaaagattccggagaacagcagatccatgcagagagaaatgaacatttcattactctcttcaggacatttgcataggtttgaaaggaaggatttcagtgccaggatggcagtcaacaggaggttttgctggagcctggcttttcagcctggcctttggttctttccgttgttttcattgtctggattctccagaacctcgtggagggaggcttactggttggaggcaaaatgttccatcgctgctgatgttctagagctcacagtgatgtaaaacatttccctgctactgactgtagctaattttagttcctccgtcagaaattgtataacatgctgtcaggaaaggcagctttctgcgtgtattcacctttcttgctttatgttctccagtagagtcggccatttgcctgtttttcatgatggagttcctttgtttgggctgttcatctgaatttcaatctcctctgaccacctttttttttttttttttttttttgagacggagtctcgctctgtcgcccaggctggagtgcagtggtgcgatctcggctcactgcaagctccacctcccgggttcacgccattctcctgcctcagcctcccgagtagctgggactacaggcacccacaaccaagcccggctaattttttttgtatttttagtagagacggggtttcaccgtgttagccaggatggtctcgatctcctgacctcgtgatccacccgcttcggcctcccaaagtgctgggattccaggcgtgagccaccgcgcccggcatgctctgaccacctttattcatctgtttgggaaactggtatttggaggctgctgtttgctagtttttccccctactgatcgttgaatcataatcccagtagtatattacaaaaccacattcagttttgcaagtctgtcttctcctctgtggtctaaatattatgatgagaaagagaagagatagtacttgcgttggatgttttaagacaacataaaattctagtgtgatttgtgaaactttcatactagggagggacatttcaaagtgccactttgggaagctctggcggagagacatgtcatgtttaaaggtgcattacaaagtgaccccttgcctgatctgtggcatcagaattttattaggtggttgatggtttagtagaagaaaaccacagtagaataatggggtgggggaggatgggtaagaggggctggagagtagactcgagaagaaaacatcatctgaaggactcactggctataatgagagagtggagatcgcctgctgaccagcagccatcagtaaaggctttgaatccttcgggaaaccacaccaggcttgcattttgttgggcagagcaaagacacaatcgctttgagattaagaggattccgatttgaaaataatttactcctggtgaaagtaattgagaatatgatcaatagaaagaaattcaaatcaaacttgctgaacaagagccttccagaaagtgtagcagaatgtcagagtgcaaaaagcctttcaggtgaaaatgcatcctctcccttcccgcagtgttcctgcttagacaatatgtatatcctcagcgaggcgttaaaaactggactggatagagagtgaacctacaaccagtgtcaccctagaactggaagagcttttgagatcatctaatccaaatcctccccttccctcccaccctagatgctttcaggaaaactgagaccagaaaggttaagtgaattactcatgtgcctgttggtactgtacgaacaccttcagcttcttcatttgtttggagttgctggagaagcaactccagacttctttattccattgtattcgaagtaagtaataaacaaaaagcaaaaacaaattcaaactaatcaaaagggaaaatgaaatgacaacgtatgttgatagttcgatagtaacactgatctggaggcccagctgcagtcagctcccttgtgtaagaagtcagcgtggaagtggcaatggtggtcaaaccaaggaaacagaggacacggggcgcagtgcatccaacaaagcacttggagccaccgattctggggtcacagagagaactgctcccctcagggggaggttcagggttctctgctcctaagctaaggtactgaaggcccctttttgaaactgtcagtgtcctaatagggcgcatcttcctgacgacttcagatgctgtggaacttaatctagacacgacgctctttaactcgcatttgtgtcagctgaaaacataagttcggagcatgtgtatcttttcttatctgcagctatttccccgaagctgaaaactgggtacttaaaggaagttagcatcccggtcacattcatgggcggtgcaaggtcttacccgggagccttaccccaggatctgacttccagcccctcctgcacctgcgactggggctgtgctggaatcccagcccccaaagcatgcttggttgcgtatctttgtttgtatttggaggggaaaggaaaagaagacagtgatatttatggagagtcattaggagtgaagagcatctgaacccgtatgaaaggaagagaaagcttggctttggagcacaaagaaagctaagcataaaatggaaagcggatcttgaaatgttgtcagagaccagaacaccagggaagcagggctgctgtgtgcagtgcacaggccctggaatcagaagtacagttttgttttctctcctctgtgctgtctcagttggcaactttggcaagtttctcaacatctctgttcctcatttttcttcttgggagtggctgttccgattcctgcctcctcaggatactgagccagcacgagggttctctgaggaggggaattttctttttctgttggttttcatgtgtttctgcgtggaaacaattcttgtgctcggcaacgtcagctcatcttcatagctgggatcgtcgtcagctgaggctgagggcttctctgggtctctgtggctcccagcacggggtgttttggggaaacatgcccagtccgaggagtggagagatctgtcttctgcatgctcatggccagcccaccgcgatcactcaggtttgtgtgaagttactggagaacagtggctgagaaacaggcccagagactccaggctgggaccagtggagtccacattcttactttccttgtttaaggaatgcacctgtggcacagtttgtccatttgttcttttgcctttaattgatagagagcctggtctggggctaatgctctcagtggaagaaagggctctgtctgggctggagccatctcatcccagctctgccaccaggaagatgtgagacagaggccagcccctcagcagggaccgggtggaaagctggaaggcactggagcataagagctcttctgcgtaacgggggatgagagcagctgcttgctgacgtgggacccctgtgagacctgcatgcaaagcctctgacatggcactgacccatagggctccctaaatgtttgcttcttttagaacacgagcttcacttttggattttcttgtgttgtgaaatatacgtcacctaaaatttaccatacttttgggtatggggttattaaattcagcattggaactaaataggaggaaaggcagttaaaggttgccatcaggaagagaagctattgcagttactctttaggccttgtctgtaaaacgaatggctcaggctaagtgatctctaaatgcctaaatattgcacaggctctgccctctgtgattgcatttctcaatggttatggacactggaataatcgcacaccattgatattttattttacaaaatcaaaatgtttttacgtttaaaaagctttttataagcataggtcatgtgtaatcactagacttcgattccattaatccagcctgttgtgcaaacccagtgttaagcagtgctgatgtatggagtgtgtgctgtgtgccaggcccttgctaggcctttcccatgtaccctctcactcactctccatgtaatcctcttagatggtggcagtgccctcattttacagaggagaaaactgcagctcagtaaaggtgagaaacttgcccagtgtctcacagctggcaggccaaatggggatggcaactgattggctgccatagccatgcagccacaaacttagtggcttgaagcgacacacatttggatcttacagtttctttgagtcaggaatccaggcgtggcttagctgggtcctctgctgcagagtcttgcaaacctgccatggaggtgttggctacagctgctgtctcatctgaggctcaactggggaagggtccatttccaagctcatgtggttttggcaaaattaagtttcttgcaggttgttggactaagggcctcagtctcttgctggctgttggctggaagcagtccttagttctttgccataggagccttcccaacatggttgcttgctttatcaaggccagcaaggcagagtgtttcctctcccagcaggtttctgagttatgtaacatgatcatggacacaggatcacatccatttcatcccctttgctgtatcttatttgttagaagcagacacattccatccacactcaagggaggcaatcccaaagaaagtgaatccaaggaggtgaggatcatggggagcaccccagatctgtccacctacagtaacccacatggcagatgcaactctagaaatccaggatctaagtcctaaaggggtgagaggtaaaggaaggatctgagtgggatggggataatgtaggaagaccttttggaaacggtcaactctgcactgggaattaaatgaattggttggcatggattgaaagacaggacccatgtgggcattgtggacagagctgcagtgaggagggccccagggaccagcgccccttcctgggaggtagtgcccagtgtatacacagcccggccctggccaagggagcctcctcacagctctcaagcctggtttctccgaagattacagagttgaaattcactctagcttctcccatgtagaatgtttcgctttacaaagggagggaggtgatgcgtttagttactcagtctcctttttataaacactgcctgagcctggggacagcttgagggacaggaatgatggccctgtgtttttctctctgtgaacagaaagcgaaacgactgatagtgtgcccagcgatgaagagagtgccgaggtaagccactgcccagcctgcccacgatgctgccaaggaaaagcctcccgaccagctccgggctttccttgctgctggttatgcacctttcctttagatcacaagcttcactttgggattttcttgtgtggtgaaatatgcatcaccagaatttaccatacttttgggtttggggttataaaattcggcgttggaactgaaaggaggaaagggagttaaatgttaccatcaggtagagaagctgtgatagcaggaaaagggaattgaagtggaggctgggaaatgctgatgctcttaccacttaaacatcctacttcaccggcaaaaatagagcagccttcccagccagaagcagtgaccagtacacgtcacaaaatgctaagcaaaagcctcttccacgtgtgcgtgggttccctcccgctgtgacccgtgcccagagctggttgtgtgccccatctcgattccgagtgggtcccgtcccctctccctcccatagatggggcgtgcacaatggcagaaagtggctggaatggagatggaaagcattcctgctggccacctgctgggggtctgcgcttgagtgaatgagagagagagagggagggagcaagagagagggaagctcatggttgtttgaattagtggtttcccatgtactaaacactttgagaaaaagtgcagggattctgaaaagacagatgtacacgctcccatacaccctggcctgatttcttcaaggttgcagctctagccacttctctgaatgaagccagccctgaggccgctgcttgctgtacaccgtggagctctaagccgcccccatttgaaagcaatcaaggggcattcattgcctgtcactaagttcctcgctgccttttctctgaaaatgcaggttggctcaggttgactgggccagcattgagggaccgagtcgctgtgccacactggccatggtgacctgaaacctatcgaataatcgggccgagccgcagagcacaagggaaccagaaaccaagctgctgccttcttttcctgccttcacagagtagtctggaaagtatttctgggaggtagcaaatgggaattgattttttaaaaaaaaagaaaagggaagaaaaaccattacttggcatatgaatagctgggtgcaatagatttcagttgagggatgtagaggtgctaagcctttgttcattctgcagttcttaagaaactcagctaaagcaccaacacatgggaacgacacatttttcattttaaaattttttttgtgggttgttgttttgagacaaggtctcattctgttgccctggctggagtgcagtggcgcaatcatagctgactgaggccttgacttactgcgctccagtgatcctcccgcctcagcctcccgagttgctggggctaaaggtgtgcaccaccatgcctagctaattcttacgttttgtagagatgaggactcgctacattgcccaggctggtctcaaactcctgaggttaagtgatcctccagcctcagcctcccaaagtgctgggattacaggcatgagccaccacacctggccagtgatgcatttttaaaaagccatccaatagaaggagaaggaaatacatatcttaattactttcttgaaagggacggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacattttttttttttaattttgtaaaggtgaaaaaagcttttatgagctcatgtagcaatcagattttcctgtggattgataataaatgaatatgatatatagttaaatttttaaggggcatcactcctggctttgtctgtgtctgctttaaaagagcataatcacggaataggactgacaaaggattgtttctttttggggaccaaaatgttttcccttgttgaccacaagaaaccgtggaggttcttactgtgaggcttcagttgacttcttctcttgagtgctcgcctgagcaggggcccgtgctgagcgttttgcatgacttcccgtcttcattcatcacacttgtgctgtagaataggcattcatctccatttcatgtggaggaaatgaagactgaatgtgaagatgcctttacttggctcatagtggcactaagaggcaagggcacaagttgggcacaagttgagcccaattctctgtgctatgaagggggtcttttttcttgtaagcatatccgttatctcaaatgtctgtcttcctctgtgttgggagcattccctgtggagggggagtattttagccacgccactggtttccttctctgctgtgagcaaggttcaccccactctgtgtctttcctgttttcatccttaggcttacacgtacgacaaacgtcttgtgtttatgtcacttagaggggtgcatggataagacattttccacaacaggaaatatgtattgggctctaacaccatgtccgtcactcgtctttctaggacccgaggccttacacatagaccgtgccctcaaaacttggggtctgtcttgtggaataaaaggggtgacttcaagaacaccagtctttatcagccacttggtgtttgaaggtatagtcttggcctggagaaagccacagcaccagcctcccctgcatccccagtatcttactctgtaaaatcagaatatgaaaactttgctacccgcctactacctctggggggttgtggaggagattgctaagttaatatttgaagaggttcctttaatgaaaggacaaaaggctatttttatgcctatctccatgtgtggctgcagatataattagcggtcataaagttatccagccctgaatggaaatcaactggagcattttcctggcggatgcgttgtagttgaaatgccacacacagaggcggggctgcttctggaaggagcaccttcgttgactgtctcagtttctcagtggaaggggagttatcaggaagaaacagatgctccctggctccttggcacccgacttttcagttaagacctgctcttcccccaggtcctgaatggagaagttcagttctttgagacttacatctaaaatgttttactgagtcatcctattttaaataaattaacaaaacagcaacggaaggttgccctgagtcacgtggcctggttatcaaagggtttaaggtagctcaggtctcctcccccttccttcttcccaacacagactcagggcttcttcctgcatctcggtcccgaatgccattcctgctgccctccccttgcttctgtagcgtaactagacttcccaaggcccatcaagtggaagaaaattcaggacttggaaatgcaccatttaagttccagagatgatactccattgccaataaggccatgaaaaacagaatcatgtttaaaatccttctgagaaagcctgtattgtttctaagtgatacttgccagcaacgcaggaaaacaagctagtctcaggatgcctggggttgacatggggaaggaaaacaaaggcattggggcagctcctggacccaagcctcagaccttgtcgtcacttagaggaagtgccagggacgcatgcttctggttggtatttgtgtgagctgataggctttgatgatgggcttgggtgtgtgtgtgcacgtatgcgtttaatagcaagttcaagttcagtgtaactgcctttggaacaatagtttccattctctgcagccagtacctgggtcactcccttgataatgggctcactgtacagctgtgaactgtgaattcagggacat

SEQ ID NO: 17231 - DNA, 187136 bp, Human
  misc_feature (1)...(187136): n = A,T,C or G
aataaatccacaaatcaaggaagaaatgctttgcaatattctgtgtcctgattttgggtttgtgggatggattacagtgagtgtggagcaatgcacagaaaagacagcatagaacctggatctctgcgtccgcgcagacattcaagggccacgtgtcagtgaaatgtattcggcttgattccctgtgttgcttttctgaattctcaacctctgaaagataaatatttcttttaatgtaatggctttcttgagatataacttgcataccacgtaattcactttaagtatataattcagtggtttctttttgtatattcacagagtagcacaactattatcacaattttaggaacatttcatcacccccaaaaagaacaccacacgcattagcagacactcctcatttctcccaaccctaggcaaccacaaatctttctgcctctgtggattcagctattctggacatttcatatgcatggaactgtccaatatgtatttttttgtgtatgtctggctttattttacttagcctaatggtgtgtttgttttttcagatggagtctcgctctgtcacccaggctggagtgcaatgacactgtctcagctcactgcaacctccacttcccgggttcaagtgattctcctacctcagcctcccgagtagctgggattacagacgtcatgccaccacacctggctaatttttgtgtttttattagagacagggtttcaccatattggccaggctggtctcgaactcctgacctcaagtgatctgcccgcctcagccttccaaagtgttgggattacaggcatgagccatgcgtccagccacacttagcataatgtttttaggttcattcctattgtagcatgtatcagtacctgttattttttattgttgagtaatattccattgtatgggtaaaccacatttttttatctatcaatcaatctatggacatttgggtttctttttggaaattatgaataatgctgctatatatatttgtgtacaagtttttgtgtgatcttcatttttgtaacatctccatcaagagaattaagaatctctatagctagatttattgagtgcctcctgtgtgcaagatcctgtgttgatcccatgccatatcttgtaatcttcacaatagcccaaggctctctccacttccttaaaagcgaggcaactgaggtcccagagctgtggagggctgcagctgggactggaagccagttgtctgtgataccataacatttatccttaacactgctcccagaagttgggcaactgttggtattacaccactgcagttgtccacactgaataagtcacactgattaaatctgtgtgctgtgccacttccacacattatcttagtgaatcctcacaccaaccctgtgaggttgtcctactctttctaatgttcagtgaggaaaagaggttcagagaaactaagtagctcactttggtggcatggcccatcggtgtcagagcctggggagccagcattcagcagtgtctggcagctgctccttgaggccacagccttccctcacagacctggcatcctttaaccctctctcacctcagggagagtttctcatatgttcagaatactatttcaaaggacagccactacccgcctcactttgcacaatgcctgcttgcctgtgtgcatggagacaggtatccaagtatcaggatgcctggacccggggacttcgtgcagacaggacccctagtggcctgctctggtattacaggattcccgaggcgtgcatccacattagaattcacttctacacctggctgcaaaccaagacccttaagcttggagagaacttgttctgggggacggttctgagcatggcaggatggagaggaacttggggtgctgcctggaagaggaaggtggcagcagggggaggctggagaaggaggagggtaacagtagcggtggagtaccaattgtctccatgtggttgcctgcccacagctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccagtacgtagactgggcagggctgcctcttcccttgctggcagaggatggatgagcagtggtgtgagctgcacctatcagtcaccaggcctctgagatatctgatgtcgatatttccagaggaaggagaggaacttgaaccaggaggtcctgtgaagctctcagcctggatgagattcccaggttttgtgcgaatcacgtgtggagtagaattaagacaggatacccattcattcattcatccactcattcattgcttcatatattgattcattcatgttctggacattttgtccacaagttcctgaatgaaatctcgtgtgtgataagagagacggccagcccaagggtatcttagccactacacatctgactgcttaccttgcttccttatgctaagggcgctgttgtgggagaaactgggacttgggatggaatttgaccactcactctctgggtaacctcagataagtcactaagtcatcctatcctatccaaacctcagtttctacatctttaaaataggaatactaggctctattttgcaaatcttgcaggttgttaggttgttgtgaggtgtttttttgtttttgttttttttgagacagggtcttgctctgttgcccaggctggagtgcagttgcacaatctcagctcactgcaacctctgcctcccgcgttcaagtgattctcatgcctcagcctccccagtagctgagattacaggggtgtgccaccatgcccggctaatttttgtatttttaggagagatggggtttcgccatgttggccaggttggtcttgaactcctgaccccaagtgatctgcctacctcagcctcccaaagtgctgggattacaggcatgagccactgcgcccagcctattgtgagatttaaattattttaaatacaggaaaatctgtgaattgcagtgttttacaggcatatgtagtaggtcgctcaagtcacacatatggagcccctactatgcgctgggtactgcttttaattctcacctaagtgttaagtgttatcacctccactttagaaaagaaactgaggctcaaagccattgaatcatttgccagaccacagagctagtcaatggctgagctggttctggaccctgtgtgcccagtgcagtccatgagacctccctacagtcctccggcctgttgtttgtattaccttgacaactttacaagactaggcccaagttagtgggctggtgacttgtggctaagctggaaatggatcagctccagttcagagggcaggagaagagcccctcaaatcagagataatagtatctattccctaagactttgaagagtccccgtctcctccctttctaacccgtttcaacctttgaccacactcagtggcaaaaataagtaaacaaaacaaaagaacaacttgctcaaatacatctgttcttccatctgaggatccagcaaagctccagcctgggctgttagggtttcaagaaaatcagtacatccacacaggcccaagcatcacatgtggggtgtcgtgacatccagaaaagttaagaagcgatgcaggcagtggctctggagactccccagcctttctccctctcacagcttccttcttgctcctgtggtgttggatccaggctcttccctctctcttagtttgggttccctggtttattcatcatgtacttgtccataatgactacccagacctgatttactctctgtttattcattcagaaacttttattgagcattgactctatctcaggcataattcaggatatcgggcattgggaacaaagcaggaaataagatagatgtgctcctgacctcaggtggctttcagtctgtctttaggctgcacatcaggggcagcttcccccagtgcctcttaatgtgcatccccaaggtctggctctgattggatcagctcaacttgcagtgtggccagtctcacaagctgcaggtgttggccaggctgcctaataactactcttggagagagggtctactcccagtccctcctgctcctatgactgagggagggccataccatatagaacagggccattgaggccaacaggatctgtaggcacagattcctccccaagaaggcatggaggaacaagggccaaaatagtccctcatttattcattcggtcagtaagtgtttagtgagtgcctattatattttattctaggccatggggattcagcagggcacagacaagaatcctagttgtcatagaggttaatttctagtataatggaaggaagattcagatttcccagtatcttgcaaatgaaatcagaaatgccagcaacaactccttgtgaacccccagtccagtccacagtgtttccttgtccagggaggcaagtctcagacaagggtccagatttctaaatagttcagtagtccatactttgaaaagccagcccttctcttctcggttcttcagggcttctctggcagaaatgagggagccaagatttgcccgtcatggatggcatcgttagcagatgtaaatttcctcttttagtgacccatgcagcctgacttagtaaagtcaatatttctaaaatattgagccagatgaatcaggggaataaaggaaacaggtatctttattccatcttatagaactttgggcatctttttaatgggcttcttttaggcaccaggtattttcttagcaagtgggcctcagttcagtttttacatctcagtgtgtttgaggtacgattagcatttgttaggaaaggggacttctggatcttcccactccaaaggcttttcacctgaagccagagtgcccctccacagtgggttttaaacactacccaggtaaagttcattgaaagattccagcccagttctttccctcccaaagtaagggggcaggtgggttgtggcttaagcgcctaccacctgttggctattgcagggtggggcagtgactatatttggggaaggaagggaggagggggacaggatctctgggtggaggagagcccacagctctgtgatccctactttggcgaggctgtgtggtataaaaattcagagcatgggttttagaaccagactgaccagcattaaatcctgggtctcccatgtattagctgtgtgacgtagacaggctgtttaaccattttgtgcctctgtttcctcgtttgtaaaatgggagtgatggtagcattgcctcatagggtcactgggaacggtgtaggtgaaacgctcggcactgcacatagcaggacttcaggaagtggcagctgtggcttttgttgttggcttcattctctcaccccacatttgaacgggcttcctcccaacttattaccagcctcccccctctctcttgtttcaaggttcagccctacttatgtggcagcactgtctccagggctgttctcgagtggcctgcctaatgtcagcatccatcgtaattggatattccccttctccttccagttttctgggcttgatgcatctgatagctctgagccttttaaagttgtggtgagccacctcaagccagctgctgcccaatgccaaaggccgtggtttgccctgggctagtggcccagggctaatttgcatcattaatttaaaaaaatgtgagtggctctggggccctggacaactgccctaaccctacacctgtcaccctgtggccagggactctgcttcagggggatgaaagagaccctagtgatgatatctttgactgtggaaagcagaggctctgattgaagctggggctgtagcactccaacagggcacagttgtgccttactttgagtaacagggatttcagaaagctctgtccacatcacacttaatgaatcctattcagggtgggagagtcagttgagggaagcaatggttatttcaagaatcaaagattatgaagtgtaaagaagctaacgatgctggaagccagaggtcagccccctcgtctgatggttgaaggcgaggctctgagatggaaagtatcacacggggcattaattaatagccagcctggaaactggaaagatatgaggagaaatcaccccctgttctcttgggttcaaatagacagattttcatataatgggtttatttaaagtgagggtcacttgtaaagctttctccagcctgcatctgacatcccccacctctgcccttccaccattatcgccccaggatcttggtgtttgactttccaactccttctacacagcctacagatctaaaataacagagatggacaagacctattaggtcagctcctgtcccacctggcccttccttctttcccttccgtgtcttacctgaacctgagcctttcttctgcagggagctaccacaagctacctcctctgttcctatagatcagcgtttctcctgcggttaatgaattagagcttaactaagcaccaccctttaccattcaaacaacctgaggctccgtcccagcttgaggtttaatttcctgcagacccagaagcaggggcttccctgtcaacccctcccctgtgcctcagtttgtctctgtgaggccaagcatgctatcagctgtccgcacagtttccccttgaaactagaggcgccctggttatccgggcctcctgtggctccagtgcccggcgcgtagcgttccagctccacatggctgcacctcctgcacaggcttccaagcttctcacaggctccacgagcatgacctctggtgattcagagctgcctctgagaagtgagggctagcatccctccttcagttcaacagagtcagttgaagttggcttaaggaaaaaaaagtaagaagccagaagagaaaggcatacaaatagtgatgagtcattcagcaaacattccttactccccttctcggagctacccgcatcataggcatgatgtgggctcagccatgcattgaattgctgtacttagaaatcatctggtccaaccccttccttttacggatggggaaactgaggttcaagatcttctccaggaagttcagatgtacacatctgcaaaacgacaccatctttaggtggctctccagagaacgtgccaatgagtggcacagacaggggagcaggaggtcagaactaggaggtaggcagagcaggctatggggtcaggtgaggcccctggccagaccttagaatgttgattgatgaagagagagaagaaggcatctaggtagatggcataatagcatgagcaaaggcttaaggcaggaaaaaaaatgggatacattgggatgcagtgacagacagtatggctgaaacagagtgtacataggggcagaggagagatcctggcttcagtgtagagcaagttctggagttcaatgcaccaggattctaatcctggctctaccagcaccctgggcttctctcctatgtctcacagccctcctctgtaaaatgggaataagaagagttctcacttcatgaggttgttgtgaagattaaatgagatggtgcttaaatgttacttagtagtagtagaattcatatagtgactcctccctctcagggttgttgtagagattcaggtggcacatgtgcctggcacttggaaagccccagtaaatggtattgctgcttgcacggtggcttgggaccaggtgaaggctttgcgtgatacgctgttggtgaggagaggcgatggcggtcttgagttcttggacaccagggggcccgtcatggggcgtggcactcatgccctcacacactttcttccttggctcaagagccagcaaggccaatccatttagtcccctgtctactcccagagagttcagaatggaatgcgttcctgacagctttggcacaagagaggagatggttctttggaagtgatgaggcaattgtttgccttgccctaggatggccagggcttcacgtgtactctgtgcagtataaacaggctcagagggagactgcaccctctgctccattcaggctgcagcatcgggaagtgcttccgtgtgaaggactctgagttctcccagccctccccagtgcacatctctgtgagccccgtggggccagggttgtttgccatctgggcccagagagcactgagcagctcctcactgtcaggcaggaggacctggccccctgggtccatccaggaagctgctccttcctggaggggggctacagtcagtggcacttaccattagctcctctaaaccatctgcgacacagcctcaccctcccctccctgaactgctctctgtccggaggagggaccctgtgaagatgcaggaaaggggaaaggagtaagttccacgacgcccctcaccccaccacccctgtccagcctgggcttctaaggggtctccaatccattgccagtgctgacattttgagatgaagaagtccctccatggggccactacaccccatcatggccttttattccagcagctgagccttccaactcctctgctgcctgggaggaagaggtaaacgcatctccctcccttcctgtgcctcctgcaaactgctcagagggccgaggcctgcagaatcagcatgcaggggttccagagctgagaccctttataaatgatttccatctctactgagcagggcacccttcatagggaacgaaagaccagttcccagatcccaggaaatccccaggccatagccactgctaagaccctaattcagttccactggactcatttgggatcatttcagttcagttgagcaaacatttaatgagcaatttctttttgccagggctgaatagacatgacccctgatctcaaggccatttatgatccagtgagggagatggacacattgacacacgtgtatgagaagctcagaatggcaggcgcaggcccacaaaccctcgaggcctgatgtgtgtagaatccagattgagacattgggaaggttgaggggctgggcgtggtggctcatgcctgtaaatcccatcacttcgggaggctgaagtgggaggattgcttgacgccaagagttcaagaccagcctgggcgatgtagtggggccccatctctacaaaaaataaaaaattagccaagaatggtggcatgcacctgtagtcccagctactcaggaggctgaggcaggaggattgcttgagcccaggggttcaagtctgcagtgagctatgattgctccactgcactccagcctgagttacaaagtgagacactgtctcaaaacaaacaaacaaacaaaagaacggttgtgtggtgcatgtaccatatgtaaagttgaatctccagtaaccccatactcaaacaaatgcatgcttatattcaaatactcacacattgtaaatagctttacatctgtctgttgagatcagattttgccaacaactgagtttgatgaaaaacatcaagtttcagagccttttggactttggaattgggaataaggaattgtggccttctataagaatttattttcaggagaaactttcctttcttgggaaccaacatcaccaggctgcttgggacagaagctggccaggaattcagagagcaaggaagctgcgctgtctcctaaaggcggctgactcagagccacagtgtgctgtgaatatagggagggagagatgccttctggcctaggagcaagatctgagctggatgctgaagtatgagtgggagtttgctaggcagaagggcaagagaagcctagaccatggtagtctggagatgctaatgaatcccttctcagataaatgtttttaaatgaataaaaacctttttattaataaaaaaggatagaaaataaataacaaaaatccaataaaatggatagggtgactatggaaaccagctatatggaaatgcagttatattttaatagtggtatactaatatatatgcttcttcattaatgtattaaatagcatcgagcctaattactaccataatcttgaagtaataatgaatataactggtatttgaagatatccttagcactgtagtgtcatatgaaaactgcggtgatttctgtgggaaacaaagtcacaggtgctattaacacactgtagtttgttgcctacattcaaaatggaaagaaatgctacatttcacttaggggttagagaaaagaatgatgtaattccccccacaagtgttcacagacccctgacttctacccacagaccccaggctacaggttaagaacccctgatctagagatagccatttgggaacaggatcaggcaggaaaatatgtacagagtatgttctaggtgagctggcatgcagcgggagatggcacggtgggagaaggggctgcaaagacaggacttaaggagaccagagtcactcgaattttacttgctcatcagaagaatgtttttattatagcattgtattctttataatatgttataaaaaggaatacatgctcattatagaaagtagtgaaatgaaaaaagggaagacaataactcagtgttccagtggccaaggcaatctacaaacatcccagttaattgccatttgctggggatggctgtgcggtgcagtggttaaggggccggtctttggggaaatgggtggagctgttgaatcttgactctgctctttaatttctctctgttgattttgtatctgtaaaatgagaatgacagtaatagtacctatttcctcagtttgttttgggaattaaatatgtcagttcccgtaagagtgcttcgaacgggccatagttaacactcagtacatgtagtctttaataacatcttctcataatcattcctcagtgtataagtactctctgtatttgcttagttgtagccttcatatagatatacatataattttatatcctgcttctgtctcttagtattattaaataaatatttttaatactattataaactgttcataagtattttaaatgcctaaataatattccatttgggcatacagcccacattttatatacttattcccttatgattatacatttagtttatttccagttttgcatggaaggtgttgagtgggcctcagtgtggttcagcaactgtttataggccacgtaactctgagtcaggccttgttctaagtatggaggacacagacataaataagacaggttctctgccttgggggcacactccgatctacgttttaggactataatttgccccaccgtttaaagaatggattggaaatgaagaatcctggagacagagagactcccttagaagggcaggttataaagaggggttgacctggaaccatggcagtagacgtaggaaggaagggctggcagagagtgagaaggtcagatggtcggaacctggcccttgacctgtaaagcaggagaacagcttgagtgagggaaggcaagaaagaggccaggatgactgtggctttgagcttgaggagataagaggagtaaagtagagtgggtaagagcactggctttggtgccatgtcgatccccaagttcaagcccagtttgaccttatattacctgtgtgatcttaaacaagttacttaaactttctaggcctcagcttccccagctgtaaagtggagataaaaatgaattttcctcatagaagtgtggagatccaaccagattgtgaaaaatatataacaaatctgatatggtggggataataataaaagggtcatgtagcatgtcaggtaccattctgaatgttaagtattaattcactttaattctcacagcaaccttatgagagaggtgttattagtatcttataggtgagaaaacaggcccagaggtttgataatttgctcaaggtctcgaaactagtaagtgacagagactcaaacccagacagccatgcatcagactccaagctcttacagaactgagtgtgagatgccagagggaaggccctgtggcaacgtccagcaggtggttggaacttgactttgtgacccagcacataggtgagagtgcagggtcatctgggcagagacaagggtggaggctgtaggcaatggtaaaatggcccaggaacagtgagtcaggggcaaaacctgaatttggtgggtgggagaaggaagaggagtcagcaatgagtgaaagactgaccagagaactggaggagaatccagattgcacggtgttaggaaattctaaagaacaatgcaatcagaacaagtgctgcagaaagagaacaggatgagaatggataacaggtcatggtgaccttggagaaagtggattcagtagacgaggtgggcggggggacctccactgtaagaggctgagaagtgctgggtgtaggagtggctggctgcaaggagcagtgcagacaaagtaagtggctgtgagagaggaacatgaaccctggatgcgggtcaggagacttgaatccagatgccaactctggccttgattaggtgtgtgaccagagcggaggcacttcacgtctctggggtgctgtgtccttaccagtaaaatcaggagataagaccccactcccccaaggcagttgtagggatctgaggggatgatgaacttcaagcacctagtgggctgtaagagttaagttggctgaggtcacatgagataacccccatggaagtagcttggaatttgaagagactcttcaaagatgaagcctgatcatcactactttggccagacacttagtactgatgagtcctccagtcagctgagattttgggatgttgtgggatgcctgcccaagccataggctaagagaagactccaagatctatagttcatatggtaaattgcaatgctgggatttgaaccctggtgttctgccttgctgcctgtaccccgttcagatgatcacctggctgtattggactctaacccagaagaaagagcgtccatgtggcaggtgtggctttacagctggctcagtaagaaaccttgtactagtcccttaacctcaattgctaggccagggaaattgctctgcctgactcctaatacaagtaggaagaaaatacatatggagttaagccttgagttttgcagacaaggatgcagtggggaacctcgattgcattttctgagggacggccccttggctctgataccacagtgtgtgcacggagaattctttcctgtcctctctcactgtgtttccctctttctcccatccttcctttctcagtctctagcattttaaaatcttagattctctccccctcctctgattacacatcccattcctttagacattcacacagcaaatctgagctgggctcctactctctagaatgcattgtgctggacactgaagagatgagaagtggggattgggagataaatgtggctcagttcctgtcttcaagaggtttgaaatctagtgagaggagagcactaaacaacaaacccaaatagatacagtgtcttagactagaggtatgaaccccaggccttgggagcccaaggcagtgttaattccatctaaaggagcccagtggtggggtgcggtggctcatgcctgtaatcccagcacttcgggaggccaaggcaggtggatcacttgaggtcaggagttcaagaccagcctggccaacatggtgaaaccccgtcgctactaaaaatacaaaaattagccaggcgtggtggtgggtgcctgtaatcccagttactcctgaggcaggagaattgcttgaacctgggaggcggaggttgcagtgagccgagatcgcaccacaccactgcactccaacctgggtgacagggtgcgactccatctcaataaataaatacataaataagcccaggaaggtctaaggagaaggtggtgtcagaactgatcccggacaggtgagcgagtgttcagtccaggagggaaaggccagatgccaggcatgctggtcggtcaggacgggacctgctctacctgggggagggaacatgccaggcttcaggacgaagtgaacgacgggggcattgacagatgaaacttctttctgcctctcactttctccctgcctcccattttctttccctttttcttgcctccgctccttttgactttagccacccctgctctcttcctgtctgcgtcatcctcgccctccttcatacccccgcctgcctgcctgccttccttctcccagactctctttatatttggggggactaatgcagcagctgtgctggggctccccctacccccctgcaggccaggccaggccgtgggatggaatctgcaggtttgttccattagcctctgtccttctgtgacagtccagacaatttatacaccctgttggctatggccgtatgttgtcataacctgggtcatttcctcatttaatgctgcccataaactccaataaaactgtcctggagcccagtcgtccaggggagaaggagagactctgggtttcgaagggttggagcaggggcctgggcagcgggtgtgcagaaggtgagggggcagcgggtgaagaggagaggactgggccatggcgcaagcccgacctgatgagtgctttgcttctttccctgtccctgccgctggctgcagtgtgtcagatcctccccaagggggtggtcgctgtcctcggaccatcgtccagcccagcctccagctccatcatcagcaacatctgtggagagaaggaggtgagtgtgaggcagggctggggaatatctgtgtgctggagcctgtgcccagggtccaaagatagggttgattctcaagggctggaagagcctgtcaaggctgggttggtatcattaataacaacaacataaatacaaatacagaagcagtgggcttgccctgctccaggatgtttgcatggaggggtctcggaggaggtgtttgacagcaggaatctgaagcggagctcctccctgtcttagggtcccatggcggtgcccccagcggcctcttggtggtggtgggtagagggagaggctggagaggctgatgggcatggcaggccaagcgggcagacgtctgagcgtccactctcgtgtccacgtgagcagctccctggttatctgtttacatatcgggattctggggaagaatgccttcggggaaggcattgccacattttattgctaaaataaagtttgaaagcctctgtcatataagttctctagaaaagagattttatcttgctttcttcctcattcaccagttccagtgtttgcttcttcaagcagcacattcttcctcagatgtgactcgaactggaggctctccagtttcaaagtgttgagtccatttgctctagttctgtttccatgggagaaaaaaaatggtagggcacaagtttcagagtgactgcccccctccctattctgccaactctccccctcctttttccccagagaagacaaactcagaaattcagagattctgtctagtcctggcatctttcctggtccttcctggatccatcaatccttccccttcagatatatcgtcgggagacagtgagaaattggccccttagcccctgtctgccccaagggccttccagccaggtccttagtgggcagatggagcttggtggtcaggcatgaggtcaggagctgggtgggggcgggggcagggacatgggaggaaggctcagtctcgcttctgccctagaggcctggaggctcagccttccagaagctctagtctcaggaggacacagttcttagaaacaggaggagcacttgctgcaggagggactggatgcctcctcagtgagccgctcctgccagggcaggagcaacagacagtcctctgcccaccccacgcctgctgggagtctacccctctgatgccaccactgtctcttatgatccagggctcagtgagtccctgacgctttgggcagaagaatatttatcttcccgattttaggagcccactctcagaattgtgtgcacgtttaagtgccgcgatcctagtcctggtcgcgttggtcctgctcctccagtagctgggcctctctctgtaggctgcacccttgagccttcttacatgggctggggctgacaagtccccatcctcctcccggtcacatatcctcaaatacaactctgaggccagcccaggccacagaggagctctgtcctactaggtccctcccagcctctcccaggccgtggcccaggaagttagacctcacgtgtaatttacatctttcttgcggcactctgagaaacagcttaaatctatggcaggtcattattgtagcagtggctctgatcttcactaagtggggcagccaagacttcagctccccatcttctctcttctgcatcctctttttctttcctcctctctcccttctcccccaccacacagtctttgctgtgcatcacatcctcccccaagccccactccaatatggcctccttttggggttcagtggctatttaatctcagccaacacatcccttcaccctgtctggcatttcaggccagaagccaagcccatgatctgcagccaactcctctgcccctgtgccagaccagccagccagactgcactgccctgggagtggccagacgcttacccgcctttgtctggttatgtttcttctagagcaacttttcctctctgctcagattatgcatttattttaatgttttatgaggctgaactgccttatgctgattctcccctgctccagggaaaagcaatggagttctcacccaggagtccattgctttaaatgctgctgacatctctgcagcccttgtggctggctgccttctgccttgctgctcccctctccattctgctcacctcttcttgtcccccacacacctccgtgatggcttcctgggatacatttgcaattgcacattgagtatagatcgatctttgtcccagagagggaaccataggaccaggactgggctgggctatccctgcctagacccagcagagcccagtgggcttcaaggagactgtgccgaaggctccccttcagctccccttcctcagccctcaccccctgtacgcacaactccaagagctttgcgggagctcctacatttggggaggaaggagaaagagccttgcacaagcacttattatacattaggtattgaactattatataccctacacacaggttcacattttatcctcccagagctctaagaagcacctgtggttatctccattttaatgatgttttgacaagttaagtggtttatctgaaaatcacacagcagaacctggatgcaaacccaagtctgtagactccaaaacccatttgttcttcaccttcctgagtccttcccatccatctctaggatccgtggattcacggtatctctaaggggtccacagtactagggggtgctaaggggttgtgctctattggattcgctgctaatggaatgtggtaggctagagggttacacagggacgaccttggtcagaggtgttcaaacgttcaaaccagccagccaggctaccctgcccctgtcgggccttcccctctatcttgcccatttgtgaccttttcctttcaaggtctgtttgttattcactttagacagagtggatgggatacaaaatacaagcgggaagaaagatccgttatgacacagatcaatgtcactctttagaattgcctttcataactcaccagactctcccccattctgcatttttcagtttctggtggaaaatattggttgccctctccctatggtttaaaggctaatcctagttgaattcagaagtttttcccctagtttctgctaaatctttatcctcttcccacctcagtctcagaggagctctggtctccagctgacttctcccaaaaatttaaaaggataaagtaggagactcctacagagaccatcccaacatcttcgcagactcttggcaggataagttgtgggccagagcaggcagagacaattcttcagtcatttctgaataatccattctggaagccaatctactcaccaccaggaagttcttcctgctgtctactatcgatcttccttgctttaacatctatacacactgatattcagcttcagctcgctcagctctggacaccaggggtgagagtggaagaataaaatcaaggtggatggcagattattacattgtaactttcctattacctaccaaatagcctaagccgccaataaagcagccatcacagcctcttaagatcttttcctgggagaagagaggcagaaggcaggacagtgggtcctggaaatgtcagtaatagatgcagagggaagctgacactgtcctaatgaagccaaaccacgtatttatttacctggctgtgttcagaggttctctagatggtttctccgcctgcagggcttccttcctccatgtgcgcatgtgtgtctgtgcgggagcccatccccgccccacttcctctccctgggcattccccactgaagtttgttgggagctggttactatacacctgttggctgggctgggctgatgggactcttctcttagtcccagggtagcaatttttctctttctgccatctctgctctgatgtattaactacaaataaaatattctaaggattatgctttcaagagccaactgtctctctgccagcagcaggcagttcctctaagaataaagatagattcttttgccttctcaggaccacagaccccagcttgcagacccacggtgcattcatccgggtctctggacaaatagttttctgtcctggggctgcttctttgaagcatcatcagggatgtcatcgctcgtcttcctcccacggagtgggtgccctgggagctccttctcccattggtgtctggcgaaggtgttacataaaagaactcaccctccacaacctcagctcactcatccctctttcttccttttcacccacctggatcctccctgctgtccgtttttgctcctcttgccaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgtaagtttccccaggctggctctgccccagacagtccagtcttgttgattttgccctgattccctgtgcccctggctggagaccctccaggaaggggaggcttccttcagatccacagggctgataaccaatgggtttgggcattcccatgctcatgtgtccgtgtgtgtgtgtgtgtgtgtgtgtgtgtgtgtgtttaagagagaaagagaaaaagagagaaagagagagagagatggggagggagtccatccaggagtactacttgccaggactccctgggcatgagtggaacagaggggaactaggttacaaggagactggccaaccgccaagcctttttgcatctgcaaactcaattcccacattctcagcttcattgtcaaggagatacaaaaagagagagagggaacatataaaattggatgcatttgtacttgatgggttgaagaacttcttccccctggagagcaggttttgctgatggaacaaggtccgaggtcaattcctgataaagcattttttagcaaatgcaggttttggaaatgtgttttctatgactctcagtcaatttgtgacataaatttagtgtttatgagatttagctaatttaagccagcaccttccagcaaatctgtgcatctgtgtgctcccggtggcagctgtgcacccacatgtggtcaaacaggtgctggccactggctactgctggaacccagtgcctgagccccaggcacctgtgtcctgcgcagctcacctgtccagggcttacctgggggtttttatgggttgcactgcagagcgattccatctttattagggctcctttctatggcttctcagaactgctctgccttctcaagcccttcctgcatcctggaatccccacagtctccaaatacaaaagccacctctctattaagagtcagaaccacctactttcccagacctctgtgcctggcatgtgctttaattcatttatccagtacaattttattgaatattcaatctgtgctacccaagaaatcaaggaactgagttccaactcagctgtgaccacccagtgggtttggaggtgttagatctccccatttcaaagttgaggaagttgagactctaggaggtgaaatgacttgcccaaggccacacaacttaagcaccagggcccaaactcaaatacaggcctcctcacttcaagttgaaagctcttccagagccctgcagtggatgcagagaaaatagggcccttgccactgatctgagaaggcccagagtggtttatgctaagtgtcaaatgtgcaatgtggccagtcgaggagagtgtccctgagtacagggtgctagataggctttgggatgtgggcagggcttcaactggatctcaaaggataaaaatgatttagaaaaggagggaaagagataggtcatgccagatgaggagcaagagagggaggcagggatcctgatgctgtgcctaggggaagtaggttggagcctagagtccatgctggataaagatggaaagagaggctggggaaggtagcagagatccttgtagcaggcaaggaacatggacttggtcctgtgtcatctgcgagcccttgaaggtcactctctaaggaatgtcttctaaggcgaggcagttctcatcatgggtgtgcccttgtggaacaactggttttgggtctgtgaaaagggcaaaggagttgggaactggaattagacccaaggagctggggaccctcagacgtggagaaagaaagttgaactcaaagccttgttcaacaggcagaccctgagtggcaccagcaagttgggtgcattcaggagcactccagtccatcactcaggcagtcaacaggcgtcttcgagcatctcctgggtgctgggcacccttacactctatgtacggcataagagagcaacacgcagcctctgttctcaaagatgaagcagacttgatggaaaactaagcagggtcgatggtcatgaagcaattaacacagtaaaatcggtgcggtggctcacacctgtaatcccaacactttggaaggccaaggtgggaagatcacttgacatcaggagtttgagaccagtctggccaatgtagtagaaaccccgtttctactgaatatgtaaaaattagacgggtgtggtggtacgcgcctgtaatcccagctacttgggaggctgagacacgagaatcacttgaaccctggaggtggaggttgcagtgagccgagatcatgccactgcactccaacctgggtgacaggagggaaaccctatctcaaaaaaaaaaaaaaaaaaaaaaaagacagtaaaatgataattgaggtacactggagttctccagcagggcttccatgaaaggggtttggcaagaaatcagtgaacatagattctaaccccctcagctagagaagaagaaagggaggcccagaaggtagcttggtttggctagagtctcataattagtaagtggtagagcttggatttgaatccagattctgtgaatcacagtccagtgcaccatcgtcattacacctgtatttatcaaatgggtttcctctggatctgtgatgaccaaagcagtagccacaagccacgtatggctattcaagtgtacatatgaattgattaaaattaaataaacttagaaatccagttcctcagtcttgttacatttcaagtggtcagtagccacgtggctggtggctgctgtgttgggcagcacaagtgtggaacattcccatcatggaggaaagttctacaggacagctcggctttgatgatacgtgttttgtggaccaggagttttatggcaaaaaaataatgtttggataacccttcattctatttcctcctagtgggaggaagttgacgatacacattagcgtggacacactcagatgtcctgtggccaaaacatgtatttgcttcattttctttcaaataagtttgaccatgagccaaaaaagaatgctgatcttacagcctgaaggatgttcccacttcaaggaacacagtgggaagctctgcattccactgggtggttttcctcctgtggtgcccttggaccatcgaatggtgtaacaggctcaaggattctcccctagaactgactgccacacgcccattttggcaggactgaactggtgtaccctgtgtacacagcggggttgttaagagacagagggtatccgcaaatgtctccaggcaaagatggtcctgcagtcttcctcaatgctggtacaatatctcaccaacctgacaggaagttctttttgtgtctagtcacagtctggcttgcttttaggctgagacttgtttcctctgcttcagctcttgctgggcttttgggaaacaggttgctcagatgtttgctaagcatctactacacactaagcactatgctaatactgttgcctcccagcccagggctcttcccattagaattatgacattccttgacattcaaacagttccgtgcagatggcaaagcactttcacttaacatttctccattttacctccctcctccccggtcattccagagctgagaaaacagagtcttggaggtattaagggacgccaggtcgcacagctggtacgtggcaaagctaagactttatcttagtcctctgatcttcaagctggctcttccctctccatgacccccttccaccatcatggtctgcacaaacagccctggagcagtggttcgagggtgggctctgcctggcaggtgcagtgttcagggaagggcagagatctctctgaacaacatgtgcccttgttccctcgagcaggggtgcaggacagctaagcacagacaaggttctggagcagatgtgcctgtccaggtgcagtaggggacggcccacatcccagcggacttggcaggcacacaacacagagctgctggaactcacctgctgaggctgctgagggactccagtccccaccctccagggccagagcagggaaggtggagcagagcagaagttcaagggcacagaggattaaaaatctaatcaagggatgagaaaatgagggaccgaagggaaatgcagctcagagctctgaaggagacactcttccatcttccttattaatgcagggccgagagatactgtgagtagaattaggagcagaatctaattctattttccagccatgaaaattaggcataacggagataattccatggagaatcatgccacttactctcttccttcccaaaagtagatttttaataagcaggttttggaccaagtagagagagattgtatattacattatttttctttaatgggaaaaaaagaacatttgcaagtgcctgtttctgatgaggctgggggaggagatgtgatgagcagcccaggtgtggtcctcctggtcagagctcacagagcctgagggagttggctactggggggcttccaaggagagttggggctcaccactgtgggtgcccagggcctgttggtcagatcacccagccctgccgcggatctacctgttgacctcaggctgggcccgaagccacaggtataacatgccgtgtatttccctgctatcttcctacatgtctcaaatcttattttttttccttcttttttttttcttttcttttttttttttttttgacaaggtctcactctgttggccaggctggagtgcagtggcgcaatctcagctcactgcaaccttcatctctcgggttcaagtgattcttctgcctcagtctcccaagtagctgggattataggcatgcaccaccacgcctggctaatttttttatttttttgtagagacaggtttcaccatgttggccaggctggtctcgaacccctgacctcaggtgatctgcctgcctcggcctcccgaagtgctgggattacagctatgagccactgtgcctggccttattttattattattattttttaatgcttgcttttatatttctttctgagttttttgtttgcttgtttttgtttgtttgtttgtttgtttttgagacggagtcttgctctgttgcccaggctgaagtgcaatggtgcgatctctgctcactgcaacctctgcttcctgggttcaagcgattctcctgcctcaccctcccgagtagctgggattacagatgtgagccaccatgctcagctaactttttgtatttttagtagagacagggtttcaccatgttggccaggctggtctcaaactgctcaccttaggtcatccgcccacctcagcctcccaaagtgctggggttacaggcatgaaccaccgcgcctggcctctttctgaatattttaatgtcctttttgtggttacatggcctgtgtccccacatcttctgctacttattttctacctgtgagatcttggaaaagtgactttaccctctacctctgttgtctcatgtataaacagtgaaacctcgctcccgggatggctgaggggattcaacagatgacacctggagagtgaataacacagtgtccacaccgaggaaatgctcggcacacatgagttttcctttcctcccttactctgatctctttcaaatgaggcaaggccagacctgggagcaagagtcagctgaggtcgggctttgtcctcctaccagcctgtgatcaccaaacgtggcccaggctactggagaggagcagacttggatctcgaggcagtccctgcccttggggaggatgtgctgtcaaagagaacggcaggataccagagtcagccaagctgcaccaccacttgggagctgtgtgacacggagcaggtcaatctgcctctctgagccttagtttcctcccatgtaacaagacgataataatgtctattgaggtaattggatgggaaagtaactgggcccagaacacgataccacatttaattactgttattttattctgcaactctgcttatggcagtgggggtggaggatggggagtaggcagtgatacccaaggccctggaagagtaaccaggatggtagtgggccttccctgtgctgtcccccggaggccctgtgggaggccttttgctcataatgataaaaaattaaccatgcagctctgtgctgataccaggaaggtcacagtcctcccattacagagcacttactacgtgcccaacaccatgctaagggtttttatattatctcatttaaattttagattctcttatttaaaccatataactcatgataaccgtataagatgggctctatcaacattctcattatatgcagaagaaaagagagattatctccatcttcaaggtcacatgattcctgctaccttctctcccagctttcctaaagaagacagagaagtgagggaccatctttcctacagtatgggacgaccgagaccatcccatgtatcagagaccagaatgtggaatcagataatctgggtttggatcctggcctgtcccgggacctctgaccgtatgatctcagtcactgaatttctcccgccccagcaattctgtcttgactcagggataataatatccacctcccagggcagtcaggaggatgaaatcagttgtgtatgtgaaggaatttaggaaacactgaaggttattctcagagcagggatgtctaccaggtcccagtagctgaggcccaagctggaaacacatcctgaaatcaggaggctgatgggaacacagaggccggggtcttccgacacccattcttgccattgtagaagggacagcctcgatggccaaacacggccacctacggtccacctgtgagcaagaagcctcagctggctcctctctccctctcctcttgccctgctggtcttccctgcctgttcctggagcaaagcttaggtgcaggatgggacaaatttgggatgcaggtaaaatacgtcattccagaacttgaacttgttctgtgccccttccccacctggggacaccttggaccctcatcttgtccctctggtgagggttcgctccatggaacaggtccgacaaccgcacaccctgaggcatgggcacctggcagggggaaggggaaggtttaggtttaggacactatgtgccatattgaattcatactatctcattaaatcctcaccacaatccgcaaagatcaatcttatatgaactgcttcccacaaggttaaaaagtgctggtccaggaccaaggcactactccagccagtaaagagggaaggaagcttgttgaaagaggtgtttatttttataatattttttgatacaagggtcctctgtgtcccctgcagactcatcgcttaggtcttggtgtccttgtcctgcggctgtgtccacccctggctgtgcctttccttacctcgacatcctcctcccacccctcttggcccctgccttccagttccagaagccagcctcccttcttcctcccagaacagcctgcctgccgactctctcatcgatccgtcccgctgcatcctgagcaaggctaataggttccctaggcccctctcagccttagacttggcaggcaggcaggcaggcctgctgctgggccatggtctggaaggagaggagggtgggggtggaagtggatggggtgtggggaagagagcagcttttaacccctgtgatggcagctgcctttggtgaatcccttagttccattaaacagataaaggtgaggagaatgacaattcgaaaatgccaaactgccctgaaaactcttaatactctcaatgtaactaaaccacacttttcctaatgtaaatttcttccactgcctagaattaaaaagtatcctcttctgattcataaaattagaggatctctgggctggaaagacatcaacgttttactagttcgactttccatccactggtttaattccctctatagtgatcctcaagaggggctttggtctttccttgactacctccagtgatggggaactcactacctcatgggcagcccactgcatcataaaggaagagttattccttacgttgagctggagtctgtctccctgtgacttccactccctcatgactcctgggtttagtccttgaagctgccaagagctagcctgcctcatgacagcccttccttctctccctctggccaggcacccaagtcagctgctcctcaagtgacatggcgacggttcctgcctggcactgctgctcccctgacttgttaggatttagttactttcttcccccacagtctctacatcagtccaatccagcaagcaccatgcaccctgcctgcactggggatatgcagggaagtctgaaatgggctccctacctaacactgaaatcatttatgcacatactgtatattacaaatatatacacacacatctatgcacatacacatacttacgcatatacgtgctctcaaatactttctatggtttaaaaccaagactatctttggtgggttggataatcctgtaagaggtgggagacgtgagaagagggtggaggctggagaatggagagaaggtttcagggaggagatggggtaaagggtagttggggggtgagtgggaaacaaggtttgttaagccccttgtagttgccatcttcttaatgaccctgtaatgtagtcactccccttattccacagaaaaggaaactgaggcacagaggggtggggctgttgccatagtaacctgcctggcattgctggggttggcactcatgtccccagactgggttctttgtgctgagccaggtgtgtccaggttgggaaatggaacaactgactgataggcaattctgggcgggatgcggacctcccagaggactcgccgcctcctcctctctcctgtccccgccccgcgtctcagcacacagagcatgttatatgggatggggaatgatgctgttctttgtttaaaggacagcagaactctccaaggggtagcaggctgggaattgattggaataggtccccagtttatctgacatctggggggctctctttccctgggagtttcgtgcacctgccatttgcaaaggaataaagcatccccggcagcctctgccaggcagcaccatgctatgcataaccctgctgtcatcccccagccttccctgtctcgtcccactgaatttcattgcctgtctgaagaatcccagggaatttggcctctttcccagtcaggctccaaagattcttcatgctccattctaggacgtggggaggttgcctttgccaccccttgcttgttcacctctccagctgtggggcaccctcacccacagcctgctcaggagatagctgagactccagatgcaccagctccgtggcctccctccacctccttgttaagagtgtcttttggatcagacacccagacctttgtccaggtaggagttagcttttcacatcatctctgaggaagaggcggtaaatactctctccactttacatataggacaaaatgaggctgccccctaaaaaaaaaattaaattcaggctgccaaacaaaacggggatgtgatttgaacttcatcagcaacttagctgcgagtgccgggaccctaaactcctgagggcagggactgtatgtgacccgtcttctctgcctggtgtcctgtctgcacaatgcctggcactcaggacatgccagagactgttggttgaacagatgtgtccttgcctgactcttcatctgcctcaccgcgcctgcccttggagcacttctgggaatgggtaaatacaggagtaacatggagaccgtacatcccacttcccggcagcctttctcatacgatcacagtgagttctcatcctcctttgcccattctacagatgaagaatggagctttgaagaggttagacaacttctcaaggtcacttagccaaggagggctgaccctgagcttgaatccagagctttgggatcaggattggcagggagtaacctggcaacatcagtgccactgttgtgggggccagtggtgagggcctgtgaggggcacagatggcggcagcagagagtctttacaagtctccatcgaaaccctgtcagggaagagaggaaaggccagcattgtggtttgcacagctgggctgtttctgaagcatcttaataaataacaggccttcccagggcttcttcccaacctgccacagcctccagctccctagaaagccttctcaaaacaggtgacaggaagacgggttggcagcaccttcccagagctgtctctatcaggccagtcccttgggctccaactccactaccctctccttcctatgaagaaaaaaaaaaaaaaaagcacagacacacaaccagcatcagcttccctctcctaatccctgagacacgtgtctctggaccttcccaggcactgtgcccactgcctccagctgagtttgtcctccgaggcagcctggtctcatggtaagagggttggatagaaatcagaaaactgagatcagaattctggtcccagctgtgtccccgtgtctctgtttgctgagtaagtcatgtcaccaatctgcaatgcgaggaggtggatgggaggctctccctcctttttggcctgggtggtgagtaacctatgcaggaaagtcttccggggttgtagtcaagccatccccgagttgaatatcccatcagccagtacagaaaccagcagcacggggccttggactggttacaaagccaacctttccctcgccatcccagtgtgtgaggccagttgctcgtccttcctacctccgattctcctctgtgctggggattataatactttatgggattgtcgtgaggacttacatgagataagccatgtaaaatgtttcgcacattaactggaacacaataagcatttgataaatgttgcccttatcattgcttttgggagcaaacgcctacgtgatgtctttttccatgggaattgagaccacactctgcctcctgcacccccacatcacccccaccccccacatttccctcccccaccccatacacacataccctctgctggctggcatgcctttccaaagacaaggcagaattaagaccctcatgtctcagtgacatcattctggaacccctcctcccaccagggccctaggcatcaaatagctggtgggtgggagaggagggagtgagggagggcaggggtaggtccttggtgcacagtcccttttttctgttttgttctgggcccagattcttgcctgctggagtgcagttcaaagcctgttcccttatgatcatcataatactttgtcttaatgcagccacaaggctctgaggagttcaaagcgttttactagatctgttttctgggccttgggatcttaagggaattgctcctccacctccaaaatgaaaacaaaggctcttacagagcccagtgtaacatttgtgagggtttaatgtgtccgaggctcgggcctgagcccttcacacgtggcctcttgtaatccttgccttggacctgagtgctggctgctgtgataattctaacttctcaattgaggaaactgaggccaagacaactggccacatggagaagtccatgaattagggaagcagactcaggcctggtggtctctgaacccaggtcttggtctctgtgcatcctatccggctttcgagggtggtggggaggaggggggattctcttattccacccaagggagcttccgtctctaccttaaaagaacgttctcgagggagtcaggggaggtgatggactcagaagtgttcttttattttagatgggatcattgaagcccaaagaggctgagaaacctgctcaggttatgatctgtctccttaatgctgtcagtggggccagaccccccgaccccacttccagcccacatctccgtgccttcctgcttctgcccaggtgtctctagaggcagctctgtggaccctcaggggcttcatcctctctcccctccaggccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggtgggagcctccctctctcccccaccccctgctgagctccaccctcccccctccttgccttgagggtcctcctgagctgaggctgacggagccccgggctggacctgaactcttacaaacctctctctgtgcttctgttttcaatgagcggttcccgaaaaatgaaagaagaaagcagggtgagggtgatgtcgttttcagcactggggcagcagggcagtaggcaacggagacacctagatgctgccaaacttagaccctgctaagggctctgtggagaggtctgcgggttcctaggaggggctagggtggggcacctaaggggcttgggcagaggctgtctgccaaatggtatagaaatggttccgtagtttaacaacaggaccatcacaccagtgtgtactgctgaatgccagctctgtctttagtcctgacacggtgcacaacagttacacagcacttctgtgtagtcgatctcccagcgtagagctctcagcaatgacatgaggtaggtataatgtcttccctcacagaagagggaactgagactctgggagatgaacagatgcgtccaaggcccagccctgagtggagcagggctgagcctgcacaaccctctcttatctgcaaatcaggtagtgtctcctaagctcctggagttggaggggcagtgccagcccctgagtcagaacatgcacactggaaaccagaactctgtgagtgaggctgatccaagagagagagacgtcgggagcctaggggccccacacaggacaaactgctggaaatagctgggtagcatcggagtcacctgacgtcagttcctgggctggtggctgggctgggcatgaacttcggagagaacgggccccgtttccaggctccttggcggctcccccaacctctccaggcgcactggcctcttctaatgccattttaattgcacgtttaagcacaacctgccgtcttccactgggggagcgaggctcctcgttaacctctgccaagctgtgaggagcccgcagacactcagatgattgtctcccctccttccctccctccctcccagctgcccctcctcagctcgtttttgactcagagttaataagagatttgaatgagttctctcagtactgagggctgtcccttcagcccgttgctatagtaatcttccagagctccaaagccatgtctgtctgtgtgcgtatacccaactcacattatctctctctctttctttctctctctctctttctctctgacacacacacacacacacacacggaaacacaatatttttctcttttcttccttttcctctgttttctcttatgcctggagccatgatcaatgaagtcattaagggtagaaaagctccaccaagtttcacgagaggagaggggccctctttagggaaggttgggagcaggcagtgagagcttcagcttagtagatagatgtccctccaccacccttgtggaaggtagctcagaatacacaggttccccctgtggtagctggagcctgcctgaacagcccccaggtagaagcttctgggggccagccttgtgccctccatagctcccagcatctgatgttgcactattattttttttattcgaatagcattactagttcattgttgaaattttggaacatatagaacagaaagcacatagaagaaactaaaaattattcacaatcctatcacccagagctatttaaccactgttaaattttgatgtctgtttttttctgctttacagacacatttttcccccaaattattgtcatactgcacaaacttttctgtaagcgctttttgtccacacttaattctatgccgtgcattttccccatgtcattaaacatttttctagaaatattttaatggctgcctcatttcctatcatacagaggtcccataatttatttaaccatcactttattgttggagatacaggttgtttcaaatcttttgctacaataaataatgctgaggtgcacatctttgtacataaatctttatacacattcatgaatatttccccagcatacatttctagaagtggaattactgagttaaaggtacgcatgcttttaaggattctgatatgatttgccagattgcattttagaaaggctgtaacagtttacactttcgccagcagcatataggtgtcttatagcacccttgccaatactgggtatgttaattaaaaacactttataggtgtgtgtgtgtgtgtgtgtgtgtgtgtgtgtggccatgcttttgaaggaagctctgcctgtagtgtagtgatcattattagcaaatggttctgctcgatgcctcagggctgtctttcctgagctcacctgtcagccccaactcctgtgacattggagccacactgatcaatgagcagcaaggcttcaggaaagcctgttccctttgcccatttgccttcccaatggcccaggcaggcaggcgttccatcaggcctggcctctgtcctcatgcttccctggggctccgtactcttccctccaggagggcacaacagggcctctcagggcctcagcaaggatgggaagcagagtgggcagggagcacacggggcctctgggagactcagtgtgcacgtgggagtccagcccctagagcttggcaacactctgccatctcttgatttcaggaggatttgcagagcaatccctgattttattgagcggctgttccagcaacgaactccatgtttacccagaaatcaggccttaaaaaccaaggatctcttgtcttttatctctaggacagcagatttcacaaagcgggttttagctccccactgtgaccccgcccggaccctctgcccccagcctgtcgctgtaagcagcgggctcgctccgtgggtcgcatccgtctaggcaggggtgagatgcagcagcactcttacttggacagtgtgattgtgtgtgtgcagtggggcgtaggatgggttggtcatcttgccacatcatcctcttgaaagtgaaggaggaaatatagcttggcctggaggaagaaggagcctcaccaaagaggctttgagctcccttgtgccctgagactcctgccccagtcactgagcatttgccctccagcttcccattggaacaaccatgatagagttacccccgacctgctcctcagggagcctgcaagtgttcctataagaatcctataagattacaggcgcggtgcctcacgcctgtaatcccagcactttgggaggccaaggcaggcagatcacttgaggtcaagagttcaagaccagcctggccaatatggcgaaatcccatctctactaaaaatacaaaaattagccaggtgtggtcgtgggtgcctgtaatttcagctacctggcagcctgaggcaggagaatcacttgaacccaggaggcggaggttgcagtgagccatgatcgcgccaatgcactccagcctgggtgacagagtgagactctgactcaaagaaaaaacaaacaaacaaacaaaaaaagaagctcacaaaattatttgagttccttgggagatgaacactatgtaagaggaaaaatgtaatcatccttggtctggtttctcctccatccacctcaatagtcatgacaaaacgggtctcccagtggcccagggctgcagaatacattatgaaaatctagccgactgtcaggagggatgagggtccccagagagaacggggctcattattttcctgatctacgtgtcagtttctatagtacctgtcacactcaaagccaggcacactgacggggaaggttggctaggggtatttatgacgggtacaaagatcagacaaaagggagactcttctgatgtagcagttctcaactgtggagtgatgccacactgatgcgctgtgatcaagggtgaggcatgccacaggcaactgattccttacgacaaataaaggacccaagtttgcaaatgagtcacttgtttccgacgtcactgcagattcaagaatacccttatgactctgccctgcactctgacagagtggagttgatttgcattgctacaacctacggactctcttatctatgccagggccccaaagagagttgtgtttgtggttccatcagtgtgacagtcctgaagggggagtatagagtttggataaaagcactgaaattaggctgcctggatttgcttttatcttttccattaatgagacatgtgatcttgtgcaagtcacttagcctttcgttgtgtcagtttcctcagctgtaaaatggggttggggaggaataatagcgccaacctcatagagttatcccatgtagaatgcttgagagtgcctgacacatactaaacagtgggttagtgttagccattgttattgttaatagctgtggagatcattattgtagtcttttttattatttgcttcatttccctaaaagtcattttggtttcagtaatgtctggctatatccatgggagtatgttgtgtacaagaacaccagctactacgcatgccactgcaggggtagggggccaggcggaggtggagagaccccgctcttgagaccagaatttctgtgctccatcctctaagatcaagggcaacataagaactaatcaagatgttctgttctgcctggtgccaaggggcagtgggccagacaaatggtagacacttggaacccctactgctcatttgcttcaagtgagtttttgttttcttctctaatctccttctcttcgccttgcaggcagccgaacttgggatggtgtcagcctattacacatacatcttcactaatctggtaagatgttctcacagctcacctccttggaagagagtgttgtcagtggtcaggattgatggattataagggaaaaagcccaggggatgatgagtacaggagatagaagcagaggagcagaagccaaccagagaggcagggcgtcctggaaattctcatcccaataattctgagccacaggagaatgaggatttggggaatctaatgcctccattcaaatgccgctagctacataaagcgaattctgggctgtagtgtgatggacgagcctcctcagtaggtccagttactggcctgcagtctagtctctacatggacttagggatcaggtgtcctaaaaagtcctgtgaggtttagaagatgacagcccagagagacaggcttggactctgagatccttgttcttttccagctgtcggtgtctatgaacagtcctttccaggggctgctgtgggattgttaaccctgtagcatctgacaggcctttgttctcagagttgaaacagaccttagaggaatttagtgtgacctttcttctggtatagggactcccacaacaggcttgtcaggaagccgttcagccttctcttgaacttgagtagaagtgcctagtttgccaccaccatccaaatacctgccccattgttgggcatcttcatggtagtctagcgtgcacatagatgaaagccacacatattatatgcgcgtagcttaagaaaactttttccaagtaagcacacctgtgtaagcagcacacagctccagaaatagagcattaccagcaccccagaatccccctcatgcccctcaaaacataaaacagatgaacttgtttcctttttttttttttaacctaacactgctgctataaattagagcattaatatgtaaaaagggagaaaaggattagactactcccagagcaaagcaaaagcatttgcttaaagtaaggaggcatctgggggagcctgggcaagttggcaaaggagcaaagagagattaaagtacagttgtgttccattttgggagcctgggaaatagaaggaggagagggaaaaggcaggccagtgccagcctgccagagaggctccctaaattaggccggcaacatgagtagaggaggaaggaactgggcagcgaggtgtcgctggggtgatttagcagatggaaggaagccattcatttggaatatgagttcccaggacagtcaccggaatgaggtggagttgcttggcttagaggtttttaagacagcatcctccacagtgtaccactatttcccattcatagaaatcataagaatgatggtgatgatattatctagtggaaaaagcactggcctgtgaagtcaggaggcccagagtcaagtcctgactcagccttatgctcactgtgagcctttggttgagtcgcagtgactctctgaaccacagttttctcattttaaaaatgggaacataaaaccttacaagtttattatgaggattaactggaattctgtaagtaaaaatgtattttaaataacaaagtcctatatgtttctaaggcattatatttagaaaaatatatagctctatgatgctttcagttttcaaagagcttttctcctttttgggtgggcatgaatgagatcagctttgggaattaacaggactcatggaattaacagtttgtaagtttgcaagaggaaatcatgatgaaaagtaactgtataaatgatgctggttgaataatagtcaagaaaacgacagcagaaccattgcaaaaatctgccagtaagagaatattctagaagcttctcatgagtgtgttggctttctaaaagggacaaacctctaataggagtaaagaaactgtttttaggaccactctttctgcccagttgcagttggtgttttttttgtttgtttgctttttattttgtttttgtgtgtgtgtgttttgtttttgctttttttgagacagaatctcgctctgtcacccaggctgaagtgcagtagtgccatcttgattcaccttccaacctctgcctcccaggttcaagccattctcctgcctccgcctcccaagtagctgggattacaggcacacgccaccatgcctcgctaatttttgtatttttagtagagacggcgtttcacaacattggctaggctgctctcaaactcctgacttcaggtgatctgcctgccttggcctccaaaaaaggctgggattacaggtgtgagccactgcatctggcccagttggtgttttgggccatagagggaggggcttcatccagagggtaatgagttgtcttctgcattctccagtcccttctccccaatacagatgccagctgggttttcattcttatttcttctttctctgaatcccttggggatctccaccatgtctcatcactctgaattctgctacagtgatgcagtaggtcctcagatcagcttttagagaacaagcatggtgaacgggaaaggcatggatggaccttggcattaggtactcatgactcaaaacttttgtttgactagctactggctgtgtgatcctgtgcagtttacttaacctttctgagccccaggaacctcttctgtaagtggacactaatagtacctgcctcgggagataatgtacacatagcaatggactcacaatacgagtttatttaggagaaggtgttattttaagaagtccagcttatgcctcccatgggctaaaatgaatggaagatgcttattttgctccccagccatgcatggcctgtgaaagtgactcctaaaatgccattttatttatttccagataagaaataggactaggtagtatggttattgtgtgtgactgaactgaccattgtagggtttatttgtgtcggtaattactgagtaattgatcaaatgcccatacctcactcccatccaggcataaagaaaagtgattgatttagggcatctgtaataaatgaattaggttgactgctgtggattctgtcagttgattacccatcacaagaattgggacaaaattatccatcacgaatcgaacttctaaaccatcagttcatttgaccctatagaaacacagcttctctctctgtcagggtccagtcagcagaagagtgagtgttctaaccctgagccttgggtgacagaggtgactgatgcaataagaggaactgagccagagagagcggaggctgctcgggggtcacacagccatcacaggcggagctggaagaagctgggcaagtccagggaagggccaggtctctggtgcaggggaagctgggctcagtgacagggtgacagtgaggtgtcaggcaatggagagagacacttctgcaggaggggagagagcagcagacagggacagcccctctccagaacagaggaggaagtcagtgacaggaagtatggagatgaaggcacacagtcagaggaaacagtgaactgacatctgggccttttatttatattatctatttcaaaatgagatctgggtggtcggaactgatgttagagacttgatcagtgaaacagcatcatgcccctgcttctggttctagtgggtcaggaatcattccccacagaggaaatctctgatcaacagacagcaatggcacctggttaaggtgggagctctggggcagagggtcagcttatgaggtccaaatcgtgagaacttgacaggtaaattgacagcacttggccagaggtcgggcacgcagagagcaactatgaggaagtaagtcctggcaggtagactgaggcagggggtcaaaagtccaggccaaagtgaagtggaccgattaaggaacaaattaagagaaataaaattactgtgcagagtcataaaagcatgccaacacagagaactagtttctgccttcatccagaaatcaatctgcctgcctgcctgcctttgtttgcagtttagtggcgttaattatattcttagtgttgtacaaccatcaccactatatatttctaaaacttcatccagccaaacagaaactctgtacccattaagcaatagctccccattccccctccccatggcctgtggtaacctccatgttattttcttctcagtgagtttgcctattctagctaggtgcctcatagaagtggaattatacaatatttatcttttgtgtctagtttatttcactcagcataatgttttctaggttcattcatgttgtagcatgtgtcagaaattgcatttcttttttttaagctttgtattattgtggtgaaatatatgtgacataaaatttgccattgtaaccatatttaagtacacttttcagtggcatgaagtacatccacattgttatgcaaccaccaataccatccacctccagaacatttttcaccttttcagaatgaaactctgtacccattagacgcaaactccccatgtctttttgcacccaggccctggcaaccaccattctaatttctctctgtatggatatgactactctaggtatttcatataagtggaatcatataatatttgtccttttgtgtttggctctgtttacttagattcatgtctttagggttcattcatatgtcagaattgcctgcctttttaaggccaaataatatactatgtgtgtgtagacacacacataccagattttgtgtatccgttcattcatcgatggacacgtgggtcgcctccaccttttggctattgtgaataatgctggcatgaacttgggtgtgcaaatgtctgttcaagtccctgctttcaatccttttgtgtatatgcctaagagtggaattgctgggtcatgtggtaattatccgtttatttattgagaaaccaccgaacattttccagaatgaccacaccatttttcgttcctgtcagcaatgtacaaaggtcccggtttctctgcaaccttgacaatacttgctatttttcatttttaaaaataatagccatctcgatgggtgtcaagtagtcagatgtgttttttatttctatttgaagtgtgcaaattggaagaagcaagaccacatgactgaagttgagagtcctggtgattaagaagctttataatgagggaaagtagctgatgaataaaaatcacatccttacaatcagtcagaagtggtaaaaatccccagttcaggagcttatgagctgggacctttggaggttctctgtcctcatatgtaaaatatgaataataatatccaccttttaaaaatcttggtaagatttaaaaattagcaactgataacactgtacctggtaggtaatgctagctgctataacagataaacccccagatctcatcgtttcacacaatggaagaaaatttcttactcaattgaagttccaaaagggtgtttctggtaagcagcattccataaggttattcaaggccccagtcttcttctagtttataaatgtgtcctcttagagaccagtgttaggaaaacaacatggaagatcatacatgggagggtttatgggtcaggcctggaagtgacacgtattatttcagctcacaattccattggctagaattcatcacatggccacactcacttgtaagggaagctgggaaaggtagtctagccatgtgcccagggagaagaggaaatgagtttaatgatcacaaagcaatctctgccacattattaaattatcaatcatcatcacacatctatttcatgtatactaaaaaagcaactagaatcccaagccctggcttgtctttttagaggataactgatcctaaaagtggaaatcagcacttagttataaggatgtcagcttcccgtgttctcttacccgaggagggcatgcatagggcagttatagatgcactgtgcttattcggctctttactctgcaagggagtctctgtcttccagtcagcctctgggtttggttgggggaaacctttgttgtgcaagactgatggaagtttgaataaaagacataaagaattaagggcctctgggcaaccagtctaccgttgagacagcagggtggttgatgccgtaagagaagagatgaaggaggaagctcaatttgagctaataaatctggagggattatccagcaactaatgaacccagagagatatgcagtcactgcctaacagaaaagataagatcaccctaatctattatcagagagcataggtgggccctgtgcctatggcaggagctgccatctcagcagagagaagtgttgagatttaagggtaaaggtcaaaagtcagggactgccaatgaaagatgggaaataattgggcactggaagcaggaggctgtgtggtctgctgaccactgagctgctacggcattgcaggtggtgtgactagctggactccagcgccaccatttcattgccatgccccaggcagggccagagctccctgctctcggcaccgccgctgtgctggagggtagaatgctatttgtggggtgtcaacagaggcagtgggcacccagagtttttcttttggggaatctagagagaagggactgagagctgggtatgccatgttagaagacagggagaaggagtacatcagcaggaggcctcattattatagagggcaaggccctggactagcagtgaagcagctatggcttcaagttccagtcctgctactaactagctgggtgtatggcaatatcaatagttgatatttacgtgagtaagtgctaataagtgcttcacagttttttcccatttaaacctcacgacaactctagcaggagacacagttttatccctgttttagagatgagcaagttgagaccctcttcactctaccgcctgtatctgggtgagctattttaccttgctgggcttcggttttttatctgaaaaattgtgaggttgtattaggtgatctctaagggccttttcagccttggacctgtttcatcctatatgtggtttggggcatttcagttcacaatgccttggaattggggatgttccctggagtgaggggagaatgccccatcaggttggggagttcgtgtgactcgtggaagcagtttctgttcacccgacaggtcctcagattcccaaactatagtcaggtccaagtgagccctgcagaaataacccctccatgccccagtctctatcttgttttggcagaatggatatatgcagccaattttcctcccctgggttcgttttattgtcagtagacctgagcctatgtttatttttccaaaggtttatcagagagattagccataagtaatttgaaattgctaaaattattacagaaaggggacccagggcagacagagagggaaaaaataattgattccaggaggaaatgagaatgcacacagccccactctttcactccttgctttggtgagttgacgctactcatctttcaggacttacttaaatgtcacttcccccaaggaagtctcccctgacaccccgcaaggttgagtctgctgccacacactctcccagcaccctgtgttcttgtttttgtagcattcatctcaagtgggaatccatttttctacgctaacctttccaccagactttgagcttcataaaagcaagatcaaatcagtcttgttcatcaccatagatccagtggcctcctacatagtaggcactcaataaatattgtatgagtgaagggagcattccataacatctggagttcttggggtagaagggctggccaagtaagataagtcatctctttagatcccacaggaattcagttcatcccaactaagcctcagacacaaaggaacctatctgcgtttcagctggggagagctgggccctattccctgttccgcaggacccccggtacttgcttagcctacatgacaactactccatctggaatacccttcctcccattctgagctggacagatttgaagtcaacgttgtgcaggaccatgtagggtggtttagttcaggatccaagagacacaatttcaggggttctgctgagtgagagtgatgtcaaaacctgaggcccagggttggcaccaagaatgatcactgaggcaggggagggcagaagagtgcaaggacagtcaggctgattgtgacaagtggtctctctgtcacctgggactgtttccttcactggccacaccatgcctgccttggtcagccttgatcatgtggtgtcttcaggccaacacctggcagctgactcatagagccagaacccaagggtctttagaagaaacctctccttcaggttataaaggccattatgaagtgatctagtcctgtcctctgtcccaatggcttggcatatgaggttgggtgagcctgattactgtgttgacactgagaatagagaaagggtttaatggaagctgccagggcctcagatcagagagaacttgagttcctatctgggccctgccgtacattagatgtacatgcggcaagttacttaacctgttggcctatcagttttccctcttgtaaaatggagataatcatgcttatctcataacattattttgtgaagacgatgggaagtttctaatcctgagggttgttagtaaatattatttcccttccctctcttttttctcacttacctgtcaagtatttccatccttagacctcagtttcctgatttactgcctctagctttccaaaactctacagctgttatcagaaacatttcagttggcctctcacctagttgaactgtaattcccaggatgcttgagcctttcagttcttcacggaaaatgcaacaggcacacatgaacatatacacacacatccctatgcacacttctacacacacacacacacacacacacacacacggccagaagttacaatccatcagccagacaactttctagtgccagagcaattgattccaaagtgtagtttattgtaaaattattaagagtatccacatatttcagctttattgagccttttaggagaaccactctgcataatatagtatactttgatgaataaatatgttttagtgcaactagaaaaaagagtgatggagtgaaagctccttgtgtgtcagtctgagctgccaaggtaccaccctacccaatgcaaaccctgagaggtggcaggtctggcggtgacagatgtctcctgggcgtgcttgggcacagcagtttcttacagagatgctattgatccaaacctgtgttttccaaagctgctaaccctcctgtacctattctctgcacatggttgttggaagatggaaatatgttcagaaggagaaaaaacagagagaatcacaaggggattcaggaggcattgactgaagatttattttttgcattgtggaaactgtggctgacagcttgaagttccttggcccaagttataggattataaaatgattagccagctatgattaagcaatttgcatatggaaaatgctaccatcaactacactgagtcagcaaacatctattaagtgcctgctgtgtggtgggagaaacaaggactaggaggatgtggtccagcaggatgtgaattgaagaggtctgcgtctattaatgtgaggtgtggcagcccagaggagagagcatgtagttcttctttgggagtttggatgagggtttacagatatggcttcccttactgaagcatgggttagagatggcaattggagagtgacatgtaggcagtggtaagttatagttccttttgtgcctggagcaggagagtgtgatggagagaggtggacccagagccagccaaggaagtctcaggtgagatgatgtccttctgctatgcacgtttgctggacttttcagcattggaattggcgtcagtaggcccagggtcttgttttggctgtcccactgactgtgtgatcttggacaagccctttcttctctggagacaagctagaaggtctccaaagacctttcaactctgaaattctattgagtttatggattggatgaatacataatgaacaaccagatgaattctcctggtgaattttttccagatgaaatcggccaccctcctcttcacggttttccagtgtcctcatctggctggctcatccctgcagtgccctcagctgtccagatcccccagagtgggggagcacccctgtcttctgagctgtcttgatctctcaccacccccttacccagaagtatctgtcctgtgtcctcacctgctccgtagagccctgacaaatgacagggcaatctgaaaatccagttcgtgccaaggtgctaatgtccatgacaacattaaattcttttggattgttgagagcatctaactaaatctcatccttctacagttgagtaaacagaactgaagagggaaagtgacttggccaggctctcacagtgagtcaggagtagagagaggaggtctcctcactcacacagttcacacattccctagatcagcattaactgagcacttactgtgctgtgtgttggggatacaatgaagaataaaattctgattttccaggaggtcagactagaggggaagaagaacacaagcagattatcataaatcagtgggttcaataaagtgatgaagatatgcacagggtattagggggccatcaaaggaaggcctccagactagcctggcaggttcatcaaaagcttcctggaataggccaatccaaagggccttggagaatcaatgggagttagtcaggtagagaaggacattctaagtgggggatacacacagttaatggctcatgcatcccagacatttgctttttagctaaggccttaaccaaggaagcagattgcatgagaaattgtggagcttgtaaggaaggtattttggaggtggggagaacctttcagaactttcatattactccccatggacagccaacttactatcctatgtaaggcaggggaagaggaaaggcatattcccaagtggacctgagttagcacctttagcttggtggtggcttgtcacaaatgcctgtcccaggctaaatatcataaaatcccagacccagggattaccacttggatagctgtcaataggtgtccctcttccagggaatgggccctactggcctaaaaagagaatggaaaccagagcttccctagggcaggagcagggagattaggccagtcctaaagatggcatagccttggttcgcttccagtgccagctaggaataagtatctgaaaggtgaactttattctgccaacactggagtgcatccctgttcctgaccctggaagccttctcaccctgagatccaagtcatgagaaactccctcctggaggaggaatgctgcagggaggatggctgggcagccgttgagggggcaggggatgtagtaggcacaggtacagactgactctaagatgctatgtgccattgacgaactacatccagagctccaggagaccccaggtgggcagggcttacctcctatgctctgttcacctttctttttgtcagcatttataggtggccgctctttcctcagtacttctgactttccctctccttatgctaacagtacctagcgcaggctctggttcagggggcatttgaatcaagccactgccttacttggctggtgggtatgtggctgttcacccattcctgttgggctaggggaagaggaaaaagtggtatcagagaagggacccttcccttggcaagctcaggtgatcagaagaatcaccccaagctgcatgggaactttccccaagagtaccccaatattaggctgttctatttgggtcccttcatctgctctccacccacagcaagagttggtctcagctgggactgatgaatcagtatatccaggggggaaatgaggcattattgtcagttatcctggaagaatagccagacactgtaccctggggatgcaggatcactaaaaatgaaaattaaccaattaggtctttatcccacccagagctagggtaggggaggaggagccagcccctgggcctttcagtgagatctggttatccaaggtgaggcaggagttgccagataccctcaattcctaaccgagggggacagggggtgtgagaacagaatggatattgccaggaagtcaatagaaactgaagaagcattcaacaggggatgttgagaccctggtggaggtaaagaaactcttctttgcttcggaggaaccaattatcagacaacccctttgctgatgtttgacaaatagcatgacagggaagataagtcccacggggctcccagagctgagtttgagatacttgtgtagcatccatttaataaaaattgaaacgcattgcttgtatctgcccccaacgcgcgcacacacacacacacacacatttctatgcccatgtgccttggtgagtgggtgcatcagactgtgcatataaaatacatcaaactgaaataagaacaagaccctggagactactgtggttcagtatctctggacacataatggaaatgctcccctttgactgcccaggccttctatctaatagagctttgggagaaaaggaagctgccttgaccctctatcacaaagttgttaaagattcagaagttgcattaatttaatgagagatgcctcggccttccgtctactgatccaacaatttccaattattcacaatcaagagagtctaataataaaaatctacccatttcccaaagctggtattctcacaataggcgctgctggctcttgagtaccagcaatgtaccagatgccatgcccagcaccttctactcaagatctttaaccctcaaaataacactgcaaagtgggtgttccaattctacacagtatgaaagtgaggctcagagatgttcaagggtcttcactcaataagtggcagatgtgagaatctgctttttacctcccagtctacatcttgtacttgtcaaactgatctttttggcttttctgtgctctattggtttctattgttgtgtgacaaattaccacaaagttagcaccttaaaacaggagcatttattagtgcaaagtcatataggtcagaagtccagcatggcatgactggctctttgctcaggctgaaatctaagtgtcaccaactacattttcatctggagcacaaggtccccctgcaagttcattcctgtggttggcagaatctacttccttgtggttataggaatgaaatctgttttcttgctggctcttggctagggacagcctagcctcaagagaccattcttgggtcctttccccatgactgctccatctcatcaacagggaacctccctgtagtccagtttctctcttagttcatatctccttggcttcctcttctgcaaacagccagtgaaaactctttgcttttaaaggactcttaggccaggctcatctggataatctccttctttgaaggcaactgcgtcatatagcgtaacctaattgagaggtaaaattcatcgtagtcacagtcctggggagtgtgtgtgtgtgtttgtgtgatgtgtgtttcttgggggtcatcttagaatcctgcctaccacacatgccaactgtgtaaattagtttattttcttttcctttctcctctaccatctggtgaaatggtatacaaggagagatctggggccagggcaccaggaggagagtgctggagacacttgaggcaggaaatccatacatcccttgatcatgcaaatgataaactctgtgttgtctctgctgaagcaaggcagagctcagggcagggcccatcccttgcctcctgatgatggcctgtaaaccagcccctgagggaaaactgacagccaaggcaaagggggaaaccaaggcctctctcttgaaactgctgtggctagcagggaggctggtggccctgaggaatttgggccctgctgagaagagtgtttgagatttaatgaatgtttggaaagcagaaggagactgaaaataaaaggcattatggcaaatcacattattattattattattattattattattattacattataagtgctattgtattacaagcaccattaggagtagcaattgctgttattattaagcaatccagcttctccatcctcagcatcaggcttcactccatgtcaaaggcgtcaacagctccgtaaatcaccatctggggcttccctcacattcatagcccagtggcaagcctgatgcctgcccatcccactgaagcctccagccatagctcatgtggtagacgcatctcctgtgaattccaaagctggatttttatcttggccaagagttgagatagtcctaaacccattcctgatcatattgctctcttgcttaaaacccttcagtggctgtctccccattaccctcaggataaagtctgaactccttaacataactcctgtgacctcctattccctatcacccactgcaccccccagccatactgaatgacttgcaggtccctgaatctgttataagctcttgctgttctggggctctgcacatgctgtggtttctctgttcgtgaaactcctcttcccacctctttatctggctgactcctgctcagctttcaggtctcaacttgcagtcagctctcagctcaggaatatcagcagcaattctggtagaaaagaccaccttatacgtgccatgccgtgtaattaactactcttcaggacttaccttccacctgctactaagtttaagcatcttgaggacaggcatggagtgtgcttatcattctatttctagtgcccaacatgttgtgtgttctcaaggagacactcatgtttttgttgaatgaatgaaggaatgagtgagactaactaagatctaaaaagtgtccaagagctgaaaatctgttatgcatatccctgcccctcccccgcccccactgtgggaacctatctgagagcctggtggcctctggaacacagcagagtcagcaagatgctcagtccttgtggagaacccattatttgatcctgctgccaatgtggagcacataaattagtaaggaggcagagtccactgattaacagcatcgctcatcttcctaaacaactccttgtacccctggtgggatggtggagctgggggtgcctgggatctctacgtgcctgaggctaatgtgttgggacctgggaaaggagaggtttagcaactgatgtatagacaggaggcctgaccagtgaatgctgatcagtgcctgaagaaggaagcaagcctgcagaaaagcggtagctcactgcagcctaaggggagagcccgaggtgtccactagttctcattgtcaacttgacttactgaggcttcagctacacagttaaccacacagttaataactacttatttagcacctagagacccagaacagtgttgtaaataaaaaaatgaagacagacccagctgctgctgaggaggtaagagggctttccacctggcctctgccttcctcttcctggaagcatatgactgaggtctttgtaaaggcagttctaccctgatgggtgtttgcaggtgaacatgaattaatttaatgaatgtgtattgagcacttgctaagcgcaagtgtaggatatagtgaaggggatagagcatgaacaagaaggaatatggtctgcctttgaagtcctgtttgtggactcatgttgggaaagaagagcagagaaaggacagagttcctgggaggaagggatgtgcatgtccaggttatggggtaaatgaataggaaacatgcagggagaagaatccaaagctgggagatttaggaccaaatctcctattaaatagaattcattgacaggtgtgaattagcctcccagctgctactgtcttcaaagacctacaacacaaaaagccatctcccagcctacacagagagcacaggctttgatgcagataaatagacagacgggtaccgcagtcaagtgggctcaggagggaaggagaggatgtaagggtgcccaggagattttggacttctggtggctccagggctttcctgcaaaaaggctaagagaggacttctgagacaagggtctggggcctggcttctgtgatgcattagatctagctatgaagaagagccttgggcaggtgaaaggaccaggctgccaatggggtgagatgaggcacagcctgacaagtgctgccttcctaaatgtttttagtcaacagccttgacttctttctatatggggtgcaccagagtgaacactgataatgtaagtgcatttctttcaaatggcatctagtccttggagaggtagctttgaacaaactcgtgataaaaagctccaagtgatgacaggtatgtagatgaggtgtaaagggggcattattgagtggccgcttcttccaggcttgggagatgcaggaggtcaaggtggacactgaggaaaaggtaggcaggaatcatagcatgaaaagacttgtgtgtctagccaaggggtttctgtcctgtattcagtaaaggagtattcggcgagggggaagttcatgatcaaatgtggagtttaaaaagatctctccagcaataacatggagaaggaacttggagaagtgcaagactaaaggaggagaaaccagtgagtccgtagtctaggtaccaagctggtgaggatctgatttgagttagagatgatggggtggagggcagggatcagattcaagagatgtaaaggaattataatgtcctcaaatgacaataaatgagtgcatacctgcttacatgaatgaatgaatgagatgtggacagtgagagcatggaaggggaggatgcattctaaattctagcttgattgacaggtggatcatgtgacattcacaaacagggaaccaagggagggaagcagatccaagtggcaagataaggagttcaagttaaagagcgatacggtcttaaggatatcttcctccttttcagcttcataataatattttaagaaattagaatcgtttagtgtttcaggactcctggggtgagaacatttgaagttgtcaatcattaacaatcacagtgatggagtatgctttgacaccacctcctagtggcctagcccagtgctgagcacacagtagggaagatagaataatcactggtcttatttgccaaggacctggatcttaattccatgtctgtcttaggggcaagacatttaactcctgggcacctcagtttgctcttctaccacatgtgaaaatgaataaaacctgttctgttcacttccaattgtggtcgggagccccaaaagcagtgcatgaaagtgccctgtaagcttcattcagccacatccgtggaagcagttgatgttattatactcagtaataaattgatatttcataaatcactttgatgtgggtgacatgaggctgccagcctcctctcccaggcagttagggtccagggctgagcatggagcagagaggatcagaggctgaggcttgggtgaaagcaggcaagaaatgagggactgcttgaaaccccactgttaagggggttaaggattttaaacaccactgttaggaagcagagccagttctggagtgaagaggctgcaaatagggccagttataacccaaatgggtgcaagcgttaacacttggagagatttcagaggtcacagaggtgttggagtgacaccttttataggttgcctgtggccctgctgggaagggagctgttaaggttcttggactacctggggctgagggctttatgcagacgccggagacagccagccacctttgtggcgtgatctggtgggcttcaggaaggcctccgcacactgccttcctcactacctgctaatgatccctgaaagtgcatgaaacatgcattccttgagctattctattattacttctaataatactaataaggagtctgtatcatacttccagtctgcacagagctctcctatgtattatcttttttgagtctcacaatggcacagtgaagtcttatttcccccattttaaaatgaggaaacttttctgattaaaaaagagaaaaataaagaaattaaaagatttttttttaaagattggtttttggaatgtgggctttcagagaggaacatctaggtcaaaatacccaaagacagtgtatgatttaaaatgcggtgactccaaacccatacccactctctccaggacagttattctcctaaccatttaattaagcccaaaaggcaacttttgatttcactgatttttctaggtgccagggacacagcagtgagtgagacagtctattctaccttccaggagttcacaggccagcggggaagcatttgaggctcaaataatgatgaccgtggagagattttactaggggcggctgaggctgctggacagctctcagcagaagttggccaagttcaccaagctgcattcgactgcctgtttctctgagccatcttagccacacaagcctgcagttatactgcattgacttctaattccttcccacctgctgcaccctggtacttgctgtgactccttttctgggttcttcatgctgaacagatgcgatgtgaggcaaacctcagctctctcatgttctcagtgaagtgctcagttttgcctggcgcacagttggtggtcagtaaattgtagtagttattattagaattattgctttcttgtgattattcatggttggaagatctggaacttcaactaaaggcttctctctcaacacaaatagccagaccaagcaattagcatcttatggtgacttttttttttttttttcgagacagagtctctgttgcccaggctggagtgcagtggcaccatcttggctcactgcgactctgcctcctgggttcaagcgattatcctgcctcagactcccaagtagctgggactacaggcagatgccacacaaccacgcccagctaatttttgtatttttagtagagatggggtttcaccatattggccaggctggtcccggactcctgactccaggtaatgccccggccttggcctcgcaaaatgctgggattataggcgtgagccaccacgcccggcctatggtgacttatttagcaaaacttttcccatttgacaagtagctaagagtcacctcttgccaaacaaagaggaagagaaagaggaaggcgaagcctccaggccagatctttccttttggcagggcccagcagttcagggggaccaggaaaaggaaggagattggggcagtgcacccactttggtgacaccggcagcacggaggatggattgcacttggacagaagaggactcccaggccatgagtacctgtgtgccaggcacttctcatggattacctgtgcaaggtagatgctcttacccgcactttacaggtgaacacatcgaaagttcagagatccgcctgaaatcagccagccagtatgtggccaaatgagggtttgaaaccaggactgtcttatttcaaaacttgtgctctttctaatacatgctactgtttcctgatgagattgccacattgcacaatgtggcaccaaggggcaccattcacatggtcatcagtataaatggcacctgggaattgaacagcatagtggctaggtatcctaagatcagaggcacgatctccattaaatagcagctattgcagaggagaaatgacgaggacctaacctggaggggttggaaaggaagggacaacttcgagagacatttaagagatagatttgacagaattggcagttgactgggtgtggagttaagaaataagggagttgaggctgtctctgaagtttctagcttaggtgcctgggagaatagtaatgcccttattggttaggaaggcaaaggggaaggggctgttgggcagaaaacatcacggaatgccacttcccctgcttacccatttgacctgggttaggagatgaacttgatttaagggtaccacctggacctgtgctttggtttcttgcttttctacttaaggtcaaactcagaaacaatctgggccattaaaagttcttgtgcttttagctgtagttgactaacctggtcctgtcctcaggattgactaaatcccacccccagtgatgggacttgcctgcttagcccagctgaacatgtccccggggccctgcttcccctagacctcccttgcagaagctgcccacaaggtctgcccaacctttcccttatccctccatgttcccagacaccagacactaaagctctacatttcttggcactggaccctgtgtggtataaggcatggtcggccccttgcagccatggtaatctcacagtttcccagaccctctcttcctctcttcctccaacaaaactacctgagctctaggacctccacctgtctggggccatgcccaactcagcccccactcagagcctgtccttgctccctggcccaggcgatgaacaggctgtagacccataaagcttcctgcagcttgcagtgaatggatgcctgtttgtaaaccaggacattggacatggcacgtctgctgcagaaagtgaggggcgcccttccacgtagctctcaagccattatccgtgaagcattccttcatctcagggtaacatctgcccgtatccacttgtggctctgacctgaccttcaactatagctatttggacccttacataccattgtatacacaaagatttgcacacatgtatgcacacatgcacacacacacacacacacacacacttttaaaaatgtttttcatgtgaaagcccagtgatgataaagcaagctgtcaggatttaaaaaaaaaatacaataatgcaattcacagaggacagtcagtggttagcacagcttctactcatgtttttacaccttctggaggtgtgacagggtgtgcttggtgttagagttggccacagtgagaccccaaggcattaagatgtcttcaatcaactgtcctcaaaacagcgttgaccaaacagcttttaggtaccaagcactctctagatgcagtgtgaacttcaaaaatgaggcagacatatctttgcttcctggaaacacacagccccctgtagagagagaccacatgtgtgaacaaacaatgcaacatggggtccatcacaaagccacccacacttggagtagtggaagacctggtcctggtctctgccccaccacttggctttaccaggtcccatttgctctgttcttcaccctcattccctggtttgggacaatgggagtcgattcctgttgggagcagggaccctcaggatatcccttcctgggatatttataagaagaggatcaaggtccccatgagaacctgttccacccgagggactgttcctttctgtcattgtatgaaggttacaaccagccaggcagtgtggctggggcggggttggggaggcataatgggagcctaagtgagccaggtgtgcattcttaggtagggctcaagatgggtgggcagcggaaactgggtgaactttaatcccttccattcctgaaatgtgttcgttttatgaaatatctctctccgcaaaatgtctccaccacttgactttggatttctaagaaatgtttctctgaatagatgtagagtagcatttcccagattgcgttctgaagcacgccactgccaggcactcatggattttggaggagaaaaaaaaacccatagtcctgctttgttccatggtcagtgtgtttgggaagttcagggttaaacaaaattaaaccagctgcttcactgctggactcttttcagcctttaatatgctagtgattattacgaatcttgaaaaggcagatataatatgcattgttttccagccttatctgagcatggaaccttgtcttcatgaaatttctgttggtgtcacctggaaacctaatgccctgaggaacacactttgataaatactggcacataagatgttcattgtttgtaaactaacggtggtcagttatttcccatattcttttagacaatagtcttcaatagcagcaggaaagtcttaagtttagataaaaaggagaatttcctaactgtaaggattcttagatactagaaccttagagtgtcgtgggaaatggcagtaaaagaatgtgcccctcccccttccttgtccttccacaggctatcccatgagtcattataaatagaatgaattatcaaggaagcttctggaatctttttatcttaagaggcctttgaaagttgcatagaattgtgggacaagaaggtaggaataaaaaggcaggaagacagactggctgacttctgggtagactgtctctaagtgtctgtaattaactcattcattcttactccgcccagaacatgcatttgaagggaatacctttctaacttgtggaactgaagaggcagaaagccagaagctaccccagatttcacggtggtctttcagtagctgtcgtatttgccaaataggaggctaagctttacatgcatcttacttgtttcttgaaataacctataaggttgctaatattgtttctttttaaaaaacaaggatctgaagcccagaaggttacagaccttgccgaaagtcaaacagccagtatggtaaggaacctggatttgaacaccaaagcctgaatccactatatcaccccagctgccactgtgaatctgtggacatccagagcctcagggcttccttaaaatgagccttcatccatcgggctctgtgtgtggggagaggatggagttgggctgatgtgtctgcccacaatgataaggaagccagggaagaggacattttccagcccctgccaaccatgcccagccaggccccttggtttgcccacaacagtctggctctgccccagtccctgcacccttgccaaatgcatcttcttccattagccatctgcccccttgtgcctaccgatagcccacagcacatgggcagctgccctgttagagagataggagataatatcagtgtaggaatcaatacattctctggcatgtcctttttcccctaatgggaatgtggcaggatccaaaatacacttaaaccttatccaaatccactctgtcaggcattggtggcttcaaaggaagcttggtacctccagtttgcacgtgtaagctaatgaagccgggctctgggtaggtgagctgaggcctgtaacctgaggccttggcagtgtctggagctgtgtggcaaggatgcaagggtggcgccaggggcctacagcagctaagtcttcagaagaggagactgcctggaggaaagcaatctttcttcctggccagaaggaaagcctaaggcacttgccatctgtcatgtcaggctgagtggctgacgggctagtcctagggtctggaagtcctgtgtacccccagggtgtggatctgtgtgcaaggcacttggaatgaacatgaaatgaatgtgatttttgtgtgaaaaggtggcctgacgcacatttgaaggcatctttccgggagcggggatcagtgagctgaataatctacaccctcttgactggtttcgctgtacagggcccagggagaccttgggggccagggctcagagctcagaggaggacactgcccctctctataacactaactggcctcggtgcactcacacctgcaggctaacacgtggccccaccagcgttattgcatgaggaccatgggttgcagggagaactcctttgagcttctaaatgtcactgcctttagatgggatttccctgactgcgtcatctaaagtagcagtccctcaccccaagtcccatccccatagctatatgaaatgacgatgaatttgtttccttactatctgtctcttccactaactgcaagcttcctgagggcagcaagtgtgtctctctcatccatatcctccatgcctagaaccatgtctggcacatgataaatgcttaaatgtgtatcaagtgaatgaaaaaattagtggtaaatgaaagcaccaccctacccgcaaaccttcgggttgaggttcttagaaagcaaacttggttttggcattcctccactgacagttcccctgggtcccatcacacataggacaaagggcacattcccaagcctggcatcctgactcttatggtctggtctctgctgactgccccagcttcgtttctcaccatccctctcccaggcccccttgtatccagtgtgctaacccacacttcaggtgtataagacttagggtcctgctggaaatgcaagctcctgggcctcagctccccagattcggattcaggtagtgttaggtagggttcagaaatcatcctcttttttttttttttttttttttttttttttttgagacagagctttgctcttcttgcccaggctggagtgcaatggcacaatctcggctcactgcaacctccgcctcctgggttcaagcgattctcctgcctcaccctcccaagtagctgggattacaggaatgcaccaccacatccggctagttttgtatttttagtagagatggggtttcaccatgttggtcagtctggtcttgaactcctgacctcaagtgatccatccttctcggcctcccaaagtgctgggattatgagcgtgagccactgcacccggccctatcattttttaaaaaggaacctggatgatgctgatggtagaatcacactttaagaagtgatgtcttcatcaaagtacaagcacaccatgggcagttcactgaaagggccatgcactttctcagctctgccctatacatggggatttctggctggaggagcctttgaccactcacaattctccacccagaaaatgcctatgtatccttcaagacacagttcaagcatcccacctcccgtggaaaaaaccctgtgtgcctagtgctgcccccactaggcacatggcttttttctttctctctctagctagtgcatcttgtatataacttgtgtagagatcattctgctattttttttctcctccatcctccaccatcacagtgttaactcctagaaaaactgctctcattaactctggacccctaggtcccaacagagtgtctggtgttcactggactagaatgtggtacccagatatgctttaccaaagtccatccctcacttcaccccttcctaactacattcttatttctgatgctgggtctttccaggagttctcactccagagaatggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcggtaagtacccgccagagctcttcctggtgccccttggcctctgcacattgcccctctgtgggccaacccctgggcaacacatcttcttggagtccagccgtctcctgctccagtcccagctcagaaagggaggtagagaggtgtgggaagtggttgcagggtatgaggtttgggaagcaatgagctgtagacagcagggagggggctgtgtagaggcactgagttgtcacttagtgatggctgcaagtcccctgtggccagactctcaataatacaattgccgagagctgcctgagtttaggatccaagaatcggttggaagggcctttaagctgatctgctccctcatttttcagataaggaaactaaagcccagactggaatgggatgtggagtggggatgtgggggtcttgttcaagggcaaacatcgaggctgttgcagagtggaactagaccccaggaatcctggctcctggtctggtgctctgtccaccccctggccacttcctgcgtcacggctcatccagaatggctcccttctgcccagtccctctgcttcctctctgcagttctggccccttccggcatgtgtgacgggagcaaacctttccatggccattctccactgagttggatgttcttctccgtggggcaggccaagaatatctgcttgtgtacatttgttaaaaggcaagttctcaggagactaggattatgtggctttttatgccctgtcctagccccattatacacaatattttatttttaaaagccccatgaggcagcccttgtgatgctaaccccaacttcctgaggcagctactatcagtatctccatttcacagatgataaaaccgaagcccagaaaggttaggcaaatagcccagggtcacatagccagtgagcagaggaccaggatcagaacccaggccgtatggctttacagtttatatttttaacctctgttccactgtgcatctctctaggactgtcatttccttgccacgctgtactgtaattgagcctggctagatggaagtacagtgatacatgcgtaatgacattttggtcagcgatggacaacttatatgatggtggtcccatagatgataataccacatttttcttgtcccttttctatgtttgggtatgtttagatatgcaaatacttaccactgtgttgctgttaactacattattcagtacagtcacataccgtacaggtttgtagcctaggagcactacactataccatatagcctaggagtgtagtaggctatagcatctatatttgtgtaagcacacactatgatggtcacacaatgaagaaattgcctgatgatgcatttctcatcatgtgtccccattgttaagcaacacatgactgtagttactaggtatttgttgaatgaatgagtgagtgagtgagtcaggcggaatgatgagttacagatagaaagaagtggaaaagcattaggtctaggagatggcaatggaattgggtacactcctggagtgggaaattctctggtgagtttttaaaataggagcgatgcctgtctctgataagacatgcccagaggcaaaggcatatctagacatctatacacttggcatctaattagtacttggccaacacggtgaccttggaggtggcctgcggaagccagggcctggacttaatgacctttcacaaaactctgtgcttttatgatcatgcagcctcgtggacatctcaggaaggaaggggtagctaaggaggtcagagctcatggaaaactcaggaagctttgatccagggagtgggacagaaggagcgggtttgagaaagagtttcatgcaggtttatggaacccatcccaacaagatattttagacctaaaagaggcaaaaatccatgggaaggactgggaagggcagctgaaggaaggagtcatgtccattaaatggtttaagggacagagagggacatctcaaagcacagtgtcatgtgcaggatcagactcaacccctagcagcaatgcaagccctgttctcccagctgcgtctgctgttcttacagttctcattccagtatttttatttttatttatttatttatttatttatttatttatttatttatttatttttgagatggagtcttgctctttcgcccaggctggagtgcagtggcgcgatctcggctcactgcaagctccgcctcccgggttcacgccattctcctgcctcagcctccggagtagctgggactacaggtgcccgccaccgtgcctggctaattttttgtatttttagtagagatggggtttcaccgtgttagccaggagtgtctcgatctcctgacttcgtgatccgcccgcctcggcctcccaaagtgctgggattacaggcgtgagccatcattccagtattttaataggtgctgacaaacttgaaaggcttgcagtacaatatcaagaaaggagaaaaaaacatctgtctctttcccttcaacccaagcctcaccacatttggcatctggcctagtgaagtaaatggtcccaggctctatttcctcattctctctaagggtatcttcctttgcattgatgctcacattggccacgagcagacagatgagggtccttcggttcctagtgggcttctttgtaaggatccagcacaaaggccaggagtgcctttcacagagctgtgggtcagcgctgccatggtcagacaggctgaaaaggccactggccttggagtcacagagcctggagtcaaatactggccttgacattttctcaccgtgtgatctgaggtagtgacgtaacccccgtgggccgcagattctttttccataactttaggtgaattatacctgaccatcttagagcattattgtgaagacggaatcagatacgattctatttccaattcacaatcattcactaagttaatataacaacctatatatgccagatgctggaataggcattactaaatatatcaggtagcttttgctacataaatactgtgtaacagccaactcctaaatctcatgatacacaataaatatgcatatacgattctatctccaattcacaatcattcactaagttaatataacaacctatatatgccagatgctggaataggcattatcaaatatatcaggtagcttttgctatgtaaatactgtgtaacagccaactcctaaatctcatgatacacaataaatatgcatacaatacacatttatgtagcccgtggacctgtgggtcagcgagggagcagcttgtctaagctggctcagttgggcagctctgctgctctgtctgagatctctcagcatgcaagggttggctaatccagactgggcctacttggggccagtacctctcactcttcccctggaccagcaggccagcccagcatattcttatggtgatggcagaagggcagcaaagcaagtggaaacgcaaagacctcttagtcctaggctcccagaaaggcacactctcattttcttggccaaagaaaggcacacacacaaactcagtgttagggagtgaggaaatgtactctcccttttagaggaaaaaaaatgcaaaggcacatggtaaaaagtctgaatacccgaatacagagtgtgtcttagaccatttgtattgccatcaaggaatactcgaggttgggtgatttgtgaagaaaataggtttatttggttcctggttctgcaagctgtacaagaagcatggtgccggtatctgtttctgatgagggcctcaggacgcttccattcttggtggaaggcaaggggagggggcgtatgcagctcacatggcaagagagaaagcaaaagagagaggggaagaggtgccaggctcttttcaacagccagttcttgtgggaactggagtgaaacttcactcactcctgtgagaatggcacaaagccatttgtgaagcatccaccccctttatccaacccacccgggtcactgccacatgagacttgggaccaaacaaaccatggcagagtgggatgaaggattggctccatcacatagtcacacagtgaagatcaaagccgctgttatccggatgcgccatgcaggagcagggttcacctccacctctgggaaggtgactcctcggcatatgttactctcatggaagcggaggaaagcccctgagttcttcctgcagaggtcggggaaggcttgcccgaaaagagggaagccagtaattcaccgctcttctgtgtgcaaagcaccaggcagggtccacagcatcccaatggagcaggggtcccgtgctgacttgctcagtggactggagagggtgtcctgtcctgaggatgccgcccagggctgtttaaaagatagaaaccctgacctcgtttgtctccttcccagtccaatgtcagacctcccaaggcctcagcatcttatgctccccaagaatgcttgggggatattcagtgagtgggggtgttctctgaggctctcttggtgctgccggcggagaacaagagtaaagatgggctgagctgcaccggctcaaggctgtctcagggaaccatgcgaggagcatccatgtgggcctcaggactgcagctggtccttgtgctgatcagattctgcgtctactttagtcagctttctctcagccaagcccctttggttttcttgccaataaaatggacgagtgttctttcttgctgaggacggcagggctcccaccccactgggtttcacctcggcacagagctgaagactcctgtagcccttcccatgaaattatcctgccttctcctattttccttctcagggcatcctcgtaacagttaagagtggtcatgtagcccttttggacaagtggggaaactgaggcacggacgtgctggatggcacatcaagggtcctctgaggtcagcactccaatataacctggagtagaacgtacatctgtctcccagtgccagagaaccttccagctactgtctctgtggcctccgagagggaagggaaggtgttgcggactctctcacctcagcgtgtggaaaggaagctcacggcagcgacaatagcaacacacctctctcaaggcttctcactttagcaaccagcttttgaaaagtggtgcctcttcctgtctctttgggggctgagaaattcacagcacaaacagcccagctcttttatgttctgggtagctggaaggcgagagggagtcagttccaggaaaaaagcctggttctgtccccaccatcaagcgttctacaaaagctgcagctccagcctcatggggacgttctctctttctctccctcttctccccttctttacccttttctccgtaaccttcttttctgtttctctctctccacacgatgttccctgctctttcttcactcttggcactttcttctctccattgcctttttctcctgacttgggtaagggtctgccgctcttcctcaccttccgggtcgggccttcggcattctaagtggagctttctggagagggagccccgttctaagggcactgagagaggagtggctgaactgagaggtaaccaggaaagcaagatcagtccatgcccccaggccatacctgccaggtggccgacaggagatgcaaatgtgcttctacctgagacaatgcaagcagaagaagggatgtcgcaaatggagacacacacccgctagcttcacacgccgttcccattaatcacgctgcaaagaacaaaaatcctggaaaatcattaaaattacagatggctagattaagtaattagaatttaggctaaagcagatgtttgtaattaagtgtttatttcattgaataaaatccagattgtaagaactattccatgggattttaatggttcctgtcctggtattatattggggggtagagtttaagctgcagaagttcagagacaaatgggcatctgggaggatcctgggaatcccgtcatctggggcatggagagagatgagggttacaggtgtgtatgtaggagatattcttattttcatgtcatgggagggggaaggaactcagccacagctccctgagtcagaactgattcatcttaatttatacagagccttgcattcccctaaacaatttgcaaacagctcaaaagaaaataacaatgaagaaccaaatgaaaatataaaaacaagagaatcgagggttcattgccaagcaacgttttggggccaagaaagaggagaggattttaaatgaggattgagccatttggggtatttaatatttagaagagacagggacaggagaagcagagacaaaagcgagaggcgtgcacacacagatgaggagtagaggccatggaaagacagaaaggaaaaggaaatgtattgagagagcagagaaggggtggaaatgggggggggggcggtgcctccttcccctgatgagcccagaagtggagacatggatggagggctttttttttttgagacggagtcttgctcgcccaggctggagtgcagtggcacaatctcggctcactgcaacctctgcctcctgggttcaagcaattctcctgcctcagcctcccaagtagctgggagtacaggcatgtgccaccatgcccagctatttttttttttgtatttttagtagagatggggtttcaccgtgttggccaggatggtctcgatctcctgacctcgtgatctgctcgcctcggcttcccaaagtgctgagattattataggcgtgagccactgtgtccggccaggagggcttttgtaacagaaactgcttctccctgactgtagccccaaatgctttccagagctaaatgagtaagtaatagcggagggaaaaaacaattaggagagggagaaagatgctttgggatggagatctgaaacaaggtggaaaaattgatgaggcagagagatgacaggctcgcacgccatcagaggagaaattcggtgagggcaggagattggtgactgtgaggagagagctgcaggcacaagggttgggaggtgaattctcagagcagtttgaaggatccaggtgagaagcgtgggcagattggcaggagcctgcagaagacagtgcctggtgatgggtggaggaacccgaggagactgcagcgggggagaagacgtttggggtttagaaagggtcagctctgaccagcccaggctgaaccacagagaggaactgtgaagcccagagcctacgggggacacgtcagtggtttcacccctctgaaggccacacacaggtggagaggagaccacaaccttgaggattttccttctacctgctccctgtgcccagcatccctagctggcattagtactagaagcactcgaagaatcttgaaggccatggaattagagatgccaaagaacattgccaacaggcatgcacggatctcagcatccacatcatgtgctaataagagagcatcagccaagaaaaccatgtcccagacggagtgggaatagtggcaaccgtgtggcaggaaccagctgggggcctggtgggaggatgtgagaaatggcgtggtgcttcctctgcaaatctgccgtgatgacggtctcttggggaccagcacacagcctcactggaggaagagggggcctggggagggggcctgtagacactggggactggtgcaacaatgcctctgagaggaaagggatccccagggccttggtaccagagtactctcggcaacagaaaccctgtatcaaaacgtcttgtgagaaaacggaaatgtgttattgcgtggcttagcaagattccggagtggtgaggttggaggccaaatcttttccatctctgctgtgtccccacttggttacagcttcatgctcaggctggagctgggctggctgcagcagtccaagcatcccaaccagacacagacatgtccagaggagagaggagcgtccttttaggagacaggaaactttcctgagaagcaagcccctcattccaggcctcagttcatggctcattgtttcagtggggtcactcacactgtcccaaatcacatattggcatggggaccttggaccacccaggattccctgggacctggggctgactcagcctcctctgaagctccttacagtttgggacagggaaggatacctaaatcaaatgggaggaagaaggggagaatgggtgctaggtaggcagccaatggctaatggctgttaactgaggggctaacgtgaggacaaacaaccagtctttccaggaggcaaactgggtgatggccccaacatagggcattagagaagcctgcccaccatcccttcctgcccccaccccggtgccagagtcccatgctcccatctgctgcagagaaggcaacaatgaaagattgccccaagttgtcctgggagatgaggcataagaataaatctgatagagcaatgacaacctaggcttctcggagggagggaggtggaagacagtgctgtggagaggggaggaagccagtctggacaaagggtactgggcctccaggccttgctttgtgaccttgggcaagagaagaatgccttgtgcctcagtttcttcattcgtgaaagaagacagatgagtggtttttttttttttggttttgtttgtttgttttctgagatggagtcttactctgttgcccaggctggagtgcagtggtgcaatcttggctcactgcagccgccgcctcccaggttcaagcgattctcctgcctcagcctcccgagtagctgggattacaggcgcacacaaccacacccagttgatttttgtatttatactagagatggggtttcaccgtgttggcaagggtggtctcgaacctctgacctcaaagtgatccacctgcctcggcctcccaaagggttgggattacaggcatgagccactgcgcccggccggatgagttgtcttctagaatttcttccagctcaatcactccacgattttgggaatctgagaatggtgagattaactgggaggcaagggagaaggtgggacagaaattggtttatagcatcatttaaatagccaaacagaaggatctagaagccagtttcagttggggcagctaacttgctgtcaatttgtctaagccggaaagggagaatctgcagcattagtctgtggcatgtgagaggcccattaataaaagagccacatgtgctcaggggaaagcgagttacatggaaggacaaggacggttgtaggcttgcaaaggagcattcattaccatgcagggcgaatcaaatgaagaaggagctgagggcaaaggggaagagcagggaagcagagaagagagagtagaagatgatggatggagggactcgggagtgtggtggctcagcccacctcatcctagctcagcaagactgcagaggtgtgcactgttccccatggtgagaattgggtgtcctttgttgcttagtcttcgggttccaggaggctctgggaccaagggacagacaggaagggagttggagcaggggaggcaggagactcgacggaggccgagggcagtggcctgatccagtatctctgtggagagtgggaaggtgttgaggtctatggtacctgccagatggtagtggctgaataaaagtgggaataaagcaaagaagcaaggcaaggaggagaagcagcagcaagagagggagggagagagagagggaggaagaaagcatacaccagccaggtagttttgtgatgcgggtgaacttggactggaacagacaaactttgttgactgttttgctctgtaattgccttttaaagagattatccagagctggctcacccagttcccctcataggcctcctggcccaacatgtagcaaaactgggtaggaaataagcccatccaccctgcctgtagccccctgtccttaccactccctggagccttacttagttcagtcaacaccggcttcctgagcacctgctaacatctgtctggacctgagggggcacagcccctgccctcaggaatgctgtcttctgacgctggcagtttgcagagcacttttacagacttgtgaggcagggactgctgcttctcttttacaggtaacagaaattgttgctcacttggagggattcacatgcctgggatcactcagcacatagtgaggggctgggatctggactctggacttggtgttcatgcttttaagctctttcctcgacacctcactgtctcacactgcttacactctgcctggagagcttgaaaaaccccgagacagcatccctccatccaaccgtggaggggccggtgtcccagggctggctaggagggaggcaggctgtaagcagttggtcccctggaatggtggtctcacaagggtgctctcacaagggtctcatgtgggaccctcacaaggatgccatcagttgaaagaggaggctcggaaggggcaatgttgagtcgccagtgatggaatgtcgtgtttcagtgaaggaacttgccttgtaatgggactctgtgtggacttctagccctgtaacaccactcctcccaggaggcctccacctgccttcctggaccccctcagggccttggcacagtactgagtgtatagtcaattgcacttgctagggttttgtttgtttgtttgtttgtttgttttttgccagggaccccgcatacattaacatagtgtggtattatctcctccttagatggcacgttcctcaaggacaggtgtcttctgtctttccactcctaccacctccaccaagatacccagctttcccctccccacaggctgcaaacattgtatccacttattgggtagtgggcaaatttcagccagaagttaattcaagtcaagcaaatgtcttaggggccagccacacgacaggccccatgacagatgctgtgcagaatatagagattaaggtcctgtgtgttccctgccctgagaagcttgcattttaatagggaagatgaaaatgtgggcacacaactatgctgacctcttccctgactttcaggccccgcatggcaggacccctgccatgtgagtgatggattgcttcctccagccccgcccctcctctgccctcctctccttctaggagtggtccaactctccactttctagtctttgttcctgcagttccacgctctggaatgcctttccctcttctcagcgactccccatccttcagtgctcagttccaatgcagcatcctccatgaaagactttcttgattgcccaaccagatgtttccctctttggaaccctccccaggaagacctttgtggacctaccacactctgtctcatgttcctcttgtttgtgccctgtctcctcatacctcccttccccatcctgctgtaatcacaggaataggctcctactcatctttgggctttgaacttaccatgtgcttcatacctactcatcaagttgtacagtacaaagtggactaatattaggcacatttaggaagaaacaatatcgtggggtcttgtaggaggaagtgaccttcaactgagccttatagaatgggcagataggggggcagtggccaggttcctttctcttcttgacataagcagccgtgccctcttcttcaggattcctggtagcagtggcagttgcttgtttccctggagcagagagaaaagggtacacttgaagtcatgtggggcccaaagggccagcacaaggcttcaatcccagagaatcctttgccaccattgtgtgtcttgggtgaacacctgactattagatgaagtagagctggcccagagacaggacgtgggccaagggtgatgaagatgcactcttatttccctttcttttgctttctcttttcttcctccattcctcttattttctccctcccctccctttcttcctctacacctctcactccctccctccgcctgctccccggcctctcccagctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtgaggagcggctgaggccctgcagggctgtgcccaggctagtggggtgggacacttggttcaaggtacaagagtccctcaactccaggcttgctcgaaatgtgtctgttattacagccccagataaatcagtgatctctggtgaccccagttgaatggatcatgagccacatttgttccctaaaccccaataaccactgagaattcatggaagtttgttcagaaggcaacagccctcgagccttacactattagtgggcccctgaattccagacttagcacctggcctctctgctcagcggtgttctcagcaaagctccacacagctgggaaagggtggtgctgctggagactggcatccctctgggagttgcaggctcaagacttctagcttggctgggtttcccattgttgtcctccccagccatgcttcctctggtgggtgaatgaggatctctaccctacacagaagacttctgtcagagaagcctgctgcagcacagtgtcttggactttgcatttagagttaggtggagagtcatcctgacttcctgtggacctgggggtgggtgagtgcctgcccggagaggatgaatgctgtggacagccaagggcctggaggaggggctgaggggaatctgagctcaagttagcaccatgactgggttggtttttgcagttggtatggggttattgggggagcattcttctcctactccaggccaagccaagtctgaattgtctccacagacatcacatttgtcatctcaagatgccttggctgtgtgtgggcaggagaaggatcttaactgctttgcctcttctgggcatccttaaatagcccctgtgtagaaatcttgcttgggggcaagtgtaacctggggcctgtttggtgctgtaactcactctctcttggacaggtagaattggaaggtcttaccggccacattgaattcaacagcaaaggccagaggtccaactacgctttgaaaatcttacagttcacaaggaatggttttcggcaggtaagcctagctgcaccgtggtgatggcaggtcctcctctctgttccatttcattgatgcctcggtgttttggatggcctcctgctcccagttatccccaacagcagcaggctggatcctgggcaaggctcctgacctgcaccagcctctcccttcctgccaccagatcagccattgtggctcagggactgcacccccagcaaaatactaagaaggagagaactggggtgaaaggggaggcaagggtgtgtcatgtaagggggggaattccccagggaggattttactccatgagtctgaccctaatcctggagcccatttagactccagggagcctgctggcaaggcagagactgtatcacatgtgggccaaggaaacccttcagtgttgcagtgcatggctgggtctctcctgtctgcccttctctgaccaacccacagctcccacccccatgccaatgacacagctcctctcctggccgctccctgcctgctccatcattgcagggatgccttgtccttcatagttcctttcagctccccactcctttgctcattctccgccattaccctttttccccttttcctgagatcttcctccatcagaagaaacagagnnnnnnnnnnnnnnnnnnnnnnnnnnnnnnnnnnnnnnnnnnnnnnnnnnnnnnnnnnnnnnnnnnnnnnnnnnnnnnnnnnnnnatcatagcagcctccatttattaagcttttaccatgagccttataccatgttaagtgtgtcatatatattttctcttttaaccctacaaaatagatactttttattagtcccaattttatacttgaagaaactgaggctcagggtgactgactgacttatccttgaacaaacagtaatgacagagctggttttggacccagagagatctacctctaaagtctaagttcttaaccattacaacaaattatgcatcagaatcaccttggaaatgcaataaaaacacagatttttaaactctacctcacaagagtctagttgggtaggcctatgacaggccccgggaactgatgcagttgtcaagcacccaaggtgattctaatgaagccctacggccgtggaggccctgtcatgtctgcctcctgcttctgggtcccagcatctgagaggctccgatcagccctccttagagtccagtggagttctttctaggagatcgtaattatgctgggccctgaggccaggtcacccttcttggaagacgaggcagtaaaaggaaagagtctcagacagagaggagcccagagtcctgctgctgactctcagaaaggcctcgtatctctggggcagagctgcattgtctgtaagcaataacagctaccattttgtataatttctcaaatgagagcagggttaggtaggcagccagaaatttcggggatggcatttcacaaaatggtcattttattcatctaacaagtcatatattgagcatgcactgtgtatcaggtaccatgctgggcctgggggaaaggaagctgaaaaagattcagcccctgcacagagagagtgctcatggtctgtccagggagcctgacatagaaaaccgtaagtgcaaatgtgggttattacactcagatcgtgccctcaggctcctaattccctgaataggtgaagctgccagcctgtggagaaattgtcaggcagacttttctctgagccccaatgtgcttgagggatgtgaagtgaagaacattcattcattctttcaagacatctttgttgattgcctattatgtgccagactgtcttctaggtataagttttttaagatggagaaagtggctgcttttgtggagcctgtattctagtaggggacaggcagtgggcaaacaaatatatatgtgacatagtgtcaggagtggtaagtggaaaaagaaaacggggaaaggagaagggggtggagatgattacagcggaggaacagttaggagaacatgatgctcactccacagaaagcctgatcccagactttgaaacactccccttagacctcagtcctgctttgtgagtgctctggggaaagagcccacttccagcaccctccatcaagagacacctgcagtggcagagctggctggtagccctgatcccactctccacttgaaggacagctgattaggctccaagtacctcttcacctttattctgcttctccagcagccgctgctcaggctagcttgtgctagccctgaggccagaggactgcctgagtcattaagaaacagcgtcatcagcccccagggctcatccttcagcccccaacccaggccagcaagggaccgtgccctgaggcatcctccacagcggctgcagtttctttggcagcagcacacataagcgggcaggacaggcttctcaaatgtagacgtgcaccaggatgaccgagagtgcttcataaaagttggacattcccaggcctcacagctatgaattccagtttagtaaaactggatgtattccaggaatccgcataattttaaccagctccgagatagatgattacagtgcaggtggtccacagactaccctttgacaaatactgtcctagtagaagagtgttcgtgaactgcagcctcttcacagagatttttttcttgacctctccacatcctacccccatctttttgagccagtgttggatggaatctgcttcagaagtgaccattaaagaggatgtgctttgaccttcggctactctaagggacacatactcttgattggacttgtgaagtggatggtgatcattctctttatgccccgcccccccccttttttcaacaaatctagtgagtgtcctgctgcttccctgtctggtttaggtgctgtgagtaccaagcaaaaactgtgcgtgatgtatcagggacacagatgtagcttcgcagctttggtccccaggtcccatcccaatcaccgcccgatctttgcctcttgacaggtgtccttcccctgcttattacaagatgaagaaatggtttagggagtgataattaattgggcctctcttccaggtggaaggaatgtcaatatctctgcgcaaatattctcccaattccattcaaggtgatgctgggcaggggaggagaaagtgacaaggaacaggggaaataacatcttttgagtactttttgcataccagacaccacatgcgcactttgcacaaatcacttccaatcttgacgacagcccttcaaggcagataaattcccatttcaccaataagaatatgggagctcagggagcggaaggaacttggtcccgctattagcaaggacttcagacagagctggaatttatgctcaggcttgtccaatggcaaagcccgtgctctcggatcccccactcctggctattcctcactttcctggaatccctaaaaccccaaatcaaaccccttcagccaggtctgttggtctgctgccacctgctgcaaaccaggacagtgcctgggtcctcatgaccagctgggctgggcgttccttaagaatggcatcttctcattggggcttggtttcattctctctcttcctgtctggatgagtgactatttaaagctggttttgattgtttagaaagccccacgcagcgacctgctgggttgcaattggtaaaacgtctgaaccaaataccacattctctgccggtggctgattaaaggattattaccattttaaaaatagtctatcagaactcaggattgttttctactattttaaaaatgactattttgattctgttcggagagggttttcagtcttgggactgaccttgtggagcttctactggagattgcagggtcagggacaattccctgttgtgccctgtcagtgacatttctgaacctggaccatcgcccagttattggcttatgggcatagaagttgacagtattgtttcagctccaccctccagtttttgcacatgcgagatctctgctgtccatctcatatcctcccttttcatgacacggaagatggcctggacagtattaggaaagtatagtctcccttcctgatttgggagaaatctttggaagaggctgggaaagaaggaagcacaacatcataaggcccttaatatccttcgtttaacttggtctaaagatcagagattctgagcagcccccaagcaactttgttagtgctgtaataagatgagcgtatctttcatctgaggattggaaatggcttgacaggctctaattaagcctttgaggtttgctattcctagttaaagatgcagatctaaactttttctgttggctcactgtgtatcactacgtggatacctcagtttcatttctctgagcaatggaggtcgtaacctcccagcgtttgacctgggtgaacccaagaattatccaaactagaattgcatggcacagtcttgtccttgcctgtggttacatagaaagccggctctactgacatagtagctaacatttgttgtcacctacatgatgtgctgtgctgagtggtgtaagtatgtatttaaaatttttcatcatttcgtcaaccctgcaggagagctattctgtcagcttgtaggtgaaggaattgagacacagagagagaagaagtcatgtatctacattcatacagccagtaagtgccagattgaagaactgggtctgagtacaagtccaagtacaagtacaaggcaggactgggtctgccttcaaagtccaaggtctttccactatgcagagttgtcccagcccatgttggaagggaccttcaagcctttcatggattcctccaacccagtgtaagaacgtttctccattgttcccctgaaagagatgaccgcccagcctctccttgagcatgtcctgggctgaggaattcactgcctctcaagggacacattccaaatacttccaggcactgggtcaaaatctgcctcctaattctgccataataggaatagtctgcttcctctttcttaccagctcttcaaatattttttaaaagtttgattttacttcattcacttactctttcatgcctgaatttagcatagaatttttgagcaccttctctgtgtcaggggccgggaatgtaagattcatgaatcatggttccctcaagagctcataatcttttggggaaggcaaaaactgcagccaggtcttactgtacagggctggtattgtcatgctcttccattttttcctttctcaggcagcggttcccaacatgacgtggctgccacatctctcaccactagtgcttttcagttcgtctaggttgtctattaaaacacaaggcccagattgaacaccacactccagatggggctgaacagcacagagctgagagcactggaggattatgaatttcctcaaactgaacgccaaatttctatttgccacattagcttgcttgctggaatttgttttccaatttttttattcattctgaactctgggccttgggatcaattaattattccacttgcctttctcccaccaggtacacaggtttcttttcatgtgaacttttctagaaattagacctgagccacactttccttagaccatggatttatttcactctgctcctacagagctggagaaactggccaggcaatgaggagagggccagtaataagccttgtgagctgacagccagacttttgttttccaaagcttatatcaacccagctttcaaggggctggctctctggaatgatttgagttctaacccaaggaggaggatggatgagatggctttcctgagtcacccttgcgaaccaagaactcagggatccagtgtcatctttagaaggctcagagaattcaacccaactccttgaaattcctgcaggtcccaccttttgctaggaggtcaggctgcctctctttaatctcctctcctgccatcttgcctgacacaagcccacacagaggcagctctgccccctttccgggggagttgggatcctcctgcgttggcagcagtggaacttgctttgctgcactcctgagtcatgtaaaggcagctgcatttcttatcgtggccctgtgcagctgagaactctggaaaatagcttctgttgctctggtgggaattttagcagacctgcttctctggtgggagccactcctgtccccatatctaggcccttcctccatttcaaaagcaaacaaacctagaacaacagaaaaccatcaaagcgccctgcctgtcagatgacattctgcactgacattgccttcacatggcatggaagaatagtgaggggcatttcatgctctccatggagaggtacccccggcatctgtgcccttgaccccagcccctcttactatgagctgaccccatcatagctccagcccctcctgtgctaaggagaagggctattaaggctcagacaggttgaggggggtgggagggggaaggcagctctgagagtactgtgattgctactgtctaatacattttcaatttgaggaaggaatttaccataaatatgcagatcctttgaagctgcttctgccggagcctggctcagagtgctggagccaggtttgattgctgggaatcagcagccttgagtgccagctctccgtctggggaacagacctccgtgggccagctgaggaggctgcttgacaggcgatttcccccagaaccagtgggagtgactttgcctttgatgaggaaacttcgagacggcagatccgggtggagggagcagaaaaagagatgggtggctggggggctgctttgaaggttactgagaagtcacttatttcttctttttaattaaggggaattggaatgaggtttaaaatagttgacaacatctcatagaatgtcaaaaattcttaagagttggaggtcagcgagtccatctttcctaccagagaacacatcagtgagagtatcattcctgggcttaaaaccccttggcggcccccatttgctttcaggatgacaggtgctgggtgctgcatacctttgagtcccctcgtctgcactggcccttctgaggctctgccccagcaataccagatgctgtgatggtcaggcatgccaggctctctcgcatgcccttgccagtgcacccgtacccactcccatttctcacctggctactcctactcacgtctccaaaactcagctcagtgaggcttccctaatccccagctcctgcaagcaccggtccagtgctccgtttatgtgctccctctactgtagccttttcacactattattcagtgctgggggctccctgagccagctgagagtggtgctcagtgcaggcttggagagcgaatacggagcgaacgagggactggtgtgtgcacagcccacctccctgggccccggggaggtgtgcagggggcacacagatgtgctgtccgggcctaaggagctcatagccaacagggacaccagagccctggggacctgaggattttgtcatgagagttctctaaagctactgttcaccaagttgttcaagagagatttcctatgacaaacctccccgctgacaactggaatttgaaaattgaagcagaaggcccctccaatcactgatatctttcccctttccattcctttccatcctccaagaacagtgctcccctacttcactaaaaggctctgaaatactttctcctgtgagtgaatcaggctctcctgtccaccccagggacaacggtcaaggggcagatgagctggctttggcaggatgtaacctgaagggtgttttctctcctgccttcctggcccatgtaagtctggttctttctcccaaagcacagggacttcctgcttatcagctttgatggaaaattcactgactgcagaagcttattcacacatcagccggcaaacaaattagagctacttaaattttcaagctgggggctgcttttgggcagaagagcagggttttaaagtgctgcattttaaatgtatttcttataatgtgccccatcacgcttctgcctgagatcagtctggggaagtttgccagttcccagtgactcttttccgtgcctcttcagccagctcatgcctggaagagctggaagaggcggacctgctaattcggtctcaggaagcagcctgcgtcagtcagctctgatgggaggtgggccaggccaccggccagaggtgtggggtttgcaggcaggcaggcctggggaaagaacaaaggtggatccagggaggtgagggagccacatgcagcagcaggcagcgtggggcactgggaagggcataaggcttcatggtcaaaggctcagggaagagtcccagctctcccagtttctgttctagcattctgtttctcaatttcctcctcagtcaagcagggatggtgatcatcatcatatctgctttatgtgcatcataaaattattgtgagagcaaaatgaaacattgtttatagctgtgctttgaggattctactatatttgcaaattttagttctgtcatctcacacagagatgactatctatgtatctgtctatctttgtgtgccgtattcccggagtctcgcttctaggctggctcagggcagagagaagaacaaaacgggggtgagcgagacgcccagggccaggtcactctggctgtaaccacgcaaagaccggcccatgccagccaggcggggtgcacaccagctgtaccaggctggccactcagggcttcaggatggcctccccacagcctctccctctcctgcctctctccttcctccacccctgacccctcctttttccactctctaatgtggcagcctcactggttccacttggcagtggctctggttttgtgtgaagctgagggaagcagaagctatggtcccactcctatgagaatcccagcaccccaaaggcctgcccgacagagcgctgctcagacaagagctgccgacaccctcaaaactaaaatttccccatccagccagagcgctgcaaggcccgggcacatgctagctgcctgctgtgagccagcttccagctaggggcagagccgggccatgctcaggccatcgcagaaagctcagaagttgcatcctcccctgccctccagcatgctactgacttcagtgtcctgagttccagaaggacggcaagtaaccggcttccttccacccgggtgcttcattaaaaccgtgagttcaattggcatctgccactcagagcgcaaagttgtgttattaatacaaccagctttcccaaggtacttctccacctggtgcgtttaacaaatgaagccaggcatggcctgcctgtgtcatgttctttggcagtaaatctccagcatgcctgagctctctgataaattctttcctcggcagctaattcaaaacaccttctagcttcctggaggtgagagaggggtatgcagatgagtcctcgtgttgactgatcctgccatgcactccgcacacggcaatttgaggaaggccaatttgatcatccccaaaaatgtttagaagtgagtctgtgagattttcaactatgcaagaaaagaagaggaagttggggtgtaggcaacataaattcttcttttttttttttttctgagatggagtttcactcttattgcccaggctggagtgcaatggcacaatcttggctcactgcaacctgcacttcctgggttcaagcgattctcttgtctcaagctcctaagtagctgagattacaggcgcctaccaccacggctggctaatttttgtattttagtagagatggggttttgccatgttggtcaggctgatctcgaactcctgacctcaggtcacctgcccgcctcggcctcccaaagtgctgggattacaggcatgagccaccacgcctggccagcaacagaaattcttaaaatcacttagtacttctgtccgaaaagaaaggagatctgagcatcctcacagctcgtctctgaaaatttaacttcagaaaccatgagctaggtgggaagtctattaagttcatacaagcatcatacaggggtggcatttttagtcagagctgactagggtggactgagctccactcctgccctattattttcgccgtcactggaatctctgagaacagccaatgtggttttattctctttggcaagaggagtggtgagggctagaccaaattctgcttcttatgccagacgttggggattagggatggaagtctgggcaggtcttggcacaagctacacattcgagagcagacaagtacggttgatcctcattatttgtggattccatgtttgcaaattcaactacttgctaaaatctatttgtaacccccaaatcaatacagtgcttttgcagacatgtacagagcagcaaaaaattggaatcactgatgtgcacgttcccagctgaggctgaacaaggctgcaccgtgtcttcttgtttcagctctcatactgtaaacaagtgtccttctcacagtccacttcatgtcacatcttgtctatttttgtgctttttcttggtaatgtttctgtttaaaatgacccctaagcatagtgctgaagtgctatctcgtgttcctacctacaagaaccagtgatatgccttccagagaaagcatgtgtgttaggtaagctgcattctggctgagtgagcgtgctgttgtttaatgttaacgcatcaacagcatatattaagcgaggtgcctgcaaacagcaacacatgtaaaacaaagtgattgattgattgaagaaagcaccatgaccagaggctcacaggaacctagccctgtatttcccataggaacaaaaatggttcggtattccctaattcagtgtttgtggcaactttatagaacagaactaccacgaataatggaatcacctgtagtgagtttcagccaagagagaagaccaggaatgagcaaatgtatgagtagctgaagttttcctacagtggccctttctctgcgttcactgccccgtactcctgctctcctgttttctcacaaagagcaaggacttcatctcctgttgatgtcctgcctttctcctggttcccctgatgcagaagtagaatccagatcttatattcctgcggtcaaaaagaatactaaagggcttctagaccagcactctaattggctgcttggattcttgcaaatggatcatcatagagtctgtttgaatgcctccagtgtcaaggaactcatcacctacaggaacagtatattccatcttggaaagctctcattcttggaaagttcttctatctattgggcagaaatcttcctttctaaagcctctttcctttttccttagttgtgtttcttgggttcacacatctattccacccttcctgtttctaccttcatttcgttcagctcagagagggctgttttgtggcagattggagaggagccttccttgtatccctcacatcagtggccacctgcctcaccttcatgccagggaagcagtgctgcccgtggcctcctaccgtcacctgtctgagaccttctggggttgcctgctcaggaaactgctcagacaagagttgctgacactcacaaaagtaaaaaagaataagcccatctctctcaggctctgccccaagccactctgcaaatttacatcactttataaataaacccagcattttcaggaattcctgtttgagctggaaggggcaagcctgtatccttcttttataggtaagataactaaagataaaaagaaatgacttgcccaaaagaactttgtaattcaattcaacagatatttactgagtaccctgtataggccaggcactgccctggaagctggggccacaaacgggaatttattcacgcatccagccaatatgtagtaagtgccaatttcatgctaggtattgggcatatgatagtgaacaagacagagtctcttcactctggtacaggagaggggcgtgaaacaaataattacctaaataactatatgattacaaacgtgatgagtgctacaaagcagtagttcagggcactatgcacaagtctgtgatgtgggtcttgatggagacaaaagactgggaggggcctccctgaggggtgacattcaggctgaagcttggtgggtgactgggaaaccccaggtgaaggggagtgtgaggagcctgagtgggaccacccagaggcggttgtggtggatggcagagctggttgggaagccagaactcccactctgcttatttctctgccgcctagcctccccttcctcaagctttatttacgtatcctcttctaaatatgtaactcagaatcaaagacaagggatagcaaaggccaccttcaaggatatggggtctcaggcaggaacgcttgtggcaaatgccaatggataaaggataaggattcgaatgtttactaaatgtttaactgtatagtcccaacccaatagaattaatatctattagtattagtatctatatctatctagtagcataacagacctgcctgggtttgaatctgcattaactatggagctttgggcaagaaacccaacctctcagagcctcagttttcttatctgtaaaacaaggatgatggcagtatttcccttgtgatgtggttgggaagattagatgagatgacaaatataaagcctttagtccagtacttggcatatggtaagtgttcaaaagtcttagcttgtataattttcttatactgtagttagtccttcagttataacaagtgaccaggactaggagttcattgatgcaaaagaatatatttattgagaaccagttatgttccaggtactcagctaaggtctgatgatagagtagtgaacagatagagtgtccagatctcttatgccaggcacttgtacacttcttgagcctgacttacatttgggttgcaagtcaggatgcacataaacatccatctatatgtaactgaaaccaaagcttgtgaaacaaggtacccctgctatgtgcattacaccctgatctattctaggtatagatttgctttttaaaatgcatgtcttgacccactgaattgatttcataacccactaatgggttgcaacccacagtttaacaaaatactgccttggaccaactgagttgcaggcttaataaagcccagttagagttcccagccttccctggacttgtttttgatctcttacccttggcatttaccattgctttcttttgatcctgaattttcagcattattctgcacaagcatgtatttgatggttccctctgctactagaatgcagcctttggccaacttcagcatctccctttgttccccagatcacccactccaggactcggttgggctcttgcttactcatgactcagtctcctctgtgaatgaaacttttatgattggagatattagatttaaatgcagtaagcgtttactccctcgtgccaaggtgttcaccacggaggctaatattacaaacctttttagttggttttatttcaaatacagatctatataatataagagactttgaaactctaacaatctcagtttattcctgggatccctggccatagtgttttcacctgaatgtcacttttcctgcccatatgtcagaatcacttctgtgcactcaagaagccacaaatacattattaatatgcatctttcctagtaagaacttcaacttagtaccctgaacctgagagtaaaaaaaaaagagtcattggttatggttcatctgactttggatgtccctggagaacaaggatctgaaatagaataaaatagaaagagcttacaatttttttttttttttttttttttttttttttatgagatggagttttactcttgttggccaggctggagtgcaatggtatgatctcagctcactgcaacctctgactcctgggttccagtgattctcctgcctcagcctccggagtagttatgattacaggcatgtgccactactcctgattaattttctgtttttagtagagacagggtttcaccatgttggtcaggctggtcttgaactcctgacctcaggtaatccgcctgccttggcctaccaaagtgctgggattagaggcgtgagtcactgcacccagtcagagcttgcatttgaataggccttgaaacttttgtcacatctgtaattgcctcagatcaccctaataaggggagaagggaaggggagctatttttatcttataggtagcaaaatcaacttcccaagaccatgtagtaagttggagggtggaacttgaacccaaatctcctgacttctggccggctgcattcccaccaaatatacaatggtaccgttaaatggtaccattatcttatgttcccatggcttattgtggcttgtcaaaggccatcacgtacattatctcagttgcttatcaacaacaacaacgctgtactatgggtaggcaggttcatttatttccagatggagaaggttcagagaggttaaatgccttaccccagctcatacagcttatgcatgggagaggaggaaaaaaaatgtgggtcctcttgtaccccctgaatccccttgtgccaagctagctcctaagcaaccactctgggccctggccaggatcactcatatggcctctttgaagtgactcccttcaggactatatttagtaaacaagttcatgatgatcagagaggaattgagaaggcccaggccttaaggtcaagacaagatacacctgtcctaactcaaccagatggtatagtaataaatagaacctaagttccaatctcagtttaatctcctattaactgtgtgaccctcagcaagttgcttgatatctctgagtctcactttcattcattcattcatttattcaacagaaaggtgtatgaaagtgcctacattaagcattattattgttgtctgaagtacctccattaagcctacatttctcaggtgggaataataacaaggttgttgtgcagaatcaaggagatttacgtaagcagagcacatggctgagtgcccagaatgcaaaggtgatcaataagtgtttgcaaaacctgagtctgaagccgaaggacttaccctgccttggggttacggtggcctccctagaagaagctggatcctggcactgctgagtgcaaagaacaatcatctaaatgtacataaaatatgaaatgttatagtgctgcgtgcacacccacagatgcaggcaaagatgtgaggaaatccctcgaggctttaaaaatgaatctctttttacctacttgagagggaacaaagtggcaaaatgacagccctgtgtgattctaggcaggagtgagagctgtgagcaggcaggattgccagggctccccctcagcggcagggcgtgcaagttccagggatgacacccaggtgagcctgtgggcctccaggactggtctataggaaagggcctgagggctcactgactgcagcctggaaggaatctgagccacagagaggggaaaggacttggcaaagttcatttcatccctgcttacacaccaggcactgtgctatgcccgttcccatcgctgtcttgactctgaaacagaatagcacagtggttaggagcacatgctttggggatgcagaaagcatgggtttacatccccatcttggtacttagcagcatgtgactttggggacattcatgacctaaacttgctaagattcaggacgtttaaaatctgtaaaatgagtacaaaaataactccctcttaaagataggctgaaggttaaatgagattctacaggcaatgttcctggtgcattcacttaactcgattttattgagcatctgtgataagctaggcactgtgccaggctctagggataaaagggcagtcaaagctggccatgatccctactctcatgaagcttattatctagtaagaaagataggcggtaagcaatggtcacatcgatgaatgtttggaaggaaaagaacgtggttctgggaggagtccgactttgagggattagcaaggaaaggcttcctggaggaagggacctttgagctgaagcctgaggggattaacagatgtaaagtagatcaagattcagcaaatttttttctatgaaggtccacgtgataaatatttagactttgcaggtcacatggctctgagcaaatcagcttttgtagatgaaagcagtcacagtgcacgaatgaatgggcgaggctacgttccaataaaactttatttcagaaaatagggagtgggctgcattccacctgcagtcccgggcttgccaactcctaaactagctgaaaggggctggggggcaggggttcatgtggcaaggagagttccagacagggaatggcatgtgcaaaggctgtggcgggaaggagcctgttgcacttgaacgcgggaggaaggtaggtgtggctgcagcacaggtaaagctggaccgaagagcatgagaagaggatggagagtgggcaaaggacagacctcatggggctttgcaggccatagtaagagttttggtctctatccttaagccaacatgggaaagaattgaagggttttaagcagggactggcgtgtatgtgagatttggtagtgacgactggctgctgctgtgtgaagaacagaacagggaggcccagagtgaattctagtcccaggcaagatcagtggggattttgattagggtggaggctggggaggggtgaggctcgaggaaattaactgacttgctcagggtcacccacctgtggtcatagtgccaggtactaatgggggtctcctgatgccaggtgacacactgcagcctctgtcaggaagccccagaggacccctgtggtcctggcccctgggtgcaggactttctgcagtgcattgccgcagaagtgaccagcttgcttatattgacctggggtcacacgacagaccaaatccaagtccctgacactcattcagttgtacagtcatctcctttccaaaggactatgggtagcccctactgatgccacggaaccattcactacaaccctgtggccctatcagcccccttgtctaggctctccttaaaattctttcaagcttggtccctggctgctctacccaggggtcctagaaagacagaggctcagagacagcagtcgtaataggagcaagaagtgatggctcacagtgagaaaagaaacagacactacgagaaagcagacaaattaacgtataaaagcgcagaactgcaggcagtggccctccacatttcagtaaccccaagggtagcactgtatcaaggcacagtgtaataactggcttcgtaatgataacactgcatattaaggtagacaggctccctgttcaagaggacagaggaacataataattcctttagaaaggagttttggaaacaatggttttgaataaataattaaactctcccaaattttaatgcctcaggagcaagatcattattaatttatatccacctgtgtcccttggggatgttgggtaaatgatacattctatgtacgtgcaaacacatcccatatcggttatatttacctaaattttaatatttgactaagcagtcctatcataaaatgtttcttgtaatggcattaagaatctgtaggtagaaggactatacatttgttttaaatattgtggaaccaattaagcagccattggccttgtctggaatcctattttttctactcaccagctctgcgagttaggtaaattattaacttatctggaccctgctttccttatgaatacagtgggggtgggaatgggattagtatgcatcaccttctaatgcccagcacagagcccctgtgagtatggcgggcaccagtcatgtgctagagctggcttgccccagcctgcaagagtccgttgtacacatccgttcccagctctgtgcttggtgacatcatgttggcagctttaaatcagccatagcgggtgtgtttacaccacagaaattggcaaatgctacacatgagggtctttttttttccccccaggagagccagtttgtaaacatttcctaactgagcatgggcgggcactgaagcactgttaatctctgcaccctaacctttctctgtcatcctgtttgtcgtctgagttggtctttttgctcggctctagaatttctgatttagtcattctggggtagggcccaagaatttgcatttgttttcagttttaattttgtttttcaaatgtccatctcagagaagaagagaatttgcatttctaatgctgatactgttggtctgggaactatactttgagacaccgtcctaatctgcctaatcaactaaagcccatagtgtgaagcctttcacagagcacacaggagatcccaccttctgccttgggcaatggtattaaaaactaataagggttgacacagtaccttgcacatacaccatctcccttaatcttaagaacccctatgaggtaataattactattttaatccccattttatagatgggggaaacaggctcagagggattcggtaacttacccaagttcacgtagctcatcagcagagaagccgggttaaactcctgtccaactttgcgttgctggttctggttgtgcaacacccaaggatgaagtccagctcgaactctgcattcccagggtgcagtggcagggccacatcagcccagaggggtgcttttttcttatctgcattaagatgctgtttgtaggctagcagcggccctgtccaaatccataccttctcctccttcactgcaacccctggggcctctaaacagtggaaaggcagagcaagtgagagagacagaaagtatagagggagccaaggagagacattatttgaagcaaaatcaagcctgcacatgtgggcatgtggaagcggcttacaaaacagctgttcctacaggaggtttggggggcaggtgtcagcagggtggagcaaagggatttggccggaggcagagccacagattgtcagtgatgaaagagctatgtctcctgcccactcctggcacgtgtgtggcttcgagggtgcccagtgggtggggcaattagcctgtatcccagggcgcctggctctgaatctccctttccctcccactgcctttctgcaattagattgcactgggtaatagctgccaagccgctttgttggatctgatgagtttattaatttcttgggggctaatgggagggtgggtgggggattcatttcctgactggagcttgggggctaattagtctctttgccgtgtccccagaggagggaggtgggaaggtgcgttgctcaggctgttggatctggctctgggtgtatagttcctacccctggcttttacctgtctcatggcttgggtcagaccagggagtctggggccggggcttcttttagcaagtgattggtgaggattagatcccttgagaacagtggcggtgggaaagtgggtagcggggagctgaggtcttactggctctgttggtatgaggtttaggatgacagaaaggactctaaggagttcagtcctgttccatacatcccagtgctgacatctagcccaattgctctttctgttctttctgcctaaatatagcccctcccagcctaggagtccattgggagccaattctatccatttttcagacagggaaactgagcctctttgaggacaataatttcacctggctttgtggagtgtcaagaccaaggagaagaaagctatgtatttggacttcttaatggaatggccctagaagccattccccggttagcctggcctgcttaagtgaagggcacattcgtatccccaccccaagagacagcagcagaaacaagaaagatcacagaattaggagtcagacagatctaggttcaagcccgtgctacacctgccatccggggaaccttaggcaagccattaaacctctctgagcttcagtttcttcataactaaaacagaaacacatgtaactactcgaaagggttgatgggagaattcagagatgataggcttgacacatctaacacatcaggtgtccagtaactattaccctttccccattcatttggaaaccttaacagctcatccctcacccatgcagagaggaggaggaaggggaatctcaggccataacatggcctggctggtccctttaagagacaataggagctcccaaggccagaggagggctcggagaaagagaaagtgccttccgccctagcctcaccaacaacagcaatctgctgatagacaatggttttccctcgcttccaaagccaggcccagagcaagggcacaagcataagtataagaccagcacctgctgtcctgagccacacaggctgctcatggggaagacacataggtaaacaagcatgtgcaattgaatggtggaggagtcagacaggatgaccaggcaggcttcctcaggaagattcatctgggcttaagagtgcagggcttaaagctcaggcctctcagctgacaggctctgtgacctcaggcaagttgggtgggctcttttgttttggcctcagtttccttatctgtaaaacggggcttgttgtatggatgtgtatgaggccttgcttgtaaactgaaaaggaacatgaacacacacagaaccatgctgcccttgcagagatggggacagctgcccacccttttccaggtggcattcttgcagggcgtggacgggagcatttggtcatctccccttttccacaggaaaggcccaactgtagagaccataaggctcctgcctggaactggaggcccacgagagctcccagctgatggtctggggtgggcctggctggccctgccatccacactctccaccttctccagactgtgaagcagggagccactccctctcactctcagtcctctggccccatagggtgggggcggcgagaaagggtgaaacatgtctttactgttgctggaaattccataaaagaacccagagcccagttctgcggaatagaaccacatggcatctgtggaacttgtgtgggtcttccagggaagctgctgctactgcctgcagaagcctggcagagaaaggtgtgtgcatttcattgcgtttttagccagtcgtctctcctggctgcccacctaaaaacactcagcaacagcaatgatttgccaggggctccagctagtagagatatattgggattttatgtatatagatatgtgtgtgtgtatttttgtatgtataaaaagagttctggccaggtgcagtggctcacgcctgtaatctcagcactttgggaggccaaggcgggaggattacttgggtccaggaggtcaagaccagcctgggcaacataataagaccccatgtcttattaaaaaaattaaaaggagacatccgttgggaaaaacaagcaatctaaaaacccattgctgttgagtttagatttaggtaacttaccagaatgaagaactgagtaagttgtggatttttttcacctggagttctttgagacaatgagacagacaacagtaatgtattgtacatttaaaaacttggtaaaagagtacatctcggccgggcgcggtggctcatgcctgtaatcccagcactttgggaggccgaggtgggtggatcttgaggccaggagttttgagaccagcctggccaagatggtgaaaccccatctctaccaaaaatacaaaaattagctggggatggtggcaggcacctgtaatcccagctactcgggaggcagaggttgcaatgagccgagatcgcacaactagactctagcctgggtgacagaacaagactccttctcaaaaaaaaaaaaaaaaaaaaaaaaaaaaaaaaaaaaaaaaaaggagtccatctcatattaagtgttcttatcacaataaaataaaaacaaaataaaggaaacaaaacacattagagagagaaaacgaaagacaacgtggaaggaaagcagcatgtattgagtgccaggttaaatacattcttacaatgacccaatgaggtttctattattatccccattttttagatgagaaaacatgctcagagaggttcagtcacttttctaaggtttcactgttgagatctgcgttcctgggtctggataaataatggaacacccactggcacatacatgagaagctccgagaaggcaggacaagcattatcatccccatttatacatggggaaactggggttctgaaagatgtgaataacttgcctgagttctcacagctaataaatgagtccatctggactagacctgtttaggttcattcattcattcattctttcagccatccagcaaatgtttatcaaagggcatagttctctccagtatagccttctggttcttattttgataatcagaaatgattgaaggcaggccggatcaaaagaactccgcagcccatccctgcctcaaaataatgtgattccacatgttccattcctttctgtgtgagagaacttcaccaaactgcattcattcctgatttatttctccattttcctctcccacctctcccccacatctttattcctttcttccctgactgttacagcccccgtttccctcagccccccaaccctgggaaacagtctcccttctgcagttcagcccccggctccgtactccacacccctccctgctcacatgcagcccagccagaggcagaggtcagcctcttggctccttccagctctggaggccaccatttcttcccagtcctctccgttggtctcctcagatcggccagtggcacgtggcagagggcctcagcatggacagccacctctatgcctccaacatctcggacactctcttcaacaccaccctggtcgtcaccaccatcctggtaagtgggctctcctaggctcccagctgcagcatcctggggtgcctccccggctctgagcactcacaggctgccccttgaacagaagatgggagctctaatcacagcactgagcccaatttatgacagcgtaattacactcaagttgctgtttcatatggaaatgatatttgatgagttccagagcaggtggggggagggttggggtggagagacaccacagtttgtggatgcctcttggaggcaccctgtcagctggggcaactgtgcaggaggaagggaaggggacctgtgacacagagcgggcagctggatccagaccctgcggacccctgccccttcccagcagcccaccttgctgggtgcctgctgtgtacaaaacaggaccctcccccaccacatcctgaagcggacatgggaatgtcagtgggtttacatggtctgtttcttcatttccaggtggtaaaaagagagttctcaatctatagggcaagaggccaggtgcagtggctcatgcctgtagtcctagcattttgggaagctgaagtgggaagatcacttgaggccaggagtttgagaccaagctggccaacacggcgaaaccctgtctctactaaaaaaaaatagaaaaattagctgggcacggtggcacacgcctgaaattccagctacttgggaggctgaggcacgagaatcactttaacccaggaggcagaggttgcagtgagccgagatcgtgccactgcactccagcctgggtgacagagtgagactgtctcaaaaaaaaaaaaaaaaaaaaaaatacagggcaagagaccatgtgcccttttttatttgattctcctctattcagtaattgccaagttcaccctcccttccctgtccccctgccatgtgccaggtgctgtacccagtcctggagaccaaagatgagtaggactcagctctgttctctatcctgaggttgtaagttagtagatgggataagtcaagtgcatacatggccaaggtattatttgtcttcccctctgaagaccttatgtttaaaagatttgtcaattaaaccaactacatgtattaagcagtaattagtttgttcctcccctcccccttttaactaatctaaagcacttttccctgcctggcccagcatcttattagcaggagatagccagtggaacctcaatgatatcattgcagcccagagcaaagaggcgatgcatgagttcgcctcctcagccttatcattgctaactgtgcaaggtctgcaaatgtgtccatgtcttttaggcttttggagataataaaaagagttcaaggacctccatcactatctttatgaactcctggggcccaggcgccctgggctgaaatgattgatctactataaacagaaagagataaaagctggaaagagacacacacctaggactgtggggtttcaaggagagagaggtcccctcccatggggaggtcagcaaagccttcaggaaagaaggggcattgacgatgggctctgaaagacagggaatgagtggggaggagaggtcaatgaaggagggcattgtcgggtgttcaggaaaagctgaaaggtacaggttttcctgagaaatagacactggtaagaaagggaagaggcataagccagaaaagtgggttgggtccatagagcttaggaacttgaatgccaggctactaagtttcccttcactgtgaggagatggggtcactgaacattttcattcattcatttatttatgtgatgactgtttattgggtgctgctatatgctgggcactgttgtaggtgctcagagtgcatccatgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagccgggaagggcctggggtgctgagagggttggtgatgttgatacccaggggtcagggtggcctctccgagaaagggagcattgagcagagacctggtggaggtgaggacgcagccaagtagttgccgggggaggggtattcttggcacagggagctgtcgaagcaagcactgagagagcagttccagcccccagggtttcacccacgcccatctctgctcagccttagcttatctgaaccagtgtgaaaatgccagaaagatgagagggttgcggtgtcgctgtccagcagagagctgggaacagcctggctgagtccactttgggggagggggtgcagcacccagtgtgattgctgggacctgcttcccgctgtcttcttagtctctaaaaatcttctggatctgtcctcttctatccatccgcaaagcccctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcatcctgcccctccctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcattatttaaagctttacctccccttctaggatgagagctcctcgaaggtagaggggctgacacaaagtaggagctcaataattagaatctgagtgaaggaattccttcctacagggtaggggtgtcccttaaaagccagcaagactttgggagggagatggggaagtggctgggctgtactgccagcctctcagagccgggaattacaccgtgcttggagttctggcacagatccacagctacgccaagtccacagggtcctgttgctagtctgggaaagtcaccctgatttgtgcatgtgtgcacgtgtgcttattcacatacgtgcacgtgctcatgaggggtggggtgcaggccggacactggtgtgtgaggtgacatttaacaacatggtaagtacaactcaaacaactattagccttggttcttttcttgcgcgtgtgtgcctacagtggctgatccaattcgatagctcttaccaggaatgacgatcttaattcagttcccaggtgaccatctgtgggttttccctggcaaatggtaatcccgaatgatttatcccttaaaactcagcacacattcatgttgtctccccgctctggtcagggcacacttggggacgtgtggatggtttattggttaatgccagcaaacatggaattggctgccgctcccattccctgaacaccttttctgtatcagaccccgtgttcagcggtttgccacattctcacctcgcgttcacagcacccctgctccaggctagcactcaacaccccagcattctccaaggtgccagtgagccctaaccatccccatccttgggctttccaacgcgtctccaagaccggccttgtgtctgttcactttgaatatgtcaataagttttaaattaacttgagagtagtgagtatttggggagaagaatttgtgacaccccttgggacaatcaaagatacaatgggacattaccagtcctgagatggaaacccccagccatgccctgtccaggaagccatttgtttgcttcttactcacatgatcggcaagtgcttaatgctgagccaggtaggggaaccaagcaggtgacgagtctgtcccaggacccactcccattctacctagagcaggcgcaaatcggaaaacattggagggtgattgtgtgggccctggcatgagagcaggggagttctgagacatgggttggcacagaaggaggcagtgtgactctgcggacaaagatgactaggtgaggtggaagatgggggagtgtgtggagagtttgtgcagggagaagcccttgtgctgaggacggcgtgtgtggaaggcaggctgaccgttcctatctcattgacgtgacagtggactcatccagaatcagaatcacgtcaccttccactcagagctcccgctccctgacacatgacctttgccttctggctgcccacttcatcacgcccacatcctgctctccctcacagtccctccatgaccttgtgtctgtctggccctccatcttccccagcctagaagtccttctcagaacgagctcagcccatcaggatttcagtgctttcctctctgggctcctagaatcgtgatgtgcaggtttctccatgcacacctgtacccaagcccgattgtccctgccacccctgctcccagctgcctgtctgcatccagcctcccctctgcagccgggccttggtaatccctgagcccagctctcctctgtccctgtcgcatcccctgagcggctctgctgaaaatcttcccacacaccaagactcaagcctatctgccccactttcagcacaactctggggccagcacgagctcccttctctctgtgaacccacccataccctctacctcacctccaggctcaggcctcaacctcaccccgccccaccctgcctccaccctgcacttcctgggcccttgctccaccagctagcatggttctttcctcctcttttctccccttttccagggattttcccttcctgcctgtaaatacaccctggactgtcccatcctaaaacaccatcgccttcacctttcctacaccctgctgcccttcaagctgccctccaacgtagggagtcacagaatcacagaattgggtgggcccctgggacccccagccctgctgtttgcggtggggaaggagcttggaggagaggcgatctgccctctctgtgcctgccgccttgcctcccttagctcctaacctgtcaaaatgctgaacagccctcactcctgtggcactcgctcagtcctcatcctacggagtcctgctgcccccaccacgcctgccttcaaaaggtcggcagtgacacatgatcaacacgctggttcccagccctgctaggtctgtgagaatggtgggagtggctacatcctctatcttccaatttcctcctccttgacgctaagatcatgttcccctgattttcagccttcctggctgcttctgtgttgtcttctgtgattgcccttcatttccccactctctaagaccaggttctccccagggcctcttcttcttcctcttctgccctttctcaactcttccccttgacggtctcacatattccccagcttcagccttgatctctgtacatgtgcaatctctggcccctgtcttacccttgctccacattttaaacacccagtgggtcacttctgcctgcgtagcctgccagcacctcagattcaacctgttccaaatcctcctcccctccaggcattcgagcccatcatgacaccaccctctgttagtcatccaccgggctccaaggctctgaggacccacacccaaccaaccagttatcagacctgttcctttctgtgcctcttacatccttctggctttctccaatccaacctgcagcccaggattcagggtctcatctcaggagagggtctgtcctcacccctggatgcttcctctcctactacttagtattccttactcgcagccttgcgtctttaaaacgcttgatgcttcccccctataccttgtgtaatgtgcagccaccacttcctggcatctgagtcccatccatctacatttctcctcccatctcgcccctgctcacaacctgtgctccggctaccctggaaggtccatcgtccactgagcagccactcaggatcatgcccttgattgtgccttcccctggcccatgcctttcattcacagcccttccatctctcagtgttctgcctcctccagagcccagcttggatcccaccttcagcttggagccttctctggacatctcactggagagacctgccctcttcccaatgccctccttggactgcagttgcacatgtacctgttcttacctagcctgcttattgcagacatccttatatctctgataatgcccagccattggtctgcctggaataaagcaggggtagaaaaaaaagagagagatagatagtggggtcagatgatgaccttaaacaagttgaagcagcttgagcctgaccctccatgcagtgggaaccactgtgtgttcctgacaacagaagcaccttgaaggacagctttaaggagcacatcagggagaggagctggtcatcaccccaaagtagcccattacccacgtcagtttcctccttctgccccatgtcctccccgaccctctgtgcccctggccctccccatcacacgcgggtgagacaccagggctaagatgagaatgacagctgcccagttttgctgcaggaaaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctagggtaaggagaggacaagtgatctgggcctgagggtgggctgggagggattggaagagcatgaggttgtgctgcacgctcatgaaccctccatttgttcagtcaatcattcatgcatttgtcatttatttgtccactcattctataaatcttgcctggactggcacagacgtgcggtggtggataagcctgcaatgatccctatcccgtggctttcccagtccagagcctgtgacaagtcatggaggctctgattgattaacacagatgagggagtttgggttccatttttggtgctttttgattgttctgattattttgtggctcattagcactccctagcagagcttgaacaggtcctgggagaagagaatgcacccacatcagctggcttggatccttgagagacactgccaagggagacgtggctaaataacagggcaaagggattgactggcagaggagttggtcacagctacagttattttcgtacatcttgtgttatctttggttagcgttaatgtccttttacagaccgagggccaaggtgtgcttggacctgctgtagattttcagggtgaatgtggagacgtgattaacattcaggtgagcattggagaatgtcagacatctgttaggttagagcaagggtatagaaagttcttccagggggaaatctcttgttttctttgtacacactattaacaactgtaaaaattaattaagtcattgggaattcaccatccatatttccataactgagttttaatgatcaggataggtgatgaggacacaatgcagagagcacagacctgggttcttgatgtgcccttgatccaactcttttcccctctgggctttcaatggtagaaggagctcctgcagcctcccagcatgtgctgatgtgcaaggtgttttacatgcattatctctaatcctctttaaacacaccttttagctggttgttagtcccactttacaaatgagcaatcgagcccagaaagcttgagtgacttgtcgggagctatactgttagcatgaggcagggctcagattggaacccagatctttttctttattgaattaatatgctttaaaccctttatatcaaacaaacttggaaatcaaataaatttttaaaatcctactcttcaatgataaaaatactatttgaggtattaaataagcagtccttgacaagggattgggaaaagtcctatgtagatgagaactgtggaaaaggtgtttaagaactgaggagggaggatacttcaggagtttgcctgacggaacatggacggcatctgcaatgaccgagcagggtaaaatggccagccttgttctgggaattctgaacgacccagggtgactggagtccagagagggctggttcagaagggaggccttgccttcagaggggcgcttgcaaacagacggctgacaagtcaacagaaggctgcagaaggcctagggagccctggacgactgccatgggggtggggatggcagggcgaaggcttcagcagaaagccctctgcagtccttgagcctcagttttcgagattcaagcctgatgatgtacgtgcttaagtggaagaggatttgtggctttctctacttagtctttcagacccactcctgaaacattcttcttatttggtttccactgtgaaggtgcagctcagtagttagaccatagaaagccgaaatgccaggccttttctttaccttcttactgatgtccttgttcaccttgagctgatttctttggtctccttgggctgcctgatgactggtagggtgacttcagagacggcggtgtcagtgcacagccatctccttattagccccctaatgagctgtgacatagactggaggacaaggagaggagtctgggactcatagacatgcagccacacaccgagtgacttgaacagtcagaatcttagaattcaccccagatctttcaagcaaaaatactgctgctttggcctcattgagacttggctacttgacatgaactaattaattaacccattaattcaataaatatttattgaacatcttccactgttgtagacactggagatacaatgggggacaaaataaacacggacacagccctcacagatcttctggactagtgagtgagacggagatcaatgaatgatcgcattcttgtgtaatttcaagctgtgataagtgcaggggaggcagagtggaaggcgttgtaggagaacatctagaggagagtaggatgcacggtgggcgcacaatggggctgtagggggaaggcttcccttgggatgtgtgcgctggcttagggaggatgggtgggagtttcctgggcaagcaaaaggtagaaggctgaaggccgttggtgtgccactggggttggtcctggatgggagttgatgacactgggaccccaccatccccaggtttgaaggattgggatgttttccaggatgttcccctaggattgtggtagccctcaggcctggatcccttctttgtgacccctttcccaagctgcacaggaaaattccagaggctgtaacagcaagcagaggcccatgtgaggcccttggggctattgaatgtgctggctgaaagagaccttagaagccattgcatctaaatctgtcccttatacagatgaggaaatggtggcccagggaggttaggtaacctgataaagatcacacagctagtaagttcagagccagcatttaagccctggtctgtctgatctcagtactcgtgatctgagaaaacacacatcttgatgttagacagacctaagctaaaatttcagttcattcatttactagctgtgtgtgcttaaacacattattttatcctttccaccccttcccccacagctctagtgttcatctgcaaaggatttttttggtaaagatttaaaataacacacacacacacatacacacacacacacacacacacagagagattgagaatttggcatacaggaagtatgagagctgtcttaggccaggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaaggagggggaaacttgtatctgtgagtcccatctctcactgactgaagttcataccacaggaagtcacctccccaacacttctaggctgtgcgcccagaccctttggccaccttcaaagaagttggttcccaagacactggtaacagcactcgaggtgcaaagcataaaatgtgggctgatctagcaagtgggtgagagctgtgaccctctccttgcccgcagccttgcctgcagctggatgcaccagtgttcttgcatcacagcagcccaaagacgcctcagggctggaggctcgaggacagggtgcaaggagtgaggtgaggcaatacaaaggtcagccagagcagacaccatgggccgggccaggccagcaggcagagcaccaccaaggcagtggcagaacctgctgagcctctctccagtgaagactggaacttccctttgtgggtcagtagaatgcagttggtgctgggtcatcttcctggagggttattggtaacaatgtggggaaatcctcatgggcatgcccaagcaaacataaggatgagctttggccccaggagtgattatcttagggacaccaggctgtctctcaatgccccttttcttgttcaagaagtatatgtttgctagtacaaagaataaaattaggccaattgtcaacagctgagagtgaaaaccattgtaacacattgggtaagcctaggatttcttcttgggggtccagggatcctgcccagacattggccatcttgcaggcatggcagctctccaggggctctcacttatgcagcacatgtggaacttggggaagaaagagaatgtgtacaaggatgaggtgccagggtatgtatggacagggctgcccaacagtttcccctggacaacaagcaaggtacatgtaattgaaactgcagcagaagcaatgaaggttgatataaaggagaacctccccaacaaggggcttggggttgaccaaggaatctctttctttggagagtttggggaatatggtgactgcctgtatgtctgagtgatatgaattaaagtgtagaggcccagggttatctccagtggaaattgtagagcctcagtcttttcacatttgttatcacctgcttacccaaaacagtgggtgctgtggtttgaatgtgtccctccaaagttcacatgttggaagcttaatctgcaatgcaacagtgttgggaggtggggcccagtaagagatgaatgggtcatgagcactctgcccttaggaatggattcatgtcatcatcgaggaaggttagttactggaagagcaggttgttataaagtgagtcaggcctctggtgcctctctctatcttgtgcactcacttctgccatggctgacccttaccgggtgacaatgccatgctcttgaactttcttcccagccttcagaactgtgagccaaataaatttgtattgtttataaattgcttagtctgtagtatcctgttacaacagcggaaagcatacagagaccatgggcttagacacacggccgtgtattcattgtggaggagaattcaagcatattttctgcatatgtgtgaaaatcatcagagcatgtcttttcctgtaatcccattaaaaggggaagtgtggttggagtgaaggcaagtggattcacacaaactgggccagttgggtggcctctcaccctggggctgtgtctgggcagtggagatgagaaggatggttgttcgagaggctctcaggtttgaatttgttttgcctggtcagctcctttgcagctaagcccgcagaaggactgagtggcagtgatgttgtatctcactggaggtgtgcttggcagagaggagacagactggagtagcttgaagaagcagatgccccaggactaatcccaggggccctctgtctcatgccagtacatttacatggatgtataaacagttttggtgaaactgttcaaggcattcaggtacaaagatgtctctagactcaaggaggccactctttgataggggccccattcgggtgagagcagggtgagaaggactatgatggggaagtgcagacagaatactggagaagggctctgaactctgcctgtgacacatggggaaggaccctgtgggaggtgatgctaggcctgaatctttaaggatgaagagacattggccatcaaagaagagacacggagagagaagaacatgccagtgaggagagagtacgagagccaagtcatggggccatgaaggtgcaggggtagattccatttcagcaaccacacataggtgggtctccctggaacagaacatggtggtgagggagtgtggccccgtgggcagctgtcattgatgaagggcctgtttgagctgcagcatgaaacaagcgggcaggagggcaacactggaggcaggggagccgggaagaaggctttcactgttgcaagagatggtgagaaccaaaagtagcttgggagttagaagaaggtacagattccaaaattctcttttttttttttttttgagacggagtttcactctgtcacccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcttgagccaccgcgcccgggcccaaaattctctttaaagataataggctgggtacggtggctcacagccatgtaatcccagcactttgggaggccgaggcgggtggatcacctgaggtcaggagttcaagaccagcctggccaacatgggtgaaaccccgtctctactaaaaatacaaaaattagccaggcgtggtggtgcatgcctgtaatcccagctactcaggaggctgaagcaggagaatcacttgaacctgggaggtggaggttgcagtgagccgagatcgtgtgccattgcattccagcctgagtgacagagtaagactccatctcaaaaaaaaaaaaaaagaaaagaaaaggtttttctcttatacggaggtagacatgctttttgaaaaatagataaggttttaaaaaactaaaaattatttgtaattccaccacctggtaatacccatggctaacacttctgtatcatgccttctaatttttaaatgcgtatatgttttacacaagttctttttgtaaaaatgggattatactatatgcagtgttgtgtaacccattaaaaactatttaatagagaaatcatcaggaccaggggacccagtggatgtggaatgtgagagagagggagaatgtaggatgactcaccagtttctgacttggacatacgggtggttggtggtgcccagcaatgaggtagaaaaacaggtctgggaggagagagaggatgcatttagctttggaaatggtaagtttgaggtgccttttggatatctacttagagacgttcagcagagagttggctagagtgggcttcagcaggctgaaggcgtagactgtagggtgaatggatgggtgggtgcaactgaagatatgagtagggaaggaatctttcagggaaaagagcacatgttcaagagggaggaagacgggagcccgtgaaggctgctgaaagagaatgggtaaagaggttttctgccgcttgaaaggaagtacagaagaacatttcccaggctgagcaatacgggggtcaccggcaaatgcagtttcagggggtggctggattgaggtccaatggcagtgattgaattgtgaacaagaagagtgagcagaggagatggagacagcagccagggaatactcattaaagtcatgtagcttgtaagggaaagcaaggtaaagggttgtagctagagggagctgtggagattgactgtaagtcaagatgaaatcgcttatgtaagcagctgctcagaattgagaatgcttttcttatggattggggaaatgcagggacgttcatgtggctggagcaatattggaattggcagtgtcagtaaaaggtaggcgggatggaggctggagatgatggagcattcagaaaagggttttggagtttttgtcgagatgctagtacttcttcccacagctggtatctgggaaccagcacagtcaggcaagtatctgtctgggcattgtcttaacctcttgacatttgggcagtgactgaatgtctataaactgctttcacaagcattagctctttcatcctttacagcagcactgtgaagtaggtattattatccccattttagagctaagcaaactgaggtttcaaagaacaaaatgaaccactgccagttagtggcagaggtctggtgaaacttaggcacctgagaccaagtccatggcagcacacggtctttccctgcagaaattacagcctcatctccctgcagccacaattggcattcacttctgagatgtccttccagacagaggatgtggagggtgcccagaatttgatacccaagttcaactctggcccataaagagattgcactccatctgtaaagtgacagaaccagacagatgacttccaaggccccttctgcttggtagggaggcattcttggtcaagtactgagctgtagtaccctggaaggtacaacagctgcattttccatcctcagggccctgcttgggagagagtaaagcacatttgggaagagacagagtccccctctaggttcacagttcagaacaaagtaccccgttggcattcaactccatgttggcggaatggcacatttaagttcaaagagaaaagggctttggaaggcttagattcaaggctcataagccttggacatcaaatagctcttaccaatgacattttgatgaattaagtgtaaatgaagctgaaacgcctcattccattttttctcctgggtgcccaggagaaaggattgtggagggagcttcccagaggcctggtgggtcaggctgttcgtggcctcaattcactgggaaggttgtccggagacattttgctgaactaaaaaaaaaaaaaaaaaatacaagtggtcccctgagattacttttcaccttgaagccagagactattttaactacaaataggtcacagaattctattcagcattctttaaaataaagatactgatccaggggccaaagtggagtgttccactccttccccgtgtgacagccgagctcagcgagggctttgctttaccttccccattaaggcttagtttctgcatttatgcaaatctgaaagagatgagcttctgttataattcaaccattcattcattcatcaaagtgcgtgctgtctgacaagcaccgcttggatatgaggaattgcctgtaaggagttcaggatctactcaaagagacggacaggtaaaccaagaattactgtacagtgtgacacatgctatattaataatagttataatgatggtaataacagcagctgacaggtatgaagtgcttcctatgggccaggcactgttctgagcacttgactgtattaactcaagcctcacaataactgaatgtggcaggtgaggtggcaaaacagttaaggaacctgctcaaagtcccatgagtagtgagtggcaggggtggctttgacagaagttgagcgaggtgtggtacaggagtagggaagagctcaccaaggaaatgacgagtgagcagagcactgaggatcaagaaggatcgccttggcagaaaaggatattatattctaggtgaggtggacggtgagaaatgtacactgcagtgccgttggttctggacaactggagccaagcatgagagggggtggaggagaacagggctgtaggcaggggccagtcgtgatagggtttatgtgtttggatctttataaactatgtccagagcgctagtgggagctgtctaagagcaggtggtttgtttgttttattcaaagaggggagtggcataattgcctttggttccagaaggttactctagcagatgagagggggacggattggaggtgggaagaccagatgcaggtttactcattagacagctgtccagtgatcaggagaatggaatggggtctgaattaagcagtgactgtgaggatgcccaagagaggattatggctgtgtggggacttcagcatttgagtctgggacccagtgagtgcagggagctcccctttcctgtagaccttcaagcatgggttaaggtcgtcctgcttctcaggggagaagggattggctgtttgaccctgggaaggtcctttctacaatggctccttgagagatgcatgccacatagcgatccctgcatgcaacccactgagacctgggaagggaggaaatccatcttctccagctcattattcacagacaggtgtacttgaaaataaaggggccagcgcgctggactgcaccttagccacaaacatgttcatgcactctctccacaacactctgcttcattgtgagttcccaaaaggttcttttctgtcagtaggagtcctttcactcacctgagaaaagggcaataatggcagtttcgtgactgcagccgccctttttttcttctgagatgtctgtatcggctgccaggctgcggctgggctctcccatctcatctccctctctccctctgatggcctccctctcctccattcaggagtgaggtgcgcacaccccagaagattgccgctgggcctctggagccgcagctgccaaccgtgcgagcccagccaatgccctacctgcgctcggtggagggctctgctgtggctttctgatttgccctgtcctctggcttcccttggcttatagggggtctgaatggggatctcatgtgctccagacccttgctcacatgtcttcctagttcaaagccgagccaccaggagggaagggagtagaagcagggtgctataactcctgacaaggccagacaccatgtagaagctctacactcatgagttaatttgatccttacatgacccatgagacaggaattattactctgttccacagatgagggcacagaggcttggagagttccataattaatccaagctcagacacacagcaagtggccagagcccagactcagaccccaatcttgggctcttctcactgcaccaaaggggcatgtgagaactggtgtctggaacaaaggatgacttgggtggcatcgtcttgttctctgcatcagcctcctagaagaatgaggaggaaggaataagttggcccaggagaatggtaaacaaggaggtggctctgagtggccagtttgacagggacatttggctgacacttctgtcctcaaccctcttatctggaaactggacttcttatgaccacctcgtttttcagactaagaaaacagagccccaagaagctaacgcccaggagtgctaggagttgaagtcaggtccttttcctctaggagcctttcagctaaaaaggcagacagatgcgagcagaagttattttaatgaggtcatacaggataagtgctgtattagacatagcaaagtacatcgtaaatgactaggaaggtaggggcagaaatgacttctgaatcgggacaaccaggatggattcctagtggaagtaagactggcaactctttgaaggaaagtacaatgtcttatgcatcttgacatccttatgcacctaacacagtgcctgaaacacggtgaagtggtaacataggtaatactaggaatctctagtctgaaaatccaaaatctgaaatgctccaatgtctgaaacttgttgagcttcgatgtgataccgcaagtggaaaattccacacctatcctcatgaagggtcgtagtcaaaaacagtcaaaactttgtttcatgaacaaaattatttaaaatattgtatgaaattaccttcaggctacgtgtctaaggtgtctatgaaacagaaatgaacttcgtgtttagacttgagtctcattcccaagatacctcattatgtttatgaaaatattccaaaatctgaaaaagtcggaaattcgaaacacttctggtctcaagcatttcagataaggggcgcttgcattcccctagggagtgcttccttcagcaggtttgcatcaacccaaggcttagaaagccaggctttccggccaggtgtggtggctcacgcctgtaatcccagcactttgggaggccgaggcgagcggatcacctgaggtcaggagttcgagaccagactggccaacatggagaaacctcgtctctgataaaaaatacaaaaattagctgggcatggtggcgcatgcctctaatcccagctactcaggaggctgaggcaggagaattgcttgaacccgggaggcggaggttgccgtgagctgagatcatgccattgcactccagcctgggtaacaagagcgaaactccgtctcaaaaaaaaaaaaaaaaaaaaaaaaagaaagaaagaaagaaagaaagaaaaaagaaagaaaagaaaagaaagccaggctttccatttatgaatcaatcagcagacagtgatttaacacctatgtgccagtcactgtgctggggtgtggggtaaaggaacagatcaggtttggttctgtctctgaaagcttacagaccgggcggtaaaaggcaaggggggcacaggcatgtaagataataaagtgtaggtgtgagtacatggctgggagccccgagcagggcaggactaaggaatgacatcggagcgtcacccgtgcaggtgcgctgcttaaatccctgtctctgggagagcagtctccaggcccagagacagtcagccacagatttgaaacagacttcagaattttccccgcccatcctcagatccctgtgctggttattttccatggaaggagttgcccggggggatctggaagggtttggagttcagttaggttcagtgctcccttagcagcttcctactgggagctccttcaaaccccattgggcatctcaaagcagcctgggaaacttatcagttcttgggaattatttccaccttccccactgagcgccagctgttaaggggagtgaagggtctgcaaaggaaatgaaaatgtattaattaaggcatctgaaagccttctaagagatcagcttgctgctaagcagaagagacaggtggtagggaattgatttgggtcagagacaggaaaggaagctacagacaatgtgatcttaatgtcttctaagaattctctagtctcgattccccagccacacagcagagatgaggatgttacctgtgggcttggccagacaccagactctggtctgagaccagggaggctttcaggagctccagttcagcacgcagggaccaagcctcctctgccttgctctccttcccacccagactgagaaatccagcttctgatgattccccaagcctaagtctctgagcttgccaaactggttctctcactccccttcccctcaggagtaagaatcctattcctgaacccggggtgacaaccctattgacccattctgatgtacttaccatcctcagccagtggtgcctgcctctagatgcattgattccatattggttgtgccttcagcttttactttcatagagttcacacagtttttactttcatagagttcacatcctgtatacataggacctccatgtatggtttgtgcaggttaagacatggtgaaggaggaatggggtgtgaaacccagccctcactctgctcaccaaacacgtgctctgggatgggggggtatctacttgtcgatttttttcctacaaaaatgcctttagcttgccaaggcatgtgcccactaagtctgctcagagggccaatctttataattcatacaacgtccccaactgtactgggaatgagacccggtgtataagttagtttgagacgttagcatgtgatatatacaaaagggaatcctacgcaaaatggtatgggagcacagagaaggagggaagcatttcagccggaggaagccaggcaaggcttcagagcagagctaatgagaattgtcgccagtgtttattgaatacctactacctgccaggcatttatcatgcatcatttcctctccacataacaatcttacgtgataaatattattattcatatttcataaccaagatgccaaggttgactttggcttaacagagaaggccaaatcagggtcacacagctaacaagtgattgatctggaattcaaagccaaacctgtctgacatcaaagcccacggtcattctaaccactgcaatgcctctcagggaagtgccgtcaagtcagaccttgatagacaagtaggaatttgacaggcgacaaggaggagagagttgccggcagagggaacggtgtgaggtctgaaatgtatgccaagtttaaggaacatgaagagtgcattgtgtccacatcgcaggctgaagagaggtcagcagcttaaggtgatgctgaagaggcaagcctcagctgggtggtgacaatcacttagaccatgggaaggagctgggactccattttaaagagagtggagagtaactggagtttttaaagaagatgagtaatattagatctttggtgtaaactttagagcagcggttctcaaagtattgtccttgaacgagtagcatcagcaacacctgggacttgtcagaatcccaattctggggccccatctagacctacttaacctgaaactctggggtgggactcaacaatttgcaacttaacaggccctccaggtggtgctgattcgagcttaggtttgagaaccactgattcccaatgctgcttgagtctcagctgagtggatggatggcgtgggaaagaactggaagcaaagagaccagtgcagaagctactgaataattcaaaggaaggctttaatgatggtaggggcagtgagagtcaagtggtggtgatggattcaacaggcgtttcagaggtaaaagggatggggcctggttattgaatggggagacaacagggaagggagggagagggaagactccaggctgattcatggtctctgggatgacggatggggaagtcattaatggcacacagggaaagagtagctttagacggcagagataaggaattagacatgggtataggaagtcagtaggtagggggagtgaggaaggctggcaagaggcagcactgggcctgaaccccatttggaagttgtcagcatacaggtggtagtaaaatgggaggaatgtgcccacccctgtcctcacactgccttccatcccgactggacacctaggtacaaatcgctgctctgccagctatgagctgtgtggacttggacaagtctcccaacgtttctcaaccctggtgtcttcaccctcaaaatgaaaataatagtacccacccctggattactatgagaaataaatggaatataattcctgtagcgtgcctgcactttgtggacgctctgtgagtgttcgctctctcctctccttccctccccacgtagggctgtattttcacctcctcttctggcctggagctcagctcctcagcctcacccacctcggtccccaaacacatgcccatctacgtgcatgtctgcctgctcccctgggacatgctcatccaggccccagtcttccctctcccaggccggcctgggttcattcctcttgccatgcagaccacagcagcgtcattcatcaacacagagtgcacatgtgtccagtcttgatcctactggggagaggcccagcagccttccaaggttatatgcgctgttccaacctactctcttcttgccctcacatattccccccaggaggtgggggtgtctgagccccctcttattaggtatccaggcaatggcagtggtggagcacccactagtcctcttgggcttagagaaatataattttgagttggaagccagggtctgtcccagaaccataaattagtatctgaatcttcatgggctaccatttgctcacatcttcaatgagcataaacatttcctctatgccctgcctggcaccagccacaatttcaccagtatcccttccatctggaagaactaatccagagtctacatctctgcatctcccctcaagtgccccacactcactggcctcctcttggttccttggacacagcatggtcagttccagcatgtggccttcacatttgcgccttcttctttcaaaaacctgtctcccaaatctccagtctatttccatttcattatctctgtctaagcctggcgtccccttttctgagacgtgttctttctctgccaccctgaaggacccccatcctctcatttagtcaccttctaccacattaccctgttttatgatcttcaaagaaattattactgtctaaaaccaccttgcttattatgggactatgtgtttattgactgtctccgctcactagaatgtaagtttcctgaggtcaggaactatagctgtcttctttatccgtctattggcagcattcagaacaggctctggcatatagcactcactcagccaccaggggatgggtggttggatggatgctgtaaaggcatgtggaagagaattaaccatcccagcgttgatgccaaagcacttggagcctggaacaaagagcccaatgctggggaccagttgtaggttttcggaagatccttttgctaacagggaaagcacagcagcagtccaggtgtaccggtgcgtttagcaggttggggctgcaggaggtggctgccctcccgcttgcgcgcacttcctgtgatccctgcctcccgctcctgcctccaccctcctggctcccacagctgggcctccagctcacaccactgcatgcgcggccccatctcacttcccagggcagtattatcttgagaaagaagaatttaagcatcccttgccctccctcctctctccatggggtggggaggtccagggggagttgtctgactctaggattgaccctccagtctccaattttgttctccaagttgcagcgactccttgcttcattctttaagctttaaacctaactgggtatcggtgcagcccctaacacccacacatctatggtccaactgtctttaggataaatctgctctatcaagcttgcaggctttctttcctgaagtatgtgtgttggtgaggtgtggtggcagcaggctggaggtcacagagcaagtgcccaccccacccatctggacttcggagccacctcacccagactcccaacactgtgctcaactcccgtggctccctatgtcaccttctgtgcctgctccacagatagtactagcctcattactgtgtgccaggaacaatacttgctttacaaatgttctcctatttaatcttaggacaacattacaagggcaaaagtatattgcccccattttatagatcagaaaactgaggctctgaggtcaactaacttgttcaagatcacgtggctgggaagtggtagaattaggattcaaattcagatgggtcagtgtgttctcctgactgctgtgcagagctgcccccagcagttgccacctctcgcttatagggtggtacctcagtcaccccatcctgctgcttttgctccctgccctaccccacagctaggccctgctcatcccttgccttcctgtgaatagatagtcctgcttcaaagaattccaaatgtggcacctccttctatcttccctctgccctctggccatccctcaccagaaggtcttgtggtgtgttcgatgtgcgtactgcctggcttggcctcgccaactcacagttcctggccagagtcattatatgctctgggagcttatttacagatgatttttcttgccatcctatagcttgtcaggaacaactgacatcctcccatttgtcagcgtgagagccaggcctggcttagttgtgccgatggcggtgtcggcagctacagaggcagccatctgagagtcctgttgtattacacccctttccagaacctatggaattattccttatcttatgcagccttcagataggctgcctcgcttgatgccaagctctggccctagctgtgtctgcatttgctcttgaggcaacaatgcaaaggcccagatccttagaaatagcagcatgtagtatggtcgatgcatttggactgcactgaaaggcattgttgactcttgccagacagatccctatccagatccaggagacaccctgcacggacctgccgtgtcctaggtggcgacagaacagtgggacagaggcctggctggctgtcagagggtggcaaacagtgggacacaggtgggagatcaaaacagatgctaggtgtggccggtaagtccagcaagtgtgcaagctggggttagtctggccaacaggaaaggggagttactaggagcaaatcagataggagggctcagccttagaaaaacttaccaggtgggatgttgcggcccaaagcagaggctggatctctggggctcgtgcacaaaggatggagacaagatgccagaatcaggaacagcttaatagaagaatagcaacgaacacttactgagcacttgccccatgctaggcccgatccatttgctcatttttttttttttttttttttttttggagacggagtctcactcagtcgcccaggctggagtgcagtggcgcgatctcggctcactgcaagctccgcctcccgggttcacaccattctcctgcctcagcctcctgagtagctgggactacaggcacccaccaccacccctggctaatttttttgtatttgtagtagagacggggtttcaccctgttagccaggatggtctcgatctcctgacctcgtgatccgcccggctcggcctcccaaagtgctgggatcacaggcatgagccactgcgcccggccccattcgctcatttaatcctcagaataaacccgtgaagcggaaactggtaccattcatactttactcatgagaaagcaagttcagagaggctaagtaacttgcccaggatcacacagctagccagaggcagacttaaacccaggaccctctgatggctctctggcctagtgtcagattctggtgggtagttcatccacccagcacactgtcagggcatcactgttgaatctaggacagactggtccctctcccctgggctttaggacctctagggtgatggctggcaagtcctggggggcgattacagctcccagcagggaggcaagtcttccccctgggctttgcctggtgttcgcagcaggcagagttggctcctctgggaatttcacaatctgttaagctgtttgtgccagacgaggaatctagactcttcttcatccaaatgagaatgaaaatccatgaaaacatccagatgtgcattttaccccttcttgaattagaagccacccagatgtgtaaagagaggtgcacaggaggttggccaggcctgagtgtggctcccttgcgtgtgtgaggtcaccgctgtagcagtcggtaccgtggcagcagccctggctccccttccaggctcctcaccacagagtcagcagagcgtttagtggcaggctcaacagtggccattctcctacttgggaaaatcacttaacttaaaaaaatatatattgaaatagacatatagaaaagtgcacaaatcgtaagtgacagcttaatgaatgatcacaaagaggacatccctgtgtgatcaatcactgtccggatcaagaaatatacccttagcggcatcctgaagacccccttgtccccacccacctctttcctgtttcactctctacacctttcgtctgcccaaaggtaaccattattccaaatttaacaccacatgacttcttgagtctcattctcctcatctctaaataggttactgccaaccttagacgttgctgtgggtctcaagaacgatctgtgaaaaaacagttttggggtatgactattgatgggcatatgagccatgtcaacaagtgggacacctctcagaaaaagaccaaatacacctttatcacccaggaagagtggccagaggttcagaacaatgtcttcagctctcttcctcaaaaaatggcagggattcctgagaaaatgccctgctgccctttgcagtggtttcaacgtgtgcacatactgataggaaatgagaaggggccagatgctgtccactttgtggatccaattggtcacatcactgctcactccctggggaggtggggcagttcagggctggtctctgaggcagagctggggcctccattctgtctagcaggagctgtaggggatggggtgaaaaagtgggaacagagaaggagcacagggaaggcctctagaagttctctatggctgtgggcgatgctcacagaagttggtggtactttattttacccaacaaaaacagtcctaataacaggcccgtgaatctcaccattcctaattacagggctgacaagtgggagggaaaatgaaaggaagacagcgccgtgagctggtggcactgtcgggctcctacaacagcagaaacctgtcgcctgggcttgcccaggccagctttacacaggcccccgatcacgcctggaacccatagcctcgaaataagtgtagggctggctaggccagcacaagcccttgctcattagttcaggtctgcaggttggatccccatgtggaccagttagctttgcccgttgtcagcgacccagagcttaaccagctgttttggcagccagcagggatgggagacaggcagaagagggtggactcactggtgaaaattcagtgccccttgtcccatggcctattggtgactgtattgtgggccagagatttttatcaataaagggtgcatttgggttagaaatgagcatatcggccaggcgcagtggctcatgcctgtaatcccagtactttgggagactgaggcgggtgatcacctgaggtcgggagttcacgaccagtctggccaacatggtgaaaccccatctctactaaaaatacaaaaaaaattagccaggtgtggtggtgtgcgcctgtaatcccagctactcaggaggctgaggcaggggaattgcttgaccccaggaggtggaggtttcagtgagccaagatcgcaccactgtgctccagcctgggcatcagagcgagactccatctcaaaaaaaaaaaagaaagaaaaaaaagaaaaagaaagaaaagaaatgagcatatcttcctgaaaactcagataggattcaatttcttttcttgattcgacatgtaaattgttggtcaatcttcagaaagtcaggtgtgatggtggtggtagtagtgatgtgaggaagtgaaacttaggcctctctgggctttgccacataccataacctgcctggacctaagctctcagttccctttctctttcacacctcaactatataaacactgacatctataatgcatattagttttttaatcatgggatttcttttcactcccttcaatacctacattgaattttctgaaacaataattttaaaaaataaataaaattgaagtgaatcctttaagttgcaacaaaataataaaggctgacacttctggaacattccctatgtttcaggcactgttctaagtgctttttgtgtattcattaatttaacctccccaacatacctacaaagtatgtaatattactaaccccattttccagatgaggaaactgaggtacaaagaggttaagtaactggcctaagattatgcagttagtaagtggctgagctggccctagagggtgtacccttggtcaaaacattctactacaaaatcgttccctcagttgagagccaaggatagagaataatgttaactgagctcctctttcttggatttgtctattcattcattcaatcatgacttcattcaacaaatatttatgtagtgcctggcacatggcaggttctggacactggagatgtatgatgactaaggcagacaaaggtcactccttcctgaagatggcactctagacaatcaacaggtaaactggtaaataaacaagacaatttcaggtcatgatttctgctgtgaagaaaataaagcggtataatgagccagagtgtctcgaggagaggggcccattaagtgggcaagtagggaaggctgcattgatggcatggtgcttgagctgaggtcagaacggtgagaagccagctgggccatggccagggcagagcatatgtggaggggaaagagtaaactccaagaccccaaggtggaaagtgaacttgtcatgttcagaaatcaggatgggggttagcatgactagctagactgtggtgaatgggctgccgtatcaccaacgcctggtgggccacggtaaggagttgggactttattgtctatgaacttggaagtctctcggttcttttcctaggtccacatacacccatggtctgaggatagcattgagagtccacaaaactagaaaggaagaattggccgggcacagtggcttacacctgtaatcccagcactttgggaggccaaggcaggctgatcacttgaggtcagaagttcgagaccagcctcgccaacatggcaaaacccatctctactaaaaatacagaaattagctgggtgtggtggtgcgtgcctgtagtcccaggtactcaggaggctgaggcaggagaactgcttgaacctgagaggcggaggttgcagtgaaccacatcacatcactgccctccagcctaggtgacaaagtgagactctgtctcaaaaaaaaaaaaaaaaaagaaagaaagaaagaaagaaaggaaaaattaacatctatatatttttctaagttcaaacagaaatgtaatatttccttcaattatgaatgtggtcaacaaagcttcatggtattaaccacacctgtgactttgtcaccaatggtattaatttagtgttgctgttagacacacttccagctcttgttatgtaaagaggcacagataccactatagcacaaaaagtgtacacatattttgataactgaatttctatgtagtcattttaaaatattttaaaataagaggttaacaggtatcagcagactgttaaagaggtccatggcataaaaaaatactaagaaggcaggccaggcatggtggctcatgcctgtaatcctagcactttgggaggccgaggcaggcggatcacctgagatcaggagtgtgagagaccagcctggccaacgtggtgaaaccgtgtttctactaaacatacaaaaattagccgggcatggtggtgcacaactgtaatcccagctactcgggaggctgaggcaggagaatggctggaacctgggaggtggagctgcagtgagccgagatcgcaccactgcactccagcctgggagacagagcaagactccgtcttaaaaaaaaaaaaaaaaaaagctagaaggcgacacggagaaaaatggcatcgtctgctttagctttcccaaagacccctctggctgcaacgggaagaggggattgtaagaagcaggacctcacatgagctctgtttacacagggagttgaatttaaccctcaccacaatcttaagaagtatacattattttgcctattttagagatgaggaaactgaagctcagatttctggtaattgctcagctggtgaatggcagagtcgggattcaaacatgcatctgcctgaccccaaaaagcaagaggattgaggattcgtgggccagtgaatagaagcctgtaacaagagggtcaagggtaaatagtatctgcttggcctcttgagtcagcttggacctctgtgccgcataatttcacctgcaaatgaactgccagccccttctttccttagcgctggttcgttcctaaaatctgccctctataggccaataacacagccctgtgccgagccaactaaatatttcatggggactttaatttaactctaaagaaattcatccagccccgagagtaagctgtaacctcgagaaatagcaccagggagcacttggacctgcggatgacattgccactttcccaggaatgctaatgctccactgggcctctgcctcttcaatcattgctgtggataggcctggcccagtgagcagggatgatttctacaaacatgggctcgcactggttagcaaagacgtgtgtgtgtgtgtgtgtgtgtgcgtgcgtgcacgcgtgtatgtgtgtgtgcgcacgtgtgtgtgtgtgtgtgtgtctgtgtgttggcacaggtgaacaattgggtgctatttactgttcctttattccctgatctttgttcctatatcctggttctgaaagaagggagaggtggtggggttggcatccagtctccccagtggacaaggacaccaaatattttgcaggtgccatgtgacccctaagagtttctctttgtctccagcccgcggcgggtggcgtgggcagacagcctgactcatgtggcaggagagcagatgtgtgtgttctcaggcatgtgacgctgaagtctaagggatgagccctgcggatgctcgtgtgggccaggagtgggagtgagcctccctggctccttctgatcccattgccctgcagctcggtgaccccagtgagtcctggcaagttccctgggcatctcaataggtgcgggtgggagggagaaagccgcccgcaggtaaactgatcaaaagacaggaagtgagcagataatctaatttgaaatgggctgagatacagatgttattctgctcaaatgcacagcacaaaaggactggggcctggggagaattgggaagcagctccgtggagccagtcttctggcctctggctcagcctgggcctgtcatctccattccttcccgggctgtaattaacacccctccgctgatagctgctttaagccagattggagcatggggcccttcctcttctggttgggcgtcccacatgacaccgtccaaggtgttagagggaaccgggtctggggcagggcaaggggagaagggcgccctctagtggggaacctacggcttcaagtccttaggttggaggatgtctgatcgcatccacagcatgacctgaatctggttctaatgttccagcctcctgacaaaaatccctcctgcatacaggcatctgtcagaaatcagcctgcttcagctgccagcaagaaggggctcgagggcaggccacgtttagagggggggggtcccctccttacccacgctgttggctgcactggctcttcactagggactgactgtgtgccctcttggggaaagtcactgcgaacagtgcagtaataagaaagccaagcgcacagtcctgagaatgtgtacatgggggtctgaagctagctttcttcatgtcctagctgcgtgtatttgagcaaatgatgaacctctctgggtctcagcgtctttgtctccaaaacagggctaatggcagttttgaaatgttgtttatgttaaattttttcaaagatttgatccctgcttcaagaagtttatctaatgtagagataagatatgcacacaaatgtaaacagcagtaatagtaagagctaacatttattgtgagttatctgtgtcaggcctaagctttgtgtgggttgctcatttaattcccatagaagctccatggaggtgggaactatcattatccctactttattgatgaaaaaactgaggcacagagaagttaaggtcacgcagctcataggtggcagagttggagtgtgagtccaggcatcctgtactaatacaaggaaatttatagtatatgccatggtgggtggcatgagcattgccttctctctttggcgacagacaagggagggcttatgcctgagaagatgatcagagaaggttttatgaggatggtaaactttgaatagaccttgaagagtaggtggagttgatgtttggacttttgatgtggagtaaatataactgcagaaaagtacaaggtgtgttgagagccagctgagttggcctggctgcaggggaggggcagtgtctgggagaggagtgatggagatggggctgaacttgcaggagtaggcagaccatgagggccagactcccacatgctggactgcagaggagtgggagtcgtgaataatttcttagggaggacaggtatagttgctgtggtgcgtaagtgagttttgctagaaatattgagcacccgctttattccaggtaatgtgttttgtgcattatatgtattatttcctttgtcctcataacatctctgaattggcaattattatccccactttacagataagaaaaacgagctgggagaggatatcacagctatctaaggtcacactgttagtaactggcagggcgaggacttgaacccagtttggcttggtgccagtgacccaggcaatgtagtcacaggtcagagcaggtggagggaagcagttatgtctttgaccttggccttattaggagggcccctgcagggactggagagaatggcaggctaggaggtttggcaacacaaggacttaggcaccccttggttattgtaccatggaggtcatgctgaccttggctggagtgatattggtggagtgatggggtggagaccagagtgcctggagtgtggtgatatacatggcaagggagtgaggagaaaaatgcagagggccctttcttgcctcccttcaatctttttcttcactagagccgattgaatgtgctgcatattcagcatgcagactctgaagccaaattacgtgggtttgaatcctggctctgccacttacttgctgtgcaaccttgggcaagttacttgacctctctgtgcctcagttttctcatctgttaaataaggataataatagtaacctatctcatagaggttttgtggatactgagtgaggtaacatgtaaagggcttagttcagtgcctgatacataggaagagatatgtgttagctgtattgatattacaagtccaatactgtaggacattcactgtagaaaatacttcaggaccttctgattgctgtctggttcattgcatcctctgctacctgcctgcctctccagcctcatcttacagcatgctcctggccctgtgtgttctagccactctggccttcccacagcccctgaaaagcaccaagctccctcctgcatcggggccttgacacatgttgtaccttctgtgggaatactcacccaggccttctcactggtccctcctgttcaggcagctgagtctcatctggggaaaactcctgtggaccttccaggctctgcccaagccctgttccaccttctcatggtgacatatataacccccctataaacacagcacacgtgcaattttacaatttttttttttttttttggcaatctgatacttgttcgcctcctctattggttgtaaattttttgctgtcagagactgtgcctgtatttgttcaccatagtattccagcaccttgcacactgcctggtgcagggcagagagtcagtggagagctgcaagggtacactgagcattagagaggaggaaacaggcggggagggggcattgggctctgcaggcagtccccgcccaccctgaatcccccagtgagctcagcagccccatgttactctcggcccatatcctcatccagagccaaatgtgcattatccctcccaggaaagccaggcttgctaggcacagagctgcttcctatctgtgtgtttacagataatgccagcctcattttcacagcctcaggcctggccttgcttggaattccataagccttttcaatatacaggggatctccagagacaattaccttggaatgaaggtttccaggagtgcttattctgggtagcgttttctcatcccaactgtagcctcccaaagctttccggagttaagtaacacaattacagagttaaatgacattgaagaatgggaggcactctgcagccccagcagcaggtgaaacaggagatgtgaagcctgacttgtaaagttgtagaaagctgctggcatgtagagggggcaggggcagctggcctcctcaagggcagaaagctggggtgaggaggtgtactgtaaaaaggtcagagaagaaagatctggaagctgatcagagatagaagagaggatctgaaagaggattcagagggagctggagaggccatttaattcattctccccaaaggagaatcatgtttggaggaagggactggggagaatgactggctttccaagctaggtactggatttttcccagagttttccaaaggactggacagcatgaggtctgggaggcctggaccccacataggtccacatagacagacggtcacaccagagaagcacattgtgtcaacacagctgtgcatgtgctccaggtcacccgggaaaggccgcaggggccagagtgggggacgcggtgaccagttagggctgcacatacacagaacaggtctgcctgcctccaaacatgcccacaactcatcataaggtctccataagcccttgctaagatgatcctcattgtcaagttcagcagcagcatcattgtcatcccaacagcaaagacttactggctacttacttcaaaccaggccccatgctcagcatttacagacatggcctcattcatcttctcaacaattgtaggagctaggtactcttattatacccgcgttacagataagcaaactgaggcttagaaaaagttgaataaatgacttgtccaaggtcatacaacaggtaagtgagtgcgagtccaggtagttctaagccacactgaaaactaagttcagttaccccctctactgccttaatagccccttattgatatggcagcgctctacagtgttatgatttataaggctcttctacaaccatcatctcttttgactctcacataatattgataggctggtattgccccattttacagtggagaaaaatgagtcccagagaagggaagtaaattgcacatggccatttggacggcaaggagcagaggcactggcagttctcctgacccgtcccatcctcccattagcatggctgtatgtaagggagggcagccaggccaggtggaggaggcaggcctgaggctgcaagaggtcatagccaggcgcggtggctcacacctgtaatcccagcactttgggaggccaaggcgggtggatcacgaggtcaggagatcgagaccatcctggctaacacagtgaaaccccatctctactaaaaatataaaaaaattagtcgggcatggtggcgggcgcctgtagtcccagctactcaggaggctgaggcaggagaatggcgtgaacccgggaggcggaggttgcagtgagccgagatcacgccactgcactccaggctgggtgacagagcgagactccgtctcaaaaaaaaaaaaaaaaaaaaaaaaaagggcccctttttggtttttgggccccggtaagggggggggggggaattttcccccaaaggggggccccttttttttaaaaaaaagggggggaaaaaaaaagggnnnnnnnnnnnnnnnnnnnnaaaaaaaaaaaaaaaaaaaaaaaaaggtcagcgtcatggtgctagggcactgctgagtgggagggagggaattttgcccgaaagggggcagcagctgtctgaaaaagaagggagggagatgagcaaggctttgctgtcttcggatgctcccagatctggtattgccgttagaccactcctcatgccattctcaggaagcccggagtgggagcagggggcccaggcagacgcagaccacagccttattgtgaaggctcatcttcctcccagccaggctcatgtcccaggagaagagcagtggccacgccaagccttcaggctttgacagaaatggtggcagctgcacggcccctattaatctccaggaggccaaagagagtatgttttggaagtcacctccaggctggctcccgcctgccctccccttgtaaactctacaaacatccaggagataaaagaggggatctctcagaggcagaacacaaagctcttcaaagaacactttcagtcaaaaatagggagaggagagaggtctttctctcggagggaatgtatttatatacccctgtgggggcgcacatccgccccatgccacagccgggcacatgggatgcgtggagcactctctgcttcccttcacctgtccttttctttctccggagacctaccctgtggctctaatggtcccagctttttctggttttccatcccccctgggttacgattttagacctgccttccccagatggccccttcctgaatttctttccctaaaatcaaatgtccctgctagctgctgctcttcactgacgagtctggtcatcagtttcctcctcagagcgttcaatactgctgaccgccatcatccacttaagcaaagtggggaccactcatgtaagcgctgtctcttctagtcaggcacattaaagcaggggatttgacagctggaaaggagcttagagagcctctgcttgaaccctttcattttacagttgaggacactattccagacggtggaataatttgcctaaggtcgtgatgaggttgtggcccacaagtgacaagagtcagggctgctttttggtttaaaatgttaaaactttgggaggccaaggcaggtggatcacctgaggtcaggagttcgagaccagcctggccaacatggtgaaaccccgtctctactaaaaatacaaaattagccgggtgtggtggtgcacacctgtattcccagctacttgggaggctgagacaggagaatcactcgaatgtgggaggtggaggttgcagtgagccaagatcgcaccactgcattgcagcctgggcaagacagagcaagactctgtctcaaaaaaataaaaatactaaataagtaaatattgtatttactttgaagcactcagaatgtcaaccaaacagctgcaacctttttgttgttgcaattacagagtggtactcagttaacggaacgacagttatcatgtgtaagcttcatcggagtcaactaaagatgaataagccaccacccccatacataactaatttgttctgtgcaccaagaacctgctttaaatgtttgtgccaacttacaaccccatactgtgccaggcaaggttagtggccattaaaaataccaccaggacagggttatctaaagacacattcagtagtgtgttaactatacaaaaaaaagacactgtacagttaaaaaacaaatcctacgtagccttacattttacttattttcttcaaaaaggaatgggttgtgtatgggggggtgggtgttaaatgcttgatatacaagaaaaaatgctctagaaccaacttcgtcatcatcatcctggtcttcatcttcttcatcttcctcctcctcctcctcttcatcttccttgttttccgcctcttccttttttttccttgcttttttcagccccgataacttgcttttctgctgcatcggactttcttttagctcagtttgcagcaatatcctttggcatttttcctccagcttcacagccctcttttcatatggccgctagtcatctgccgccgtgttagtccacatcttccagctcctttgcaacatcaccaatggacaggccaggatgttctcctttgatgtgagggcaatattcaggaaagaacaagatgaaggtcaaaggaggcctcttgggtgcattaggatcttttaactttttttctgtctcccctttaggagagatacgggtttcatttctctttcataacaggtcttttccacctttgccctgtctgcagattttcccttctctttagcagacatggccttccagcactgagtacttctgagaaaacttggcaaagctgactgagacagctgagtgctgcttctcctgctcctcccagcaagtttgcacagactgtgcacctgatgagattttgcctgtcagcttcttagggtcgtctttgcctgtgtttagctatttgttttcagcaaggcacagagctgcccatttcccatctggttctcacttgccctggtgctgtctcgatggagctcagtgtacttcagtggctgtgaaagcaggagcagtcaccaaaatccaggtcttctgatgtcctgttccctgctctttccgcctgggagcatgcccacccctccctggcctggcccccacctgccccccaggaggcagaggagcagaagggcttggatgagttgtcattgtacatgcccctcagcctcccacaccagtgattcctgggtggaatcacagtcccagccccctatcttactagtttggtttcatggcacattatctcttcatctgaaggctgctttatagcataatgtcttttttttgttttgtttttaagatggagtctctctctgttgcccaggctggagtgcggtggcacgatctcagctcactgcaacctccatctcccgggttcaagtgattctccctgtctcagcctcccgagtagctgggactacagacgtgcaccaccatgcccagctaatttttgtatttttaatagagacagagtttcaccgtgttggccaggctgatctcgaactcctgacctcaggtgatccacccagctcagcctcccgaagtgttgggattacaggcatgagccactgcgcccagccataatgtctttgactaggtaaaataacgaaggcacatgtgattggaataatctgatcccatgtgattgttgctgataccccagtgccttcaagctaaagtaggtaattactcctctatattgagaatataatattaaatgcaagaaacgaccgccacaaacctttcatggcttctttcagcttgtcactgccctttcctgtctccttccctgcctccctttcccccagcgtcctcttgaccggggacaaaggaaagaaagactgggactggtgggaatgtgccagcaatgtgtgcatgaagccggttccctgtttgtagggaagtgtcagtgagtgagtagacagaaatgctctgtccagacgtgaggcacaagctctcccttggcatgtggtcattctccctgtgcccagggaagaaccctggtagtgagctgctgcccatctgcagatgtgtctccacagggacatatggaattgttttggcataatgtcacagttggccaacttttatcgacttgtaaaatgatttccaaattttaatccaaagtttgccctttgggaggaaagcagcgtgtgaggaaaataaacttgaggatagagttgttgactttggttaattgatttggattttttttttaaagaaccagagaaaggaatggatgccacgtttacctcatgcccatttcatcacttttaatttttctaatcttgccatctttcctccagtttcttcattccagcccatttaactcttgtttcctcccctcaagtttcaggtaggggttggctaccaatttggttcatttctgttacctgacacctgtgctcaaaagctgaattcaaatcagtgcctctgttgtggaggggctgaggctctgaacggcccaagcaactgtctaaagagtcccccaaatgaaggcactaacaatcctctaatcaaacctaactttgaatgcaagtgtcaattcacttgctagcagtcatcagcactgtcttggagaaatacagaatggatcattcacattttctattttgtagtgaaaatccccttcatctgcaccctagttgctttttaaggatgacctcaccatataaggctccgagtttgttaagctgtgctggatcgtgtgactgctttatggggtggaacctgaattggtgatggaggattggggttgaggtggagaagaaactgatctttgccaatggatttatccttcctgtacacaaatcataattcccttgtgtgtaaaatgagggccagcacatctgtctccccactttctttgcagtgtttgtacgtagtcattcagaactgattagcctgtttgtagattgttggaccacacttcacttttcttatttcatcttttgcatcaactgatcgaccagcattagaaaatgtcaatcattgtaggctcgtctgagatacagcgcccaggtcataaaaacatggctcttaacaattagtacagtataagttagaatcatcagggcagctttttacaaatatagattcctgcgtcctaccaccagaaaatctgatccaggaagtctgggatgagactcaggaattcacattttaattgacccagcaggtgattctgaggtaggtggccccatagacagcattttgagaaccaccatagaggattgctgggaaggacccaggcactctccttgatttatggatgaggttaagggagcctagagaagtgaagtgactagtccaggttggttagttggttgttagagtagaggatgcattagaactgagcaccagttctgggcttttcccactgccccatgtgtaggagagtagactaataggaaacagacttgctttccacaggattgatttaaattagatacaaggaaaaacttcctgacatagaagagtatgaggaagtctacatctttcccagaagggtttaattcagggctaactctcatcagatgtgggcacttgaggtacagtttggaggcaaggggaaaggaaggaagcctttattgaacaaatgctggttgttgtgcattaaggggaccagaaactcttcttcgggtctgctaatgacatctgaagtttcacctggacagcgacataagtggccagtgatccaggaggcctgaatcctagccagctgggatgagctttgtgatgttggaccacttgctcagttttctggtctctgctttctcactgtgggacaaatggggttgcattaaggtttttctgatttctgtggttccagcatttttacttttcattgtagccccttcagcaaagtttcttacacaccataagcagtcagtggagttttgtcaactgaacgaaacaaacactactcaatattgagaatgggccaggcgcggtggctcatgcctataatcccatcactttgggaggccagggcgggcagatcacggggtcaggagtttgagaccagcctggccagcatggtgaagccctgtgtctactaaaattacaaaaataagccaggcatggtggcccacgcctgtagttccagctactcgggaagctgaggcaggagaatcgcttgaactcaggaggcagaggttgcggcgagccgagatggcgccactgcactccagcctgggcgacagagggagaccctgtatccagaaaaaaaaaaaaaagtattgagaatgcaggagcccaatctgccaatttcctcctcccaagcccctaccctaggacactttgagactgtctctgaacagtctggtagtgataccccctgtttttaaaattatttatgtatttaaagggatctaacgacaagtgaacatgagttatagcttcaatatccatgtacttttatgagtgatcattcagatctgtatgcagtgttgacttagagccactcctcaagcaagaagccagaccagcatcacatctccaatagcagtgacggttgctggtcgcaagtctctgtgcctcttctcctatggccaccccactgacgggctgtctctgttcttttcagaaagcagatctggctgtggcaggcctcaccattacagctgaacgggagaaggtgattgatttctctaagccattcatgactctgggaattagcattctttaccgcgttcatatggtaagagacttattttataagcatttatgtcattaaagttatttgcatgcaaacactgagttatacgggaataatgaatgactcatggaaatatttagatttcaagacttaaatgcaaatgtgctgggctattttttctcctatcatctgcacgaacttgcaaactgaagggatggaaaagtcatgcttgtgggctttccagtaaaaattacttctgcctctctgaatagcgatgaccaagaatggtcattcaatacttggtggatcctgtgttggtgattggccccatgggtcactttgctcccttgcctgcagcccagataagtcaccctagcatttctcaagcacgttgccaacttccaagtctgtgttcacttctagtgttgcatttggcgagggaatgtagattccttctctctcgatgatctgtcctggagaataaatggtagataatttaatgtcatttatacctggcctgcccttttctgcattccatgcccccatcagaaagactcctctggctaggtaggccagggtgagtgtcacagtgagtttgtgagaacacaccaataggcagcagagtacagacacgaccttcaagtatactggccggtgggaagagcagaggaagagtcaccctggctgggtctcatccatcagtgaataatcatgacagtgccagcaaatagctgactttgctagtttatcttgctggaccagaagagccttcctttcctcttgtcagctgaactggctctaagtgcagagcgtcatacagatttgcccaatacactagtcattttcagtgcccatgattcagctgccatggtatgctccagaacagagcctgtacctcgaggctgcccaacagggtagagaccaagagatcacccaacatgcctgctgaagaagtgaccccttgccaggccccacatcccagctctagagaaaaggagatcgtccacctttgcagctccagcctatgctcccaaccctgtgatgggggttgttgttaagggttgaattgtgtcccccgccaccaaaatatatgttgaatttctaacctctaggacctgtgaatgtgacctcatttggaagtagggtctttgcagatgtactcaagtgaaggtgcagccatgctagattaggctggactctaatccaatgtctgacgtccttataaaaagaagggaatttgaacacagacacatagaggagaatgccttgggaattcgaaggcagagattggagtgatgcatttacaagccaagggacaccgggtattgctagcaaccaccgaaagctagaggagacaaggaaggatcctcctagagtctgcagagagagcctggccccaccaatacctcgatgtggccttccagcctccagaactatgacatgataaatttctgttgttttaagccaccagttgtggtacttttttatggcagtcctgggagatgaatagagctgtgtcattcttattttagaaatgaggaaactaagttgtaatcagtttaaaaacatgggcaaggccacatgcttataagtgaaagaacagggttcaaacccaggaatgatgtgtttgaagcctgtgctttctccaggacagcagcctgccaccctcctgtgtgtggtctttgaatcacttgcatagggcacttttgtgcaccctttttctcatttggtcctcaagatggttctttgggggaaagggggcaggtatgataattcccaatttatagacatggaaactgaagtcatgcttggagctagttgagggctgagcctggaacccaggccccttaactccaggagggtgtcttgccatcgttacatctgttggtactcactaggcagtcttccagccagcaccatttctggagctcccctcccccacattgacccctggagtcgggggacatccaaaagaaatggaggcacacagcctttgtccaaactaccctgctgtggcttgtggtagccactcaactaggctctggccttggtgtctagattcctggagggaactaaagccttcctggtgactcagtggcccatcaggaaccagatggcagaaggtacctgaccccaagtgtttttgccaccaggaaacacctactgctaggctgccctccccacctagggcaccactgtcctgaataccaactctggccagaaagaaaccacaattcaccaatcctctggacatcccaaattggattgttgactaaatgtttcctaccacctgaaaacctgtatgagtttccctgcattcatttctgggatgacaacttttctgtgtcaacttggctaggttatgttgcttagatgcttggtcagatactagtcaggtgttgctgtgaaggtatttgtagacaggattaacaactacaatgaattgacttcctaaaggagagtactcttgataacgtgggtgggcctcatccaatcagttgaaggacataagagcaaaacctgaggtttcgtgaagaaggaattctgccttaagtctatcacatagaaatcctgcctgagtttctagcctgcctgccttttggacttattagcccccacaatcctgtgagccaatttcttacaataactttccctgtctctcccaatatctctatctctgtccctctctacacacacacacacacacacacacacacacacacacacacacacacacacaccctgactgtttggtgaggattcctctcctcttctggcctccacactgaagcgccaggatgccacgtggctgcctagacctgattgataacagggggccaagcaagaaatgagtgctgggattaacagcttacactaagcagaactgacagtttctacattttttcaacaaatatttattgagtgcattctgtgtgtgagacaccatgcttaggaagtaccaaaaagtcagctgaggggagaacaatcccaaattgactaacccaggggagatatggttagaataagtctgagatgaacgttgttatgtctgaaacagaggagggccttaggaagatctgctgtggctaaaggatgaactggtagagtccaccccaagagcctaattctaaacttacatagagactctatctctaatatcatagtgttaaggtaatgaaattaaatactgggtgttcgttgttttgcaatttttctctagttgttatctgtgagcaaaaatatgggtaatttaatcacatttatgatctataaggatcgagaatgtctatgttagttctatgtttatgaggtcacctgactgatgagttattgttaccaaaaagtgagcatctggtggcaatcaaacctgtgtgcgaatgtaaaaataattaacttagagtgcctagttaagaattattgctaaagcctccaaaataataagtagtggcaagtatgcctctgaagtctaaagaaataatttgtgactttccagcgatccaagattatctaggcattttcatgaacacagatcatcaacagttgattgtgggatatttaccttcttcctaacactgggtataatctctgtttctgttcaggcatccttaggaccaaaataagaatgttttgctctttttaccacctactccctgttactcacaggctggctgaggagtctggctttggcattcgttactgtttttccatcctgctttttaaaagtcactctctctctgtctctctctctctctcctcccccccgtcccaccctccttccctcccttctttctctctctctctctctctttttgtctttctctttctttctcacccaacttaaatgtccatggtccttttctattcttattctaccaactctccctggataatctcactccctcccaaatctgtgaatctaaccctggctgctcccctgagttccagtagtgtaattctgacacatttcttcacatctccatctggacgtctcacaggcaccccaaaaactgtgtcacaagctgaattctgtgtgtttctgagtcacacttatgcctccttccctgtgccccatatcaggcaatggaatttccatccagtaacctgagccatccttaggttttcttaccttacaaattctattggtcatctcacctcccaaagagttctcaaatatactgggtatccccacttgtgccttggttcaggctttcctaatctctactgccattcctgcagcctgtatcctcctttagggcaaggcatttcttgtccattactggatccccatcaaaaggccacagtcattataagcattcactaagaaacagcagagtgagaaccatggactctggacccagactgtctgggtttattcccagcttttacagttattagatgcatgtcacatacatctcaccttcttcatttgtaaaaatgtgttgtcgtgcaaaattaaatgagaatacatatgtaatacactcatagcagtgcctgacatatacacaataaagtgttagctattatactcaacaaatgtatattaattgttccttcataatctatttgcagcctgggtgttggtttaaaaaaaaaaaaagacaaatgtaatcatatcaacctccttcttgaaatcattcaccagctgcccatcactcacaaaaaaaagttcaactttcctgcatccaggtctttgcctgcaagcacctttgccccttgctgctcactgctcttttgtcaggtcagccccttcctgcctcctcatctaggttcacgctcatctacctgcctctcagccagctaacgaactctttcctggctttcaatacccagctcaaatggcacttgctcttccacgcagctcccctagatggagctgcttgccctctgcctatacttctattacaacacttttaggttgcattacattattctttgtttatctatctctccctttgtatcctccgatgggaggtatattaagggaaaggtaccctcttgtcagaccatagatttttatgatacgatttttggtatggaaaatgtggtcatcctaaacatgcagtatttacttgacaggaaggaaggagggcaggccataaatccagtgatcctgtgggcagtgaatgctatgctttcctttgtgctcctgattgggcagtactgagccccaggaacctgagattctattagggaaccttacagggccagtattctaggcagcaggacaagtgacccaaattcttttttaccttctggcctttacccctgtaggtcttgagaacaaacagaagtgggatgcagatgtttcaggcagcctagatgcagcctctggctcaggtctggctgtagctgcctcctgaactcactgctctctctctctctcaatgcctgcatattccacacacaacatagcatccacctgagaaagtatcagaatccgtggctagggccagatgggcttctaggctatatatagatggtccagcctttagcctttgttgtcccctgatacttcaaggatgggagccaagtggcagaacatctgaagttcaagactcttggtttccctggcacatcagctcatctccttgtaatgataagtttagtatttggtatagcagtataattccaaggacattctgcagtcaagggttttatggtattgatgcatactttgagctctcaaatatctgtgtgaatggaggggaaaagaacatgaaaaaccaaaaccatttctatttgacgttagagtatatcatgtagttttctgtctctttttttctgcagcagcaatttacctaatgatgttttgctcagattaatattaaagtgagtttgtattcctcaagcacaccccgactattatagcaaggcatcatcagactgcgccagaagccaaactgggattaagtgtttggcccatagaacccccacatgaataaatttcatctaaacagttcgttgttgctgggtgcagtggcgcatgcctgtaatcccagccactttggaggctgaggcaggagtatcaccagggttcgaggctgtagtgagctatgactgcactgcagcttaggcaacagagcaacaccccatctcttaaaaaattaaataatttaaaataaaaactcagtattgacatcttcaaggagattgggtatatgtgtaagatggtggtttgttgactcacgtctcctaatttataaagcacttccatatacagtctctggtttaacggaacagtgcccggaagcaggtagtatgattctcattttacaggacaaaattctgaaactctgtgagcccagttagtgcagaggaaagaggaaaggcaacacaatgttgcagggggcattgaaaccaggtttttggtctccaaatctccatacatgtccaactacctgtctttacagtatcataggtgtatttctttcagtgtcaacgctattctttagatgatctttcaagatcctttcccatctgaggatactatctctgatcccagagaaggtcccaagccagctagaacacccgagactccctggaaaatgtgagcttaccattttccctccataccaacttgttccacctttggttaacaaatgggaaagttttatactctcttctttttctcttcttaactcttagctagagtcttctttctcaagaaaaagaaaaatcagacagtgtttaaaaagtaagggagaaataggctgggcacggtggctcatgcctgtaatcccagcattttgggaggccgaggcaggcggattatgaggtcaagtgttcgagaccagcctgaccaacatggtgaaacgccatctctactaaaaatacaaaaattagccgggcatggtggcacacgcctgtaatcccaactactcaggaggctgagacaggagaatcatttgaagccgggaggtggaggttgtagtgagccgagattgcaacattgcactctagcctgggcaacagagtgagactctgtctcaaaaaaaaaaaaaaaagtgatggagaaataaatgctgacattaaattaatgcacgacattgctggatatattacccgcttttcaagaaggtctgtttcatttcagaaagactgtctaggaaaatggagaacaatgctaagtaaaccagtgaatcatttctaatactgcttaatactctgttctaagaaaatggaaaatgaatagagttctgttccttaaagctaagtaacatgatagcccatataatggaaatatggatccctgaatgtataataatattggttatttattgagtgcctctctctgaagaagctcaaggtgtgttaacattattttagtaattctcacggcccctcttcatgtggattaaggtgctccattcatggtgctcctttctatgggggaagacaatggcacccagagaagttgagtgacttgcctagcaccaccactcagcaagtccaggtcaatgccaggattagaatgtaggtctcctcacaccagattttcagccagtaagtgaaaatagatacactagcatatgagttctatgggcaacagacccatctgggtgctttacgtggataggaattaattacttgcttccttttttcctcttggagtcagaggtggaaagtgcatgctaaaccaaaatatcagcagacaatccattgcagacacactgagggaagccatccatgggatcctgctgagggacaggaagaaatcacctcctcctgcctctcccagaaggagtcttggagacactgcgttctcttacctcttcagccctggacagtgtgtgattgaccattgggcactgctgggagttgactatatcacaagcaacctttctataaattgccatttagttctaaagactgtagaaatgcatatgaaggaccctttgtccttggctatgctgggaggggatagagtttcaggaaagaagagagctcgtatcatgcatttgtgtagggaaatggtgactaagctacagagccctaacacagatccaagagaacctgcaacgtgtctggtccactctgtcaatgacgtctttgggtaggctgaggtgggattgagttctaaaggttggaatcactggcttttaagagtcttccttccagaagaaagcctggtattgccctaagtgcttctctggagagccctggaggaactctcatgatgcatatattacagccatagaagctccaggagttctgaaaagtggctgtagccagatagcattcttccccaaagcatctttaacatgtgtcactgtaagagagaaagtatagtatttcttgtccattgaggaaggcatcagtataaaaggaagttcccgcctttgtaacacaccatctccccactcccccttcactcacggctaccattagacagaaggagagtgaacatacatacagctctatgagttaactcactgagttcccaaaacaaccccacgaggtaggttttattattccttccatgttatacaggaggaaacagagacctagaggttacccaacttacccaggattgcatgtcttgtaaatggtggggccagaattcaatcttgggcagtctggctgcagagtctgggttttattcactacctgtcctgactgcctggctccggtgtccccatgaatctggcttcagactctgggaaagcaattgcattcttccgagaatgtcatttcttccagtatatatagagtgaagtatcaatgagtcaacagattgtttttaaggataagaggaactttgggcatgaaaggggggtttaatgccacttcatagctccatggacagccccactactatcatgcaaaggacctacacacaccaggattgtggtcagttgatgaccagccctttgtatctctccctccgtctaagagcatcagggatgctgattgatggtcagtctgatgcacagtccaaatgtcaagggagctaattctaattttgctgttgtctaattttcaatttcatccgcagagcttgacctgtcttcaacatttggggcatagactatatataaccacctatctacttccaaagtgattgtattcaccagaaggaactggcccaactcacagtcaacagagacgtgtataaatcaatacaaatgcctataaatacagcagagtcacaataaatggtgatgggtataaataaataatgtttaagagtactctaagggggtgtgtaggttgagagtttgctggcattggggagaaggcgtgggattaattagggaatttattggagtaaataaagatgcgaagatgaaaaggagaggaagatgcagtacagctgccatttgaatgaaggagagtgtggcatgcctatggcacagcttgatgaatgagcaccagagaaattgaagccattgccaatgatttgagcgaggcacttaacctccctgggtcccagttcttccatctgtcagtatggaaaattgggtattgaaatcaagagaacatagtgaagcacttttagttcttcaaaagaaaggcatcactgtcatacctcctttgggctaaggaaaatcaattatttggaagaaatgcctatggcatatgacacctgatttgccccaagcgccagtaactcacatgtcttttgggaagaaagtgatctaaaccatccacatagaaaaaaatggtaggcattcagaatcttgcaagacacatacttctctttggcatcatagagacagcatggatttagcctaagccaaggctgtataagcccagacccaaatctcaaatgactgcccattccttgctcttctggttggcgtcagtcaatcacaagtagaatcagatgttgccttgccaacgtgactgatatgtttctgggggagctttgtttatgtcatggtttttgttcgtgtgatgttctctgttttataactttggtctctaggaatttttcccacagctgtgcatcattccttatcacccataaccaaatatggcagctttaaatagtgctgtcattttcctcaatttcacttgtgatataatcaggtatagatttctgacattgagcatctaatgggttttcagattcagaaagcaacagtaatagatttttcagttgagagacagattgaaatagtcataagtgacagggcatgtggaattcatgcacatttactcagagaaacttgggggtcaaaaaagaccccaggagtggaccacactagtgatttctattgcagtaggagtataggcatgatcggctcctttactgcttctggactctgtatatggatgctaccctctctgtgtcttcctgtgtctgcctctggctcttaggatgatgaaggaaacacagtcaagccatgatggacacaggaatgattaactggggacttggattctgctgctctggagtcctttgccttctgttagaggatttatgtaatgacgggatgagccaagctcaaatgatttcctcattcttctcctgttcccttccctaagttactgggttttgtcccccagatttttcatttttccagtaatacctgagtgttgtatgcagactgagcatggatccacagtgggtcagagaacttgcaattggtatcaaagggcagttccgtggtctgagccaatactgtgaaagaaaaacagtttcagatagatcacgtgagaggtcactgtcatgctgctgaaaggccacagtgcccaagaacagctgccctttttggcagaggatgagtatttccatcctctccgtgtaccctccaaagaggaaagtaaaactgcaccgcaggcccaccggctccctaagaaggaagggaaaagcatccagaagaggagcggaaaatcacccatgatgggggctatgcaaatacaacaggagcgtgcagaactgtctcctcccacctgcctcagatgcagccgtggaaatagctattgctacttggagtttctcagcttcttctagcttcccctggataatgaaagctcagaaggctggttgagtttagctcggtattggcaaagggagttcccttttgtgtttctgggaaacccagtgtaaaaatgacatgccttgatagtgacagtaggttgcgccatgactgatacaattttgagcttaaacgcttacctgttcatagaaccctgagcttagtactgattttcagtcctatccatggacttcctggatttctggcatcatagaatcatagcgttttccatttacaatagtccttagggtgcatctagtccagtggttttatagtaaatgaaagaaaccagcctgggacaagacagggtagcagcatggagctgcagagaatatgccctgtctccagtgggcagcccacactcagcttcagccagttgggaagttggactcagtggtgttggatcaccccattttttaaaaagccagaaatctagatttgtatgtgaagttacctaattatttaacgctggcaactaatacaaactaggtagatgctgcaggataaacaattcaactctgtgggccgtatgcatccataagccactggtgtgtcacctcggatctattcccactccaactgaggccagaaaggggtgggaacttgcctgagaccacacggctaaagacttggagcagatgacttaactccatccttctcattccattttgttttcccgtgaagaatggcggggagcttggtgcccaggattccattcctggctccattgtctggctcacaggactctggccagactcatccctggccttgcaacgtgttttcccacggtgcagtggagtgagccctgggctttgagtcaggaaacatgggcttttttgggtcccggctcttccatttacgcactgtggaacctcgggcacatctctgactgccctcggctttggcttcttcacttgtaaaatgagaataataatttgtgcctcccaggactgttttgaggttgacgggggaaggtctcactgtgtgagatcaccccgcaaacaaaacccagagactccggttgtattagcatcctggtgaaaaagatgtgagtgtctaagagggatgctgtggtcgaattcagcaatgcagacagcagcagctcaaaggtgcttcctgagtccatcctccacccccgatggaggacacagggtggtacttcggggcactgagggttgttcctctttgccagcacaaagcctgcctcaccccagggagtggcatggcccctgctgctgttctgtgtcacctgctgaggtcagggctgggtcgtgtcatttgcgcagcccggcaacaccctcattcccagtgtcatttaaaccaatcacccagaacccacagaaatgggaactggggccagacccacactcactacctcctctaccccgccctgcctgccccaaggtcatgttgactgaatgtgtgcggtgaatcttgtttttctctccatttccagggacgcaaacccggctatttctccttcctggacccattttctccgggcgtctggctcttcatgcttctagcctatctggccgtcagctgtgtcctcttcctggtggctcggtactctcctcttcccttccctgtccttacaccgccacctcgtgtccacctctgggaactgcatggggagggggtggggaggaggagagggggaggaggagttgggaagatcttggtgccaaactagaaggacaggagaaggactgggggcctgaaatgctctctgcccagctgtcgacctcatgctgcccatccaaacattccccactgtgcacgacgcagacaggtggcttggcttctgcacctctgcctcctgtcccctcccacttctccccagacccccacctaagccccttgcttgtgtaggagccctgggaagagaggaggggtggggttggcaggaagatgactctcattaagcactgtgcatttggctgccctggcatcagtcattgccacaaaggatctgccacaaagtgccgaatgacaaggaacagagcctgcaaatctggactgggggcactgggggctgcagtggagcaggccagggagaaggctttctctgcagacagcctgggcctgcctctgaaaacacagctgccttgtcgaatgggaaccatggaggctgctggcgggtggcaaggagacgggatggagagaggcgttttcaagaagtgctgagttgagacgcacgggccagaccagggaggggggagaataagccctgccctatccccaggaaaccaggggctgccctggccctttggaaaaacctgaggagcagcctgaggctgtggcctcccaagactgtgcacagcaaaggtagtttcgctccaggccaaggctgttgggccagcctgagctgcaggagagccagcttaaccctccagaagtgggatgagccctggtggctcccaggccactcactcaggtccctagtgctgctaaccctccacttactgcagtggaggctcacaaagggctgttatgtgggagcagagaactactcaggaggagcttctggaatctgtccgtggctctggtttgcaggtgtctcttcagttgttacctttgcctctaggccacagtgggagggcagacagtgttagagtgcacatcccatctctgtggggtgggtggggtcttcccctagggcacgttcattcactggattgatgggggcacttggggatggagctgccgcatggtaagccctagggaaccacgggctacctaacccctgagggcacttcccagactgccagagaagggttgcatcaacctgtctgcacatacctcttctagtggagaccaaggtccccaagatcaggaaggtctttggggcccacaagatgcagccaaaaaaagacaggccttgctgacaacctggtcattttcaaacgtggcagagtttgctgcttgggcaccaccaacccctctcgggcctgtaggcatggccactgttgagtatctgctgtcagtgacggcctgcgagatggggagctagcacgctgtctgacacctcccctctccactttgccacactgctgccatgttaggaggctgtctccgtgagcctggtgccactgctctgtaattcacacttgccccttggatgtgagcccttgcgtgtggcatgccacaacactcaggtcacctcaagggccctgaaaagtcttggggtttggagagcagatacatacaagcctgcttcagcatacccacagcagcctagagctttcaaccagccctggggtgttacgctgcccctcctccctcccctccacatccaaacacaccccctccagcatctagcatcacagaaaggttaacagaaaatgtgctaaagggctaaccatacggcctctctctctcactacacacacacacacacacacacacacacacacacacacacacacacaatactggagtctagggtattctgtcttaaggtagtgattttcaaacatggttctatggactgcaaaggctcctgggagcaaccagagcctttgggggtggaatgacaagaggctgggcagccagagccctgggtccccaactcctcctcatccagaccagctctacttttatttcttatatattgtacttcgggtaagattttacagggaaaaaaaaatgtctgaaaacaacagctcttaggtagccattcccaagagagctgatcttcagagtcctgtagggagcttttagacatttgaattcccaggtcccatgagctcagaatctctaggggaagggcctgagaatctgtatctttgaagttctgcagatcccaccaatggtccgtaggcttgggagccaacaaagtggggcaccagagtgccagccagctcctcgggacccacacagagggacagagcacatctcacaggtcaaaggaccaatgctgagacgtttgtgttgtactcaggaaggagaggcgcggatggaaacgggaggcagcgacagtgggaacactaagtgcacatcaggccgagtgcaggatgggaaagagcagtgtgaagataacaccgagcacacagcaccccgccctcctgggggtgcacacctgtgcatacagtttctctcgtcagagctggaaggctttgcgtacaagatgggccggggctgcaagcatctccctggcgggcaggggaagagcaggcattctgggcatcagaggggccattcagagagacgccagtggtgaggctgagagggaaagcaggggagtgtccccacctcaccccaaggcacagagcttagagcagcccttctcagccccatgcgtgcattacactcactggggagctttaaacaaacactgatgtccaggccccacctgagccaatgaaaccagaatctttgggagtggaactcaagcagcagcattctttttttttttttgaaaggctctggggaggtctgaaacacagacagggagagcctggctttagacaccatcgaggccagtggctctcagtatggacactggcccggtggcaccagcatcatctggaaacttgggaattcttaggcctcaccccagacttaccagtgcagaagcattgaggctgggcccagccatctgtgtcagcacaccggcttggtggttctgaggtaggctaaggctggagggccactgctctaggctgagggtcttcaaaccgtggttctaagggacactaatatctctctcatcaccctgtcactggcagtgacagaacaagcggcttcccaggctgtccacctcttgacactcctagcctcaggggctccacttaatctttttttttttttttgagacagggtctcactctgtttgtccaggctggagtacagtggtgggatcttggctcactgcagcctttacctcccggactcaagtgattctcccacctcatcctcttgagtagctaggattacaggcacacaccaccacacctggctaatttttttgtattttttagtagagacgggttttcgctgtgttgcccaggctggtctcgaatccctggactcaagcaatccacccgcctcggcctcccaaagtgctgggattacaggcatgagccaccgcacctggccatcctctattctgtattttggagttccacatcagaatttattgggggtaaaaatgtctctttgattaaaaaaaagtttgagaaccatcaacccagttcaacccacttattttattttattttttttttggttgcgaaactccaagtccagcaaagggaagtggcttgcccaaggccacaggccggtctcagaggtgagaccagccaggagagcctgcctgtgtcccttcacaccccgcctctgtggcactagtgtatgttccttttctcccacaggttgacgccctacgagtggtacagcccacacccatgtgcccagggccggtgcaacctcctggtgaaccagtactccctgggcaacagcctctggtttccggtcggggggttcatgcagcagggctccaccatcgcccctcgcgccttatccacccgctgtgtcagtggcgtctggtaaggccccaggcagaggtgaaccaggccaggtggggtggggacacaaaaggggccctctgataagccggctctagcttctagagccccagagcctctgcctcttacagcagacccacgcaggaagccgagtgctttctgccagctcagaagcttggggcaatggatggggcctgctctgtgccatctggtccccttccccttactctctggggtctggatgcagaggggagccaagggaggaagggagaggaggtgacaaaacagccttgatgaatttcagcaaagcaatggtaacttcctgacctgaaaatgacctgaggtttgagaaggcatatgcagatttatgcaagtataagcctgctggcaggaagtccctgcaggaggaagccagcctggctgctacatcacatcccctctaccagccttctgaggctttgtgtctctgcctctggctctgggggcttgctggcctgttcacctcagcaggtgtgggaaaacgcaactcttgtcgttcagagttgagcaaatgattcaatgtgtgggaaagctctttgaaaacttgaaagtgctacataaacatatggactgatcattgttattagaccattatgggggcaaaggaaagacaaaacaaatgtgtgtgtgtgtgtgtgtgtgtgtgtgtgtgtgtgtgtgtgtgtgtgtgtatagcctagagaggcaagtttgcagaacacaactttttgatcctctcttaaaaatctgctgtgggtttggctgtcatagcatacaggacttacgaccttggttctctcccttccttctcagcctgtttagccaaaggaaaaggaaaggtgatgtttccacccttgagtactggtgcccagagtgggtggtctggacagaattactggaggagccactgggctgttaggaaggtgaaaacgcagctgagatagccatgccttcctgtctggggtttccattatccctgataaacaacaaatgtagcacgatttaaacctgggcgagatgcttgcctgttaccagatagtttggagaagtcactgaatggatcaccatggagaacaggagctcaggtctccaggaagagggatggacgatctcagcaaggagagtcacggaagtcccacccacaacatccgggaacctgggcagaagccctgggagaggagcatcgggggatgtcgatctccttctccctggggcttttccttctggagagtgcctgctcccacagatggatgcagctagaaccccattgcccactttatccgcttgtcagctctacccttaccccaggaaatccctcctccaggacccagccatcctgcaggttgccctgccctgaggggaggactcagcgctgctttaaatggctggccccaggtggcttggtcactgttccagagctgtgtgagaaggggctcagcgcgaatgcaagccgccgtgacaggcctgtgccagccccgactccaggtggtcactgcgcttctctcccagcacactaacagttcctagttcttaaatcagggcctcggtttggtccgttccatggaggagtgggaggtcagaagacagggccatcgtggcctacctcggcctcctcacccagagcacgtgatagaaaacaccatgtcgctggagagaatgccagtttgacaactgaaaatgccctttgacacaggagcgaggctccactgagccctccggaagcgggcatcattccctttctcagcagagccgatgggtttgcactgagccgcttgtgccctctgaccagtttccttgtgaccaatggcctaaatagccacctggtgtgtagccagagtgtagccaactctgaagtcatgtccacacctagggctcattaacccccagcacacaccaccacagctaagcagctgcagagtgctggcttcctcctggggactgcccaccccaggtctctgtttagggatggtcatgagagcaccttccaatagggcagaagagctgaggcaggagcagggagagcagaccttgggcatggagggatacctgctacttacaggtcacagatagggaaggcagaaggaggcagccaggtgattttcatcccatattcagtctgatggtctctctatacatttctctatatctcacatccctctagtcctttacagattgctgatcactcatgacatattacttcattttatctcacaactctccagcaataggcagagcaggcatgattatccccatatatttattagacaagtaaatgagctcagagaaggcgagtggttttcccccacattctcacagtggaacacagccagaaccaaaacccagctcgctcatggtggtctgccatgtagacatgcccactgagtcagaggatgcccctgttgcttcactcctggggaggcagccagcaagtgttcttggtcacaatggcaaaaggggcaatgggacctgctgctcttgaaaatctacacagcagtggcaagttgccaagttctgtgtgttaatcactatgcattcatcgtcagtgtctctatgatggataaagccccatgaactcaggctccactgattcagaatttgtgattctccatcccaaactgtgcttagatctatctttgagccccttgggattgggatgtagatccatactgttgaccagatgggagaaggcttgtttaacctactaaaatgaacacacagtttttaatggacttagcatatatgctgcctgagctgcaaaattattctaattttaaatgagttctgtctactcagtaaaacaatcttctaatttgaaatagcatgaccattgtaagagtattttctaattccagcctttcagcagttcaaaagtgcttttcgccaggtagtctttattaaagatgttctgttgttacaatttacagaactggttttaaaatacaaatttatcagctggcacaggggctcacacctataatcccagtacctggggaggctgaggcaggaagaccacttgagcccgggagttctaggttgcattgagccctgattaagccactgcattccagcctggatgacagagcaagaccctgtctccaaaaaaaaaagaatttatcggccaggtgtggtggctcacgcctgtaatcccagcactttgggaggccaaggcgggtggatcacaaggtcaagagatagagaccatcctggccaacacagtgaaaccccgtctctactaagaatacaaaaatttgctgggcatggtggtgcatgcctatagtttcagctactcaggaggccgaggcaggagaatcacttgaatccacgaggtggaggttgcagagagcagagattgtgccactgcactccagcctggcaacagagcaagactccgtctcaaaaaaaaacaaagaatgtatcactgtgttacttggcaggttgcttcacttctctgagcctcaatttcctcacctgtaaaattgggataagaattttgcttccgtgagctctagggattaagtgagatagtggatgtagctcgtggtagctgctcactgcctggcgatgcacatttgaaggttggcttcagcacgaggaggtgaggaagccctcctgctctagctctgaacagagcccttggagctggcacccgcagctcattcactagctcatttctcacagtctccaaaactgtctcatgtgcatggactacacctcttttgaataataacccaataatcatctcctttaggaaataagaaaaacaaatcaactgtcttcttccaggcagtgctcacaaacgcgattcatttctgttgacatcatatgccctgcctcctttctcttcccccactaagctgaaagctctttcataagaaagatgcctggtctctcccatgtcacagcaggactggggtcaggggccaagactccagggagtgcccgggcaatgatgacttcctcgtcttttcctacataggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaagtaaaccccatttggttgctcaccagcatcgggaattgggcagaataaagttgagatgtttctctgctggagataaaaacatctctccgcatcttattatctcttttgaacatatagtttggaggtccacatggggctcatttatctgctgctccacaaaatactcctggaatgaggtcccaaaagaactttgcgttaatatcagccggtgccagagtggtggtacttgagatgattttaggtctgatgtggtggaactgttttttagttgccatagtttcatgtttatattaatggccattagaaaaaaagtatatatatgcagtgaatcaaacctgttgttttatttatattactgcatagaatggggttaatgcatacatttacatttttaaagtgatttaaatcgtataggtagtatttagacagagcaagattcatacatgaatgactgaagtttgaggaacaccagcttaagacaaactggcttcactgattccagacttgataggtatcagatagggaccctgttggcttctttgagtttcccttgcaaggctcaggagaaagccctgccacagcgatgtgttcgctgtcaagcaaactgattgatcgccaagactgacagccagaccagatggaatagtggttttcatatgcctcaagctctcttggaaagcaggtttcccctggggttaaaaggtgtctaaccaacctaatatccaagaagttcattttcccatgaaacaagtccaatgccttcagctttctgttttccaggcaagtctccgtgcctactggcacagacaacagtgaagtcatcatgcaaacacagagtttggatagacccccagagttctctgacttgttattatttgtaaaacagcagccagcattggatatgtgattgatcaattggtttagggtggatggaaaataggaaactgcttcttcaaagggtatctctgtatagtcctaaatgaacctaagttcactgccccaaattgagggacaatgaaggtacccagccagaatttcagttctaccggaaaatggaggttggcagtagaagagctcttgagggtagatgaggcaaaaccaatgaccaaatcaggaccttagtgcgctgttgcttcctcatctttctataaaaggtatcaaaggcacaactccctcctctgccattacacagtgacagtgaacatcttgtgttgagagacagaaagggaaaaggttcttgactgtgatcagcgggtggagaagcagaagggccggcatcttaaggtgcactttgattccctctctttttaagccaacgtttccttcctcttttcccaatcctgcttccttttgttcttttcccagaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggtatgcgggagaggaacagcctctttgggtagctttgtccagacagggtcagggtagctcaaaccactgaatacagcattgaatccagtaccccctgttgttagaaccagtttaacagtgactttacgtgggcattctaaagttttttttttttttaaagcaaacacacatatttcctttaatcaacgaccagtgctcaatccttaattattaaagagctagttgattagttactgattgattaattgactaatttaaagggctaatagtaattattaaagggcatgttaatgtctttggtgtgtatttaggccttttgttccttttctcgcttgcttctccttggccatttctctgttgattgctatctctactagcagtgggaagaaggatgagatggtaaaatttgaatcagttaattttgctatttgttagcgttgccagtgaaaagtttacttctaaaggagacggccatgattagatggaatgctttcaaattatttgtggatttcactgatccatctatggtaggtcggtgtgggtcatggagaaggggcagtaaggctctggtgttcagcctgctgactgtcagcccgtcttgttgtattaataggaggatagagacgtttggcttccagaaaggtgtcctagctgtgctttttaaaaggacattcacactttggactttgggccttcccctgctaacagaacctccccaagaagatgaggagagaacatgtttagctgctgtggtgattgtgaaggggatctgaatgttcctccagccgcttctgacatgcacacttgccccttcacacacacaccatagagagcccgtgctgtagagggttgtgctggtatgagggtgttcttgtacaaggcaacaggggaagaagcaggaatcgaggccatcagactctgggagaaaattggtatacggtatgctcatctttgtagttacagtacacatccctgctgttgatctttaccttagctcaaaactctgtaaattgcaggattcactcacacctgtggagtgtaacgagcacgggctgggagtcaggcagaccccgggatgtgttctggttactggctgtggtaccttagatgcattctttagcctcagttatctaattcataaaattaggtttctaatacctacattatggggttgggaggattaaacctgataatctagttaggtgccttacctcagtgtctcacactgagcctaccttggggtatattagtgtccttctcatttcttccatggtttcctatgtttttatttatttatttatttatttatttatttatttatttatttatttatttttgagatggagcctcactctgtagcccaggctggagtgcagtggcactatctaggctcactgcaacctccgcctcccacttcaagtgattctcatacctcagcctcccgagtagctgggactacagacgtgcactaccacacccagctaatttttgtatttttggtagagacggggtttcaccatgttggccaggctggtcttgaactcctgacctcaggtgatccacccacctcagcctcccaaagtgctgggattacaggcgtgagccaccgctacttgacaaaagcaaatgacttaaattctgatcagaaacaaagaaaatgaacataggtaataatatggttcatctctgaactctgtaaattatggcactaggagttctgtgaactgtgaactggaggcttcactctgggtactcagaaacctgcacaccctctatatgctattatatgtcattggtgtccactaataatacagattatggacacctttgagagatatactcgctgacattttgtttcaagatggtagcgtgaactgcaaaatgaacttaaggcacacgttgatgatactctagcaatttgaactaaatttcaaatgcttccaaagttttcatggaacaaaactatggagagttggggtaagatagaccacaactctagaaattttcatcaataaccaaggaaaaatggaaggaaattcatttgctctatatctgacatgacactgttttcacatgttctctcacttaatagtcccccctgcaagatagatgtggttattcccatcctatagaggacagaactcagattcagagcagatagattacttgtccaaggtcacagaataggtagagaagctgggtgtgagcctaggatgcttgtctccagtccagtaattcatttaccagaccatattgccaatgggtcctatcagctagaaaggacaggataggtgggaaggtctactctgagctagcccagcttcccacatgaggctggaaagaacattacacagttcattgatgagtcaggatttaggtccagctgggagtatgcccaggagatacaagcatgtatatcattcttaagtggaatgtaagagcctaactatggaataagcaatgtggttagacccaggaaaattaagcgagacagaacaaggaacaagatggaaaattaatcaggtggcttaggaactaagtaggtaaccaaggagtaagcagaataagcctttcatgtggcccctggtgtgttctgaggttgggttgaacatgccttgaaactgcttgaaatgctttgctgggctagacagttctctctaaacctgaaatgttcattagtctcaccacctaacaacatctgttagacaactcgttcatgtgtccattcacggcagatgtgtaataagtacttactgtacttgaagctctgctggtgtttgcccatatcacttgcacacgttcagtgctgcaggcttggggttcgggtccaacaatgtgtaagatgtgtaataagtacttactctacatgaagctctgctggtggttgcccaaatcactgacacacatccagtgctgcaggcttggggtttgggcgtccaagcatagttgtgtctatagtagggaaggttctactgtggagctgtggactgtcacagttggaagagatctgggagatgttctagttccttgcctcttaaagtgtggtccacgacccagcagcatggacatcaccttggggcttgttggaaatgcagactgtcaggccccaccccaggcctactgaatcagattctgcagttcagcgaaatccccaggtgattgcaatgcacttgaaaatttgaaaagcactcatctgtttgttccaagcttctgcctgatccttcatggtagcctttctcctctggggcatctgtccacatccagccttcatggagtttgggcaaggaaactgggcagcttagttgttttccagcctcttggcagctttttcttaataatgtcccagcctgtgctgggacattgagctttccgtggtttcacttaagcctgtttttgtaatgaaatctaaattctagaaccaaagctccttgacaaaatcgcgttagaaaaattaaaaagaatggtactgaacagaaaaaaaccttcttttgaggagggaaggaggactgggagaaacagggtgatggacaggccagtgggttctcgtgcactcagcaggcagtgctgagagtgaggaacacctggtgacctgattctcacactctggggtggctcttctctcattgattggtgacttctctggataaacagttgtcaggtgtaatgtagtgagagttacaagtgcctaagaaattaattaatttatttatttttgaaacggagtcctcacattctgttgccgaggctggagtgtagtggtgcaatctcagctcactgcacctccgtctcccaggttcaagcaattcttctgtctcagcctcctgagcagctggggctacaggtgcgcaccatcacacccagctaattcttgtatttttagtagagatggggtttcaccatattggccaggctggtcttgaatttcttgcctcaagtgatccgcccatctcagcctcccaaagtgctgggattacaggcgtgagccaccgtgcctggctgtgagaaattaatttaaataaagtagaaattggacacacctgactaaaaggtttgtgtcacagaaacacaaactttggcttcctggaggtggatgggatgctttgcagccagcgtcctgtgtgtcggtgggcaggttgtttaacttggatagaccatctttttaatttagaaagtgatggtgcccggctggggaggtggatggcacaactgcctggaaagccgtttcttgacccatcttggggtgtttggccatgggctggacctgccagtcagcatggagagaagggaagcagaaaagcctgagaacactgcgtgaagccagaatgccccgctcttccgggggagccccagtggagtagacagcactggccccatgggctcgccccacccgctgcatctgtctgtcccctctcgaggtgaaagcaggcagggtggccaggaggtgtgccgggaaggggagcagagtgacacctaacagggcattcacaacctgtgtcctgggctctcccgtaacccccgcaggctcggttttccgggacgagtttgatctggccattctccagctgcaggagaacaaccgcctggagatcctgaagcgcaaatggtgggaaggagggaagtgccccaaggaggaagatcacagagctaaaggtaaggacgttcagggccatcctcctcctgccctagaggaccaaagtagcttgtttctcgtgttcaaattccaggtacacataatgacttgtaggacccattgagaacggccttggaaggaacctaggtataaagtgggctggcgggggatcaggtctgtcccagggtcttgcgtatcgcaggcacccagtgtccacccggctcccaagtcctagaggctctgcctccatgttgtttcttgaacccagctgcctctgacccctagcaccatggcttctaccctggcccatcatctccacacctgtgcagtcacagtcgcctggtttcagtttcccattcttgcgtctctacagtatattctccgctactagccagagtgatcctttttaaaaatgcaaactcgatggcagcattccccccacaaacctcccaatggtttcccatcccactgggaataaaattcaggaccctgtgtgatctgttccccctcagccttcctctcttctctgtggtccccaagcctcccatgtggctcttccaccccagggcctgtgcacctgttccctcctcctggccttccctcgaagagctcttcactcccaccctacacatttctctccatcaccttaaccccaccttatttcccttctcagacctcatcgctacctgatattatatttcttatgtatttgtttactttccacttcctctactagaatgtaagtttcatgagggtagggttggtcatcacagggctgcccaaagagctggacatgtggatattttatcgaaaggatgagcaaatgttaaattaggctgaatagaaagcagtcacttactgagatgtatggctaagaagtgttgacggtccctgagcacccaggattttctgtaggggaacacttaccctagtttgcccaggatggtatagtcttgtttctatctattgtagatcagttaatgcctataaattatttctagacagtgttcattctcaaagtgtcctggtttagacaataaatcatatggtcacgtaccatatctactactccatctactgcagccttgttaaaatatgcaacagatttacctgtccacgctctgcccgaggaagacagctgaggagtaggatgaaggatatcatgtgcttgtcttttctgctcagcatgaatgattgtccctgatgagacagtgaatgaataactatgtgattctcagtgtctatacgtggatctctatcttgcaagaagaggtctcaagaatatggatatacggagcaagtattttttataatttaaaggaaatgctgccctcagaggaactgagtgaggccacacacttcttggctcttcactccccaaaggccagagctgaccatggggaaagcagtggacacgaatggacacagggcatgggcagacctcatttcagtctcgtctctaccagttgtgagtctgtgagtttcagcacattagttagcagcactgagccctcattcctttatctgtaaaatgagttcagtaagtaacacactgtagggctgctgtgaagggagagtgaaaaagcacagagcttggctcatccctgggcccagtgtatcacagctgtgactgatctgcaccctagcaccgtgctctgctgctctcagaacttcagggcagtctgattccatcagctgcctgcagaggagttactttcaaggctcagctagccattccatcaatagggatatgctgagtgacagtgaggtatcccagcacatcacttcacactcctgggaataagaaagctctacaggcttaccagcaagcatcttaaggtgacttctggaaacaaaattcacttacttgaagtggttagcaaacaattcttgacacttgccaaattacagttaaatactggggggtgaagtgcggagattacttctccttgttcagagtaaaagaaaatgggggggatgcagaaaaaagtgtcaaggcacttttgtggattggatagaatgaactggattttgaagatgcccaggacctgaataggtcgacaccgtgggaggagggcattgcaggcagatacgcaccttgaagatggatgtggggcaggagtcagtgctgtgggcagggctgtgtgcaggggcgccgggtggtccatgtggaacagataagaattcgcatttggggagttgggttgtgtaatgggtttgtactagggaaggtgtgggtagcaaaatgctcctccactccttcccccaaaagaagacacatggattggaaacatgtgactggacctggaatagctaaaataaagttggatgattgtcagcatatgttaatgttgctctatgataacaatgagttaaaggatggcaggaaagagcgccgtctctcctccatctgcagggaaacagcagtggtattgtgctctggagctttctaaagtggaaatggagaggtgaacctggggcctagagcagaaggaccttctgcttatcaatccttcctctgattgataagtgaaatagaagaaatgtctaggtatctttcttcctagaaacgcttgatctccctctcccctcaccacagtgggttgagggccttctgtgactttggacagagcactcaatgcactatgctgcaatcttggtctcctctactcagttgctggcaccttagacccagaaccagtatcatttgcttctgtggtcctagcctccccaacagagccaggcacatagtagttactcagtgtttgtgggatgtgtgatgaaaactgctgctagctgtcagaagctaccaattgttgtgttttcctgggtcatgctaacgtgactcatgagactgtgcttggagttatttcccaaatagccttcgcaccaggagctgtccgctcacactcagttgttcctctgaacagctgacggaaggcgtgtggtggtgcagaggtgctggagaagagggaggctggagccacacaggagtggccaggggcagtgcagggaccctccaaaggatcctgtcattgacccatcaggtccaggccgcaagctctggtcagttccaagtctctcttctctcctcctccttactagtccgggatttcctgctttcctttcatttttcaaccctattccatttgatctcttgagcctttgtttcccctttagacttgctactgagttgatcacatctttccagttccccttttcctccctgaaccctaaatccagccccaggacctcttgctttgtgtacttagtcatgtgtattgatttgcatctcctgctcattcttgtggaggagcagagggcagccccattggcaagctctgggaaggggatccaggatctcggtgccttgcagtctccactcacggaccttgagttagaccatctctcccattccagatctcgcccaaagtccaaggaccctttcttttgttcatccctccccacctacctcttaagactggagctcattaaatgtttaccctcctgcgtatgtgtttgttctactgacagtcactagggtggttctcttccctgaggcagttttgataggttttgaatggacattgggtcaaatggacttcactccatagatgcccttgtgatagtagacactctgaaacatctttgagcctcagtttccgtctctggaaaatagaggtaataatagcatggccacctcccagggctgttgcgaaggttgagtaagataaatcaagcattcagcaaagtgcctggcacaaagtttatggcaacgaattttattccaaaatctaggcctgaacgagcaattaaggcacaatgagaggtttaagtagtgtccccaagctgcgaatgtgcccattcatccattctccctaaggctgaagggctcttcaaaaatcaacacttaagacatatattttctgtctgttgacattttcccccctatagacaataagcaactcaaggacagggactgtgtcttattaatttttgtgtcccaatgcccagaacatcacctgccatcagtatttgatgaaacaatgaacaacaaatgaatagataaatgaacaagtgaatgagcaagcatctcaaagtcctcctgactttggaggaggaaaagtctggaaagccttatcttatgattgtttcctttcaaacgggtgcccagcaccccaagtgttgcaatggaaagtattcatgtagttcttattgctgccaacaaacagcgtggtaaactactgtgtaccaggcactgtgcgaggctctgaaattaccaaaaggattacaacctggccttgcccttaagaggtttagaagctagagagagacacagatagttgctgtaatggttgcagtatgggagagttttaatagcggtataaagagaatgtctggaagcccggaagaggaagtgatgaattctgtggaatggtcagggaaggctttaagggcacatggcctggacctggaagcatcccttaggaatcgctgctttaggactgttgtgaggcacaggtgttacactgagaactcggtttgaataggtaggatgaggttggacttaagggactgttgaaaaccgggtaaaggtacttggactgcaaccaatctgtctcacgctttttcacaggaggaaccaaaagcagaggagactaaatgggagctgctggggatctaggacattgtgtagagcagcctacttgttcagaatttcctggaagtcttctgttctgtcctaaaaatacatgtgaattttgcatcttactctgtaatacaggcatatttatttaatgtaagaatttttttcccacccaagccctaagtaaaatcagtgtcccaggaagatgccccatcatcatgccacagctttgtcagactcctcggcacaccaacagtgccctggactgggtttgggagcattggcaatagccgtcaaaggttctggggtgagatgtggcacacggaaagctggtgtggtgggatggaattctgagctcttggcggcattcatggtcccaggggatagttattgcctcaggagaaatcaagtcaaattattggctttaagttccaaaataagttcttaaagctcacagcagagataatgtccttggagagcgaggtttttgatttgccagagaagtattttggaatacagaaggttaattcctaataggatctggtcaaaaagttaatgctagaagttagagtgaaaaaaaagagaaagaaatagaagaaccaggccaccaagtctgcaaatcagataaaaggatgccctggccaggacaggagcttctgagcagaaaaggacatgttaaaatgtggttggtccctgcccttctgggagccggagagaggcagatatcactcccagaattagctggatattccatgagttctaaatagatttttacttgtgcaggggctgtgggtggtacatgtggagcagagaagaatttctggagaaattcttctggagagtttggctgtgtaatgggcttgtactgtggtatgacgcatatttctggagtttggcaaaccccagaaatatgtgccatgccttagtgaagtgggggacgtaagaggcggcacgtagggacccaaggcagagggcccagtgaaaggcctgagttttccttaactccagacaaagatattggaaatctaagtggactacggcataagaccagacacctatccccaccccaatacaatgacacaaccgcaaacctgaaatacatcccgggaagaagagggaatggagaagacactggatttaagtgaatttaaacatgaaatgactgaaaattctctatgtttttggccatgtggtggaaatggaagttggaggtggaatagaaatataaagttataattgttgcagttgttggccttggaaacagttccgcatccacagaggtctagatggttccacagtttttggaagactgtgctgacagtagagttcaggatggagggagaagggaggcagaaagggagatcaggcttccaggaaagatggaaagaagtgaacaggaggcctctctccaccacactttgggaccaaatgttccctggcatgaaggagagaactgaacagatgaaagggaaaataaacagtggaagtcatcctgtccaggtcccaaatgcatccgaagatttctgggtgctatcagccagccagtgttaacttgtctctctacggtcatcctttggaacaagaggttgagctatattaataagaggcaatgtttcagagtggggctgtctgggagatgctatgcaaatcactctgaaagccaggacttcagctactgtcccagccatagctgctagtgccagtttaatgtggtggccccatttgtgccatggctggagcccaagcaaacattactcagagaggctaagaggcttcttggccaagcgaaactgcacgtgacctcttccaagccaagtaagaagcactagcccgaaacgggaggtgccattgcttggtctctctctgataaattagctgtcaaacttactatggtatataattcgttgttcaagggatttggaaaaacacgaccaacatgacccaaagatctcttcccttaaatcatttttttttttttgagacagattctcatcctgttgcccaggctggagtgcaatggcacaatcttgactcactgcaaccttcacctcctgggttcaagcagttctcctgcctcagcctcctgagtagctgggattacaggcgcatgccaccacacccagctaatttttgtatttttagtagagatgggatatcaccatgttggccaggctggtctcgaactcctgacctcaagtgatctgccccccttggcctcccaaagtgccgggattacaggcgtgagccaccacacccgggctttaagtctttaagtgttcaccaagaatcgagacctaggaacatttttttcctgtgtctcagactgaacagagggcagtagttttcacctgctttcccaagcagctctaaatttgttttttagaatttgaatcagttggctttcacgtgtgcctaaaggaaggagagaaatatggaatgggcagagagggatagaggtgaaaggaactatgagtgggtctgtttttcggagacctctgaaactgagagtggctgcagttttaattagaatgtaccagacgacgtgccagtgcctaacataatctttttctactttgttatcctattaaaattcgagaaatttcaaagaaaaggaactggtgcttaccccacttctaatccaatattacagctcaaacattactgccaaattccagagaagaatcctaacgatgtggtgatgccaccaatcccgagtctttttgccaggtcttgcttgcctctggtaagagccacaatattaccccttcgcttcctcgccccctctgactctccctgcctgtagctgggtggctgtccacctccctacctcgctaaaaaaatgaaacggcagatcctgtggaaaactggagattacaaaaaggaacaggctccattccaagctgtttcattttcttctgccttttcttttcaaaaaacacttatttatttattttctcacttaactgctataaaaagaaaatatcgctagccactcacagatgctggcatcccaattcaaggagattggattactgaagtctttgcagaacaattgctagacaaaaaggtggtcggtgaactccaaggaaattaaatacctttatcttgaaaaacatgagctcacaatgaggcttcaaaggaacataaatacatcaccaggctgtgaaaatcagggttccctttcaagaatggaaaagaggccagtggcattgactcacagaatccttggaaaacaggaagtttgctgtctggcacggtgggaatggaagtgtgagacatcttagcaagagtgggggtgagtgatgggagtggagggggccccagggatgcttccctctctctttcttctcatgggatccagcgtggttatcctggttctctggtttctctggagagagccgaggctggaaacctgaatatgggaatttagatagtgtttcagagagatgctgtggaggaagcctctctctgatcaaattagatctatttttgagagagagaaactccagagggatttccagaaaccatgatcagaacagaggcaaatggtggccccatgagtctgcaacaaagcaggtcacaattgttaagacttcagctcactgttgtctggaaactgggccaagattaagccaacaaatcatcgattcaaacatgcgatgtcatgttctgaaggacagaaggggattttataagctgagctgtaactcacacgtagaccccctcacctctaccctgtgtccctctagaggttcccaggaatgtgttcagtcattaggatgccaggatgagttctgtaatcacccccctgcagcatgagtggatgccgagtgactgggagagatggtgtggagtagacgggaggggactggcatcagtttagatccaggcacttccacttgtcagccgtggaaccttgggcaagttacctaactcctctgcaccttggtttctgtgtcaggaaaaatggaggtaagagtagtgcccatttcacagggtaactgtaaggattgagttaaaacatttagcatgctgactttgctcatagtaaacactcataaaggtcagctttatatttatacagagcattcgctttggaatcaaattgatctagaattcacgttagttatgaaaacatgaacaacctaagttctctgaatttctctttctttaactgtaaagtggggacaatgggccttctctatggtgtttttaacgataattgaatgagatagcaaatgaaaaatgaggcacttgagctcatattttgatggattataagcaacctcccatagctcgtgtttggataaattgcaaaatttatcacatacctctcccatccctcttctagtttgagttccttttgcctacttttctcctattattctctccagaatgtgctaggtctagtcaccagatgccttggtgaatacaagaagaaatggcaaacttaccgtttcaacatgatgaatcactttgaattttctgggaagatcatgtaggtcagtttatatcggggcacataaagttgctatttacaataataagtccctggagatcggactatttgatacacttgcatggctataggtgaatatagttctgaaatagaaagtgcttgaaagccatatggttccaagaatccatgttcttgtccaatgctcttgatgagccagtgtggcacagagcttcagcacctagcatagtgcccagctcatggaagctcctcagtcaagatctgttgaccaatgtcaaagagcaaatacattgtctcttgctgggatctcgtggcactagtcagtcctctgtgcaagtggattctctgcacctgcctccatggcttttgtggcctctgccttttttcccagccttccctcactttttgttcaaaaggagctttccctctgtattttagttgcagatttccacagtggttcgtggagatatgtgagtgttttaagggctaggacatgagtgtacctgaatccaagaagtggttattagccagacagaaccaaaggaagagcaagtgggtgggtggagattcacatctcttcacaggtgctctcttccagggtgccattcccctttgtagttcaagagacaaagaacattattcatttgcatttgtgaactatcattttttgggcaaaatatttgtgggcaatctgcgggtgacaccaaagttagtatttagccaaccaggagtttgtggggagagcgtgattctatttcagtgaatgcaactgattgctggggcacagctgagcctcagagactcaagtgtcaggagaaagtcccagtttgtaaagccatctgcctgcatggtttatgtgtggtcccatctgaagaagggaaggaaagacatgactagatgtcttcccagtcccccttgccattgctgaggcatctgtgagtgccgcgtgggccttgtaggctggagggagtccacatcaagggccccttctgatgaatgtcgatgtgctgtggaaggcatttgacttctagagaatgactgatgacagtgttaaatggaactgctgcgctctccgaactctcccttcccactccccgctccatctgtttttcaactctgactctgccagcaatctattcttgcttcctctttccaataacttcctcaaggcacgaatggtatacaagccttgcttctatgaggaggaggccactcagccaggaatcaggatgctggagccaacacccatgattaacatgctggccatgaaatgtgagaagctgggaaagaaagactatggggtgtttcagtgactcatggtttctaccagcctcctgttaaacctcaactcccctcaaagctttccctgatctaataaaaattatcccagtgcaggccacatgcctgttaataactctcccaatacccccacccaatacaggcggtccatgttgtgaattgctcatgtcaatattcagtcccctttagccatcactcagtacagtgtgggccatcttcctctgtgaccaggctggagcactcaaccagggcggagcactcaaccagggctgtcatgttttaccgttatttcaaaccaaatttaattaaaaaggaatacatatgggtccagagcttttggtaatgcagccctctgcatctggaatgtctttatcctctttctttctgctcattctttccacaaacatttactgagctataatgggccaggtaccatgaccgtgaggttatagagttgaacaaggcatggttcttcccctcaaagagctcacagtgtagtgggaaatccagatatataaactagtgtattattttatgcataatagtgataaacaaggtattattagtaaaacacaaaagtagtatacctaaaagtcaggtaagagtagagaaggcagcctggaggaagtgacctccgagctaagtcttaaagcaaaggttaaggttagccagatgtgtgtctggggagtaggggtaggttccaggcagaggaattaacaggagcaaaggtatggaaggtaagagcaacgatgctgtgtgctgggaactataaacaattctgttacttgaggatgtgtcacagttagattttgcatttcagaaagatcagtgaggcaactgtgtagtgtgcagagttgagaaggaaacagctacaggcagggaaatagttttaaaggctactgcaatagtccaagcaagagatggtgggtgcctgaactagggaagtggcaggaggaatagggagaagggtaagaaactgaaaaatatttaggaggcaaaatcagcaggacttggtaatagccaagacatggaggagaggcaagagaccaaaggtaggaaaatgagaagaaaatgtgccccgggccaatcaaaggagattgaggagattggaagagagcaatgagcaatggctttataaaaagccaagatgggagtgtgactgacagtgtcaagtgctaacaaaggtcatgcaagatcaggactagaaaatttccattaggctcgaaacaaaatgttcattggtgaccacagcgagggtggttttagtggtgcaagacaaaattgcatggggtgaagattgaatagcaagaacaaaagtgtattcaaaacagaattattttctcctttagatctcatagacagaattacttggagcttaaaagctttttgagtgtccaaattatgtttgaggtctgaataaaaagtactggcttcagaatgcaaaaaggaaactgcaaaattaaatgaagacatgtttaattaaatatctccaaaatgtaacattgtttcaacttcattaatctttaaatttaatatttgtaaaaacttcattacatgtagaaataattttttgattagatttttaactttgcaacattcttttgtatgtatgtgcaatgattgctgagaaagcacagccagttgtaagttaactgtttcttgccactcagtaatatcagaagcaaaaatttttaaatgcatttaacataagatctgggtgcattttgttctacttccttttatgtgagatggctcctccaaatgtaagtgtttttaagggcttttagaaggtcttaaaataattctgatgtagaccactctcaaaaagctcggccatggaaggagagagaagtgttggattagacagagttggagagagtaaggagaatttctttgtcttcaaggagggagaaacatgagtatgtgaatgtgctgagggagagagccagtggagagaagactggaggaggaccagggaggtgactgatagggaggcagggggcacagctggaacacaggtagcagaagaagacctaaaggggaaagaaaaccccctctacagaaacaagaggaatgcgagaccctctgcaagggggccttgtcctgttttcttttgtttttgtttttgagatggagtctcactctgttgcccaggctggagtgctggggcacgatgtcggatcaagtggcagcctccacctcttgggttcgagtgattctcctatctcagccttccgagtagctgggattaacaggtgtgagccaccatgcccggctaatttttgcatttttagtggagatggggttttatcatgatggccaggctggtctcgaactcctgacatcaagtgatctgcctgccttggcctcccaaagggctaggattacaggcatgcaccactgcatccagccccttttcctgttttctatctcgagcacaactattgccaagtgatgggggcatcctgtagactctcagcagtcacttggggactccagttacctgagcaggtggccatccttcatgtcaccattgtcatttccccagtcatgggggatgtccacccagcctccctcgacaggggctggccagagaaggtaattcatccgtgttgcacagatacacatcctaatactccagttctcaccacccctaaatctgtgggctgaagtatctgcctacaaccccagccagctccttggtacattcccttttaagtgtccctttttcatcccctacttcttgtggctcttgatgctcccagagtgaaaactttctacccaaatggcccaggttagagggacaggtgttaacgtaagatgtgggtgcattttcttctactttcttttatgtgagattgggcctccaaatataggtgttttaagggctttttgcccatttaagcaccttccccctggaaggtagaattgagtttttaaatgatcccctatttttgattgttcaaaatacaggattcccacattcacacaggtactcaagagttgactgtggtcctgcagatcagagtgtatagttcatttggtgtgttcatcatgtgagtcctcagagtcgttccaagcagattttcagttgtaggcagggacagctactgcactgtgttattttaaaaacaaaagtcagacatccacttagggctttgtaaaaggaaaccctgggcatactgaaatggccatagagctatttttccagctttccaaggtgcagaaggtagcgtcgatttctgatctggccctgtgactcatctcatagtgccgtgcgaagctgactgccccgacactgacgaggctccatgttctgtgaggacattactgactgaacattcagatgtgcaagcattcctgaaaaacacgggacacaagagaccctcctggatgaaagatgccttttgatttctgattgtggccccagttgaatcagggtgttttgtgtttgggtttctctaatgccaaaaataaaaagcatttaattacatagctgaactcaatgtttgacacagtggaaatgaaacagccatatcatatcctataagtatttattgactatatactgtgtgccaggtatcatgctttgcaatgaggacatgaccagaaacaatgtctgactcccaggaacttacatacttgcacaatgcttctaaaattaccaatttgtaaactaattttaggaatgactagaaaagaatcacctgtgaaacttctgtaaaaatacagattcctgggccccatgtccagagatactgattgagtaggtctggggtaaggactgggaatcaatatttttagtcagctttctaggcagttctgatggcagctggtttgtgaaccactcgtttggtgggataaaaagttttactttccaaataaatattttagtaacatgttgacaaagataggtaaatataactttttctatccatggtttggtcaaaacagttgcttttatatcacataaatacaatgttaggaagattgagtaaaactttaatgaaactattagaactgacaggtattttggtgtcatgtctctctctataagctgtcaagagtttgcccgagcccttttcttaaatggtcctcacctcccagccccagacaccctttggtaggcttcttgccagtgtccttgattgatggcaagatctctctcttccattttatttcaactatgctgcattttttccagataaataattaaatatcttcaaggactgggtgtctacatgtcaagtagatgcatgggtgtctacttgagcatctaccatactcaagttcttgtttgaatgattttagtatttttgataaaatgattgtgtcttcctgatcttttacaatatttttcatttgttatcactttcttacaggcctgggaatggagaatattggtggaatctttgtggttcttatttgtggcttaatcgtggccatttttatggctatgttggagtttttatggactctcagacactcagaagcaactgaggtaaactttcaaaggggtatgatcgatcgtgttggcagatggggtgaagttcacaggctcatgcacatataaggttatttcagacgcttaccacaggaagtgcagcaaagagaatcccagtgcccagcagaggggatttggatcaatgcttcattacttagtaattattatgaacaacaaagccttctagaactatcatttaagatatagttgagaaaaataggtgaaagtaccaggttactatggaaaagacaacctcagtcctttcattctgagtatgtttttgccttgcagggaaagatccttagagatatcccgactcatgtgaacccaagaattttatcccccttctcggggattttgaataagttcaattccccagcagtggcttagagacagggttaacataaactttacccaggttgaacagtttgaaaagaaggaagaagactatgccactcttcttccaacccaccccagggaagatatataaatccttacatgttaattgcattattagatttttttaaaagttacattagcctctatctcagtctcccaactctgaatcttcctaaaaacctttcctaattggcactgggaaaatatctcacagcaggacaaacagtgcccctggaagtctgtggagtctggcctcacatggggccttaacacaacaccgcctgccagtcctggtccactgtgctcagcctctttcctgtctccttgtaggacttccacgccgttgcccattcctcaagcccctctgcttctgcatgcgtagagcttcattttacttcccatctcccaagaaatcaggagtggctagccctgaattaaaacccccactaaacatctccccacagctcagccaccctgcagctgcagcagataccccagtcctcctgctgtcccttccttgatcctgtctttcctcagctgctccaggattatcctcttttgcccctgtatttttttctgcctgctctttctccagtccaccattatgaacgtgtctgccatatttcaaaataataggaagattactgttgctcttgctctatccctctcctcttccaaaccaaggggatccagctgagagaatctcagtctccatcacctcactcccgatttggtccgaaacccagggcagcctggctcctccctacccctgcaccgaaaggccgatgcttaaaggtctgacccctcccagtggaccaaaccaaagagaatctactgggccttattggactttggtgtgtcccttgatgatggggatactttctttcagaatccctcttcccttgccttgcgtggcacccagctctcttggttcccctcctgttgctgtctccagctttactggctttttccttttgcccaccccttaaaaggtggtggtcttatttattccctaagacctagttcaggtgttcccttccttgtgagtccttcctcatttctcctgctgtctcccagcaattggtcaccctccttcttcctgacaccagtgtaacctatgcatgaaccacttacacaccacgctgcagttattttggtatcagccccctactagagattgagctgcctgaagtaaagactgtgtcttttatccctgtgcttgacatgcagtagacagtcaataaatctacattgttatagtattgtcacatgtaatagattaggcaggtggtactgtttttattgtagttatcactagaagcacagagaggttaagtgacttgccaagagtctctgctatttagttaacaattggggggtgtgatgggggcctataatccaagtcgggaaaactaatgtaggccttattccattaagtgacatcacctttctgtagctgcctcacattttgttattctccccaaagctcacccatggtctggaagtatattgaaaaattcagcaagtagttagagcagtcccaatagctaaaataaagagtcagtgctatgttagcgatttggctgtggtagaacaactgtcccattggtagaattggacgaaagaacattaaagaactgaggacttctgctcccatatggtctaggaaagtgtcctttcaactcagagtagagcactcaacagagcatgtacaggcttggagttgataggtttaggtccaaattcagagtcagctattagtcaatttttggcaacatacataacttctctgagcctccatttccacatttgtgaaatggatataataataatagtaatagtagtaatacaggcccatcggccaggcacagtggctcacgcctgtaatcctagcactttgggaggccgaggcaggtgaatcatgaggtcggcagttcaagaccagcctggccaacatagtgaaaccccgtctctactaagaaatacaaaatttagccgggtgtggtggcacatgcctgtaatcccagcttactggagaggctgaggcaggagaatcgcttgaacccaggaggtggaggttgcagtgagctgagattatgccactgcactccagcctgggcgacagaggaagactcttgtctaaaaaaaaccaaaaacaaacaaacaaacaaacaaaatgcaggcccatcgtatattctttttgtttttatttnnnnnnnnnnnnnnnnnnnntgcagtggcaggtatcttggctcactgcaacctccgcctcccaggtttacgtgattttccccactcagcctcccgagtagctgagattacaggcacacgccaccacgcccagctaaattttgtggttttagtagagacagggtttcaccatgttggccaggctggtcccgaactcctgacctcaagtgatctgcctacctcggccctccaaagtgctgggattacaggtgtgagccactgtgcccagccctatcctgtattcttcatccacagttctgacacctaaaaagcttggagagttccaagttccttgtaagtttgatgcaaatgcactcagcggcggcgtggcttggctgatgtttgtggcctttatctcacacggtgtgagatgttgctacagaaatatgagcgggtttgaattcaagtctgccccagacccaccgggtgtgatacatactctactgtttgtgctttgtattaccctcctcttgttttggttatcatgaggatacatccacctcctgctataaccagttggctaaaagaaataagaatccttagcctaaggaacagaatgttcatagagacatggtggccttttcaaatacttgagagactgacatgtggtggaggaattatttatttagtaggcttcaaggtccaaacttagctgggatcaatgaatgaaaatttcagggacagaaattgttagctcggtaaaaggaagcagcatttaatggaaatgtgcaaaaaaaaaaaaaaagtgagatcattgtctttgaaggtgttcaaacaaagattggagaccagctggtggggctcttgaatattatggtatggagggtgtttgaacattaaatgggagtggagtgaggagatggactgaaaggcttttatcatcttcatacttaagatgacacgattctgtgaccgctgcccccttcatccctcatcccagcggactcgcagggggcccacgggggctggttgagaggctgggccctgacctcgctgtctcctccaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtagtcccggaggccacaggtacgcgcagaggccgggcggggcgggaggggaggggcggggcgggcgctgctgtcagccgccagccggaacttgtacagcgtcgacacctctccagatttcggatccagtcacttttcaaaaagatcaaggagcctgacgccccagccagagaccgcgcccggtcagggagcagggtccacccggaaacgttgcacccaaagggcaaaggacggccctccctcctgggcacaaggacccatcttctcccagtgggtctttccctctcgccaaaataacaagagtatagggtggggggtccctacccagaccagtccaatgaattggtggaatcatcagttgaatttccccctagtcaggggccaatgtaccctccgtctagttcttacagaaaaaaaaaaaattaaacagggaagtttttcttttctggatttgtatatttttgttaatgttcttttcccttttctttcctcctctccttttcttctttgtcatcttctcagtcctgttaatttgttttgtgttttttggagggggaggctgggttagggaatggaagcctaaataatccctatttcttctttttcctgaattttggaatattgcgttaccagtgcatccgatttcaggtgcttaactctctgtatggtgactgaggggcctgcaggagcacaggagaaggagtcttgggaagaatcagatggagagtctcaaaagtccattgcagtaaactttgagatgccaaaaagcaattaactcatcctatactcagaccttgaaacgcctggaatgtcaagggttaatctgtcttttctttccctttctctttctgactgtcactattactgggtttgatttgatctttttgtgaatgtagtctctgaagacagacaggggaggagaacagaatgcacaaagtatcctaggactttgtttaaggagcggaaagagcagatagaattttcccataccatggccttggcttccggtggaacgtgccgttcacagaggcggaaggactgggccaccccgttggtatggtgcatactttgtcaactgcatctcttttcaaccaaactcaaatgagtggctgcctatgaagccagacccccaagactatcatggattgggtggtttcttgctacttagacgtgagacctgggtgcaagtgtatgtgtgtgtatgtgtgcgcgcgtgtgcgtgtgtgtatttattcaacagaaagaccttaagtattcaagaatttgctaggttcctgggagagaggtggagtctcctagtcaatacacgggcctgggaaccaggaactcttgagtcgtaacctcagcttgagcagtagccctcccaccttgtatgactttaggtaaagcatttaacttctcttccatctaccaaataggagttactgatgctgtccaggttaccaggtgactgctagtgactgctctccatgtgagaagtttgcagagtccagagcacacatctgatgggaggggcgaggctttctacagctgcttgacctttgcttggcttcactaattgggagtttcacgcagagttctcattggctgatggaaaacaaattctatgcaatttctgattgtaaacttagaaaattcagagagaaacaaacagccgctaccaaccacctccacctccaccaccgctgccaccaccttgaatggaattgtcctcacttttgttgctgttgcaaatgtactaaaataaagacatctttggaagatgacgagcttaattcatgtttttgccatttgggttggtcggcatcctctttatgccaggacaatcagttagggctgccgtcctgggggccaaatggtaccctgattattcctgtgagggatactcgttttgtcctcacctgacctcactcatgaatttgaatcctttatcttttttctctttaaccatcaaatgacaacaagctgtgcaagacacttgtgtctttttttaaaccttgccttg

SEQ ID NO: 17232 - DNA, 67876 bp, Human
atggggttatttttgcagtgatgaaaatgttctaaaattgactgtggtgatggttgcacaaatctgtgaatatactaaaaactactgaattgtacattataaatgggagaattatatctaaagaaaactttttaagaaagcaaatgggacattataattctgaaggatcacaatgagatacaatatagagtgttagcataaggtgcccttaataaatggtggctattactcattgatgggcatttagttgtttacatttttctcatgatgatcaacactttaaaaagaacatcccagcccagtgtgggatggccaagagttcaaggttacagtgagctatgattgtgccactgcacttcagccttggcgatagagatcctgtcttaaaaaaaaaaaaaaaaataggccgggagtgaatacataggctgggcacggtggctcatgcctgcaatcccgaggcaggcagatcatgaggtcaggagttccagaccagcctggccaacatggtgaaaccccatctctactaaaaacacaaaaagattatctgggtgtggtggtgcgcgcctgtaatcccaactactccggaggctgaggcaggagaatcacttgaaccagcaggcggaggttgcagtgagctgagatctcatcactgcactccagcctgggcgatagagcgagattgtctaaaaaaataataataaataaaataaaataaaataaaataaatattgtagtcctagctactcgggaggctgaggtggcagcatcacctgagcctgggaagtccaggctgccacgtaatcacgccactgcactccatcttgggtaacagagtgagaccctgtctctaaataaataaataaatagaatatcctgtacataacaacagtgagcactttcacagccctcattttttcccagaatcttcagagatgcagacgtgctcataaaatgttgtgtacattttatttttttagaatctgaaaaactgggtcagtgggcgtttcatgggaagtatagaatgttagcaaagtatcctttcttaagtttttctgcgaaaacggtaataatgtaagtataacaaggagcacttatagtattattttccaaagcccttgcttagggaaggagcttcagtattaagttgttaaaatccatacccaaagtatttgttatgcttacaaaactggagatggttctgctttgatcctatttgcggaaatttgcatgcatttaacagaggaaaacgtggtctcctgctctattaagtttgtctgactacttttaataaggcgaattcacctaaactctgttctagggtgtgaacacaattacttgccctgaaaatactcagtttgacttttaaagagctaaagtggtaacaggtggggagagggctaggccaaattgtttgagggggtgtggaactgtggaatttgagtgaagagaaggcccaactttttttaaaaaaagagcggggcgaaataacttggggcacaacagtatgtctattttgtaggcatccctcttccccagggcaactggagcccaaaaagtgggtgagaaagccattccagggcagccagcacttccagaagtttaaggtcaggatgccggagctcaggggaatgccgatgcgccgggcaggctgtgcctgggcagttcattctgtggcagctggaggcactactcggccgccgcggtgcgaactgcgggcactgtggggcggagacctaggggcgggtcaacaaaggtcgggcgattgtgtctggaggcaaatccgacgtagacggcggcaggcggagcccaaagccggtgatgcagggtgcgcagggatcccacctggagagtcggggcggcacgttgagaccccaggggtgaagggcgggggatcccaatcccagccctgttttcccctcccctttccccgcctccttctcgcccctcccccctcctcccctctggttggaaagtttctagaatctcttcccagcggcctttgcggttccaacatggcggagctgacggtggaggttcgcggctctaacggggctttctacaaggtactgaccgttttgccactttgtcgagtgttctgggtgctggagcgcgtttgagggagggttggtggtcccagagagtgaggtttggggtcggaaaggcagccaggccaaagctcgaggccgctggattccttgcttctcccccctccacccgcggtttaacggtctcgggggccggggctccgttatgttttgaaacaacacgtcggacacctcttgcattttcctagttatgaaccctcttggttgctagtgcggttcttggcgggccggtgggaagcaactgagtggctgctgggcggcgggagctccttcggagcaggcccgagctctgggaggtgggggagtcgtgaaaggaggcggtgggattgtgtggtctcacccgctcccccgcccctcgaactgggccgggcgggagctcctcagcccgctcctccgacccctccccaccccttggggcgggtgtatcgcggaatctttggaattcacccttgtatttgagttttgggccaacaaatctttagtgtctgaggagaatgggggtaccggattgagggttaggatcaaatacagaaaagcagaaaaccttgaattgtggcgggttggaatatttttgcggcctgggaaattgggcggcgccttagcccctctattacggaagaaaaggagagttgtgagctttaaagtaagatttaaaatgcgaaatggatcagggagataggtggagaggtgactaatttctttatatcactgcccctgtttttggagggaggttttgttttgttttgttttttctcccacgaggttttttgtttgtttgcttgggaggaaggacatccattactatggaatcggggctgaaaaacgtaagaggaatagagtagaggaatttggtggggcattcagcgttcacatatctgaaaatgaaatcctaatagtttattttttgccactatagcgttcttttctccttattttcccgaaatacgccaggttgttagaagatcaatacagaatctccccagctgttgtctgtcagtcaatctcactaagccagcatctcaaatgtttgagagtcttggctatttttatgaagggccttcttctaatacatgagtattgtgcgtatgcaaagtgaattctcacaggttttcatttcagcgtaccttttatcctatgggtttttattttatttggccacgattttctattttcagcattttgattttcttttcttagtttactgattagctctgtggatttggtttaactgtcacgtggtaccagcataatggggaatcacagcgtataaaggatccccctaagctttttgcaagtttaaatctccttaggtggtaaacttaaagtaggaacagtgcctgttggaaatgagactttatgttaatgcgtgagtagttaacattgacgttctcggtttaagacttgatgtcagaccaatgacctaggtgaaatttgagtacatagttaattgacttttgttgttattgaaacctggtggttgctttccctggactactgcagatacagttcgctgggtaagacggcgaaaagaatagacttatctatgtttttcctatcaattgtagataagtcgttttgcatcaccccccacccctttcccgaaaagttttaaattctcactatttggccctgtagttcttgtataagggaggtatgcattttttcttgcatattggaaaaaataaagtgattattttgctttatttcatggttctgcatcatgcatgtggtagacaactatttttagcaaagtatatttgtcaatagcctgctatgcaagatattttttcctttttttaataaggtgaaggtaattttagtaaagattgtttgcagtcttactttggtttctcacggtattttttttttccagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctaggtctgtacttcaccttaccattatctaacaatggacccctgaacaaatctctctgtctaacatgaggggcttgaagtagttctgtgatccccagtatatttttatcctattaaactgctgacttgaaaaccattggcttattgcacagaagtttattgctttttattcattagaatgtaaaagttaatgttaatttacatacagtaaaataagccttttttggtgtacggttatgaatcttgataaatgctgacaattatcaagattaactgtcactttaactgtggtggtgtcagcatttatcaagattcatagcccccaaatttccgtcatgcccttttcagtcaaccattcctcaaccccagcttctagagtgttttctgtccccatagtttttcttattcagaacgttacgtatatagaatcgtacactatattgtgtagtgttttgagtccggcttccatttagcgtagaagcaatttaattttaattagtttttttccaatttagaagataatacatggtcactgaggtaattttggaactcagcaaaaactagaagttgccttgagatgagagctgttaacattttagtgtatttctttggttttttttggtggtttttcaatgtacaggtgatctgaatttcccttttttcccctcctcttaccccgtataggcagaagacacacatttggccgtaagtgtgaattgccattgatgagtttcaaagtcagttatcatgccttgaggcagtactctgtagactttgattaaagtttttgtagtagaactgaaacttcatttcacaaattaattggaaccagtgaaacgctgaagatctgaatattttacctaaaattagggtagcctttaaaaaatagtatgtacacaaatggtggcatgctaaatacattgttctgcatttaacagtggctctatagttagagatattagaaacttgatttgtgcatgttcgtagccctataaatctgcggggatgagagagaatgggaagatgttaattaagcatttgttggtgggctatgctgttatataaaataacattataggctttgtacttttgtacttctcatacctaaagtagcatcttaggttttatactactggacatttaaggtgtcttgaaaaagaaagttttaatgaggtagaatgtatattctataaaacaaccttttttaagtgtacagttgaatgacagtgtatttacagagttgtgtaaccaccgccacagtcttccttcagaacgttccattaccccacagaaacctccggctcatttgcatcattaaagtgctttttaactgatgtataaatatatattagtctttgtaatagcattgcaatttgtatggccttgggctgagtataatttcattttatttttattttttgagacagaatcttgctcttttgcccgggtgggagcacagtggtgggagcgcagtggtgcgatctcggctcactgcaacctccacctcccaggttcaagtgattctcctgcctcagcctcccaggtagctgggacaacaggcatgtgctaacatggccggctaatttttgtatttttagtagagacggggttttactgtgtaggccaggctggcctcgaactcctgacgtcaaatgatcgccctcctcggcctcccaaagtgctgggattacaggtgtgagccaccacgcccgaccatgagtataattttaaatagaagttggaagtaagtcactcagtttctggctcataggaaagtttccatgatgttcgaagggaacctgtaagctctgagatttcagtcactttctgcagaaggtagagttacatttttttgttttcttgagacggagtcttgctctgtcaccaggctggagtgcagtggtgcaatcttggctggctgcaacctctgactcagtggttcaagcgattctcctgcctcagcctcctgagtagctggtatttcagggacgcaccaccacgcccagctaattttttgtatttttagtagagacggagtttcaccatgttggccaggatgttctcgatctccaggatggcctccatctgtccgcctcggcgtcccaaggtgctgggaatacaggcgtgagccaccgcgcctggccagagttaattacttttagagctgtctgcttccaccgtgtaactgtctacaaaacaaatctcaaagtactatatttctataattccctgtttagcttgatttaatattaagtggaatttgagcgtaatctaaattatgcatagatatattaataatgatgaccaatagaattatagtaaaaagttgcgttcagagggtatgctgacttttcaaggttagtacagaatcttgttagttggtttcattgtggagatttgtaattgaaaaaacgataattgtcttaatattaggccaccctgttaatttaaaaatacatagttccagataatttaaaatggttgttttgcatatttaaaaagataattttcattaaaatgctaagtaatgaagatttaactggatgtcaaaataaatgatcacaacagcttttattttcattcacagatagttgcaaaacgtggaggggaaggaaggctgggattttctactctatcttgctgatggtgatcacagttattaaaaagtcaacttaggccgggcgccgtggctcatgcctgtaatcccagcactttgtggggctgaggtgcgtggatcacgaggtcaggagttcgagaccagcctggccaacatagagaaaccccgtctctactaaaaatacaaaaattagccaggtgtggtggcacgcgcctgtagtcccagctacttgggaagctgaggtgggagaatcgcttgaaccggggaggcagaggttgcagtgagccgagatcatgccattgcactccagcctgggtgacagagtgagactctgtctccaaaaaaaaaaaaaaaaaaaaaagtcaatttaaatgcatatatttcttgtaaagttttgtgttttgtattagaagagcaacacataattacgaaaaatatgaaagcagaaaagcacatcttacctatctagagagatactgtcaaggccctggctttaaatacttccagaaaacattatttttccgtatttttacttttatgtacctgttattttctatgtcagatatttgtgtgccttctgtaagataatagtttaagatgagagcctgttctttactagattatgtattaagcttctatatgtatttcctgattttcttttcccaagaactctgtgaggttggttttatttttttaatttttattttttagtagagatggggtcttgctatttagatcaggctggtctcaaactcctggtctcaagcaatactcccatctgggcctcccagagtgctgggattacaggcatgaaccactgagtctggccagcattagggatttttcaaagtaacttttaggatagtgagcttacattttcattaggaggaaaagggcagatactttgctggattatcactctggataagttctctatcacagtgtttaaggttgtcaaattagcttttttgtagtgggaagagcaatatgcattcattccatgattgacccctaattcttgtaatagtttttaactggcaggatcatccaggtaaacaccttggttttttcatatgcagtatgaagcagttgtatttcctttaacctatttataagttgtgaaatctttgctagtttctgttgatggcagtcccatctacctctagcaactgtaactaattttcattgagtacccagactacttaccagactttgtaggtgccttactcgaatttcccatttaatcctttcaaccacagtgaagtagataactccactatttgagaatactgaggctaagtgaatccaggtctgtaaagttagatgctgattcaagattcagactctaaagtttgacaccacagaaccaatttctttaaccattatggtgcaatattttttgaagtacaaatgttttgccacattattactaattttgaattgttactaatatgaggagaattatgaggaataaattgggaggttcccagagaaatgatttgagctatgcctttgctttagacaaatctgctttctaatatagtagccaccagccatggagctgaaatgtactagtctgaattgagacatgctttaaatgtaaaatacaaattgggtttcaaagccttagaattaaaaaaaaatgtgaaacacctaaattttattttttttttatttttgtttttttttttttgagccagagtcttgctctgttgcccaggctggagtgcagtggcactatctcgggtcattgcaacttccgcctcctgggttcacgtgattctcatgcctgagccacccgagtagctgggattatagctgtgtgcctccacgcccaggcaatttttgtatttttagtagagacagggtttcaccatgttggccggctggtttcgaactcctaacctcaaatgttccacctggctcagcctcccaaagtgctgggattacaggcgtgagccactgcgccgggccaataattttttacattgattacatgttggataatattttaggtatattaggttaaataatattgaaattaatattacctatttcttttcatgcattttgttttattttgagatggagtcttgctctgttgcccagactggagtgcagtggcgcaatctcagctcactgcaacctctgcctcccgggttcaagcaattctcccgtctcagcctcctgaatagctgggactaaaggtgccagccaccacgcccggctgatttttgtattagagatggggtttcaccatattggccgggctggtcccaaactgctgaccttatgatcttcctgcctcagcctcccaaagtgctgggattacaggcatgagccactacctccttcttttaatcaagataatttatgctatcagtgtatttaacttgcctgccattctctatcttcagcgttttttgctgtctattttgggaagatgaacagaggtctccattagtaaaatagctgatgaagtttattattgttggcaaagggatgcgctcccgtgttgagatttcttcagatcaggagcctcagaggctcctgaattcctttcttaatctacataattaatcataggtagctgtttttggttcccttttcatgtaacctttttgtttttacagtttttcaggttattttcaagtcttaaattttgttgatatatgtacttagttcatagtaagccctcagtgtatatttgttgaatgatgtgtaatcttagtaactgctaacttcatcatttctgattttggttcaaactgaatttaaatgatttttttaaagaagttatgttttgatcttggtcaagttcagatattgtcacaaaactttatgcatgcatagagggaactgtatagaacttaaactctgcaacgagaaagtcagaatagttttgttcttttttttttttttttttgagtctagctctgttgcccaggttggagtgcagtggcacaatcttggctcactgcaacctctgcctcttaggttcaggcgattcttgtgcctcagtaattattgtagctgagattacagccatgcaccaccacgcccggctaattttgtatttttagtagagatggcgatttgccgtgttgactaggctgaccttgagctcctgatctcaggtgatctgcctgcctcagcctcccaaagtgctaggattacaggtgtgagccaccatgcccggcccagaatagttttgggtggccatttggaactgttaacttattccatttcagagagaactgttagataatacatacaaatgggtgaacctaacaagccaagaacattactggtatgtaaacagtagtagtagacacttgtgtattcttaaagaaatcttcacatcctcattgtcctttttcttttttcaaactcagaacagttacatgctcaatactaatgaatgctgaatgcttgccttgaataatttttttttcttattagagcttactccataattggctgggcgtgctggctcttgactgtaatcccagcactttgggaggctgaggcgggtggatcacttgagggcaggagttcgagaccagcccggccaacatggtgaaaccatctccactaaaaacacaaaaattagcagggcatggtggctggtgcctgtaatcccagctattctggaggctgaggcaggagaatcccttgaacccagggtgggggtgtgtgtggaggttgcagtgagccaagatcacgccactgcactccagcctgggcaacagaaactccatctaaaaaaaaaaaaaaaaacttgtaataattattgtaatgtataatgtaattggtaaatttgcagactttttgaatttgtggaacaagtatctagtgatttggaataattttactttgtagatttagttgcgtagatctttttaaaaagtatattgtttgaagttaagacatttttttgattgcagtagcagccttgactatttggtacttgttggaatcaaattacaacttagatcttttagttgtggtaagcatcttataagtttatatcttataaatttgagatccctagagatggaaaaattagaagtggggagtggtgatgcacatacgtgctgtatggaaaacgtgttggctgacaataagatatattctaattcttaaaagtatacgtttacatagacacgtgtataattttacacacacgtaagtatgatataaaaacttagtctgttgtatttttttttcccctggttgctcttcaccacctgggtctctcacctccgcctccatattaggtaacctttgtttgtagcacatatacgtggttccatatatttcactatgctcgtagaattgtatataggtacgcattcagttacaagtatagggtttttcagtattactgtataaaaataggatcatccacatcttaactattttcatgtggagtatgatttattttttaaggttatataatcataacaatgtattaaattcagccattccccagttaatagacatacactttgttttcagttttttgtcgctccacataactatttccattggatagatatcaaagaatgggatagcttggtgaaagggaacctttaaaaaaacaaaaaactgtaataaatgttgaaagattgctttccaaaaaggcttctgatgcttcctgtgttctccatcaataataaatggcagctttttctttttatctgggccagaagttggctttatgatctttaatttttgccagtctgttggatgtaaagggatatctcattggaacttgatcccagttgtgaattttaatgttgtttgccatttgaacttgttcttttaagacttgcctttgtttgccatttgattttgtttttctaagaattgcctgtcttttgcccatttttttgttggggtgtcctttgtcagttttgaaaatctttctgtattatggatattaagcctctgacctgatgtaagagtgtccactctcccacctatttatttaggttattaattttgagataggatctcaaaataaataatactgtgtcacccaggttgcagtgcagtgataggatcatggctcattgcagtcttgaccttccaggttcaagcgatcctcctgcctcagcctctggagtatctgagactacagacatgtgccaccatgcccagctaatttaaaaaaattttctgtagagataggtcttgttatgttgcccaggctggcctccaactcctggactcaagtgatcttcctgcctcggcctcccaaagtgctgggattacaggtgtgagccacactgtgccctgcctccccatccttttaacttcttttcttatattgctggtcatagtgagattttagtttttaacataattttttttttccattaaggcttctgggtttccagtcctggttaagacagtctgtgcccagattatacatacaatttcttaggttactttggagttttatttttacatttaaatagtacgttaatatttttgcatatttgtatgtataggcagttatgctagtgccatgtattaatcatctctgtttgaaagttgtttttcttgcatgtgtgtctctccttagctgtatctccctcacttctaggattgggatgagaggttgatgctcagcatcctggagggctggatcccattccagattgatagaccctcctgagaattactccaaagagtctggggtgtcctgggaataccatacagagatctcgagaagggaacattgtgatttgctttttggcaaataaggccagttagggatcttattttccttacattactgtcttggatcctctcttgttatacacagtaagtagtgggatctgagaccttacagtgaaaccactgtattgtagtgccttcatttagtgaggcttttttttttccttgccctgataaggagccctttatataatctgttaactatgtagacagtccagaaactttattatgaatcttttaaattactttacttatcataaaagctccaggaagatttaccatggtagttgtggggagggagtagctttaagtactcctagcacatctttgagtgtcagggagtaccccagtttaagaatcttcacctcctttattttgcaaatagagaaattgttgtttcaggagaccggtctgttgatctgtctccctatgttgcccaggctggctggcctcgaactactaggctcaagtgatcttccccgctcagtctcctgagtgggttgggattacagaccctcaggcatccttcttgagaactttaaagttgcctagataacgatgatcacccagatctgggagacaagtcagacttttgcagcttgagtttctgtttttttttgagacagagtcttgctctgtcgcccaggctggagtgcagtggcgtggtcttggcccactgaaacctctgcctctcgggttcaagtgattctcctccctcaggctcccaggtagctgggacttcaggtgtgtaccaccatgccgagctaatttttgcatttttagtagagatagggtttcgccatgttggcctcgaactcctgacctcaggtgatctgcctgcctcgacctcccaaagtgctgggattacaggtgtgagctgtcgtgcccagccttcagcccgagtttcttatctgaactataaagcacagaaacacagtttctcagttctggtgatggcacataggtcgtagtaccattctagatatatgtgagagaagttaattcattacacacagcggatgccttattgcatcgggctgtattctcctagaatcctggttaaaaaagattgtttgctgtgttcagttttctctttcattttgaaaatcctgttaaatggatcatgctgtgtagggtgcagagcaggacaacagatgagattctgactgtggacgtgttgattttaggtgtcagtaaactatgggtggagatgtctgaatagttggaagttgggtttagaatcaacagaatagattgtttttccatatatagatttgggaaattagtggaagatcaaccaatttttgtatttttagtagagacggggtttcaccatgttggccaggttggtctcaaactcctgacctcaggtgatccacctgcctcggcctcccaaattgttgggattacaggcgtgagccaccgtgcctggcctcaatgcaatttcattatacctaaaacagcatcagttgtcagaggcactgtaccatgaagaaagaagaaatgtgccaattaatctgaacaatggttgtctttattttttaatattcttatgtagttattgaaaaatatcctaacagtcccatacataaaatgggaagttcaagcaaaagaaattcattaaaacatattcatattcagatacctgtgtttcttctcaaaatatcttcctcagtgccatggagagtattgatgttgtaaacctactttaaaagggctctcctggccgggcgcgatggctcacgcctgtaatcccagcactttgggggctgaggtgggtggatcacgaggtcaggagttcgagaccagcctggctaatatggtgaaaccctgtctctactacaaataaaaaagttagccgggcatggtggcacgtgcctctagtcccagctactcggaaggctaaggcagaagaatcgcttgaactgggaggtggaggttacagtgagctgatatcaggccattgcactccggcctgggcaacagagcgagactccatctcaaaaaaaaaaaaaaagtgcattcctctgttgtctccaggattttcttccagtaatttttactcattttgtgagctttgatcctggtgctttctagattttatcagaaggtgttaacaaacaaacattttgataagaaaccgcggtcattcctaaagtggttcttcgttggtttgctgactgaaatgctcaggggttaccatcaggtgccacagaaaatcgcaagcaaaccaagtttgagtactaaagagtgacatttatgtcctgactgacatgtggctatcagctattccaagatgccatccattgtaagaagcatcctgatttcagagatgttaaatcattcaaattgatgggctggaaaggtagactggggccagagtatgaatcaataaataaactgataattgatcaagggataaaaagtgataataaaatccattgtggcagttcttggggaagaaaaaacccgaggtactgaattttgcatgaattatgttagtacctttttctcatgggctatatattttgtaatcaaatttatccacatcagtaatatttaactgatgtagttggggtaaatggagagttaacctagtcagaggaaagacccttcactatctaacaaacagcccagtgtctctaataaagaaggatttattttaatcagtttatctttagaaatacagtaagtactttaccacaagtttgcatcaggaattaagccatgaactgcacttttttctttttttaacacatttgagaaggcataaaaaaagtaatttctgactgttgtgccaaatctagagagaaaaataaaatgtttaaatttcatgccagcgattcatgagaagagaattaaaaagaaaaacagtagtcttaaagctggagtgacaaactatgtaagaatacttgatcaggtttgagggaagcagtaatgtgcgtctgatacttccttttgcttccttaagagaataaatgtgaactagaggtatgattcctgacaggtctcctgctttaccatgaaacttttaataggttggaatcttgagactggagtcattaaaaagttgggttaagccaagggtagttcctaatctctatttagggggattgtactgtatatatatatatatatatatatatatatttttttttctggccttttgttggcattaaaaaagaaaaaaggcagtttgttttgcaatcagaaaactcttctaagaagaattttgaaatatgagagttacacttttagggtgtaaatcttcgattttttggttctggacttgcattttaaaacttcggattcaggctgtgctgtttctgattacatttggtagtctgccaaatactaaggttttaaagtttctgtttactcctttataaagtttgtttactcctttataaggaatgtaaatttactgttgtaatgaattgaaatggtaggaaggcatcagtgggtcttaaaaaaaatctaaagtaacagatgaattagtaatcatggttactttccagtcaaaggaatttttctagactaggatggtatattcttaatgggtttattaggaatgttcctgaagggacatctgtacagatttctaagccacaactcaatcaagatacctgatctattgatcagtatttcaaacattaaaattttctttcagcttgaatccaggttttggacaagataattgccttaccagttgtgagttagtttttgatactttgggaaccttgccttaaatatctttttatgataggtgccttatttcctctgattaacattactaccagactcaatcttttagagtttaaaactatatgaattggcaaaagtatttcatcatttggttcgtagtgatttagtgaaaagagctcaagacagatgagattttaaatttgtacttttaacctagggagtgaaactttggggctatataagatgtgtattgtttcaactttccttctttaaaatgagtgctcttataaaatgagtggtttataaatgatattttgtctgccctcatacagtgtcattaggtcactgttccacagccagggtccataatacatctgttcagattttttgctatatttgtaatattaatcttttaactcctgaaatatattcataccatgtttctttctgtttagcctataggattttttttccacaacggctcctgtcaagttgagaaactttttgtttttcagctatattctgtaatttcaaaaatatattcataaagtaagcagatatcctgtgtacttttttcccccacaggccatttaagcacccgtctaaaaaaaaatgagtagatcttcatagtaaggtaggatctacaagacacaaactgaagagaaaagcgaagttcagaacaaattgtagcaaatgtttaacaatttaaaggagatttgtatattattaaaattacattttttcctgtgaattacttgttcacctagttcatatccatcgataccttttccatcagcttgttcttactcacctaagaatatttgaattggggatttaaccctgttgtatgctgtttcaccctctgcccccttttctcctttgtatgtgatgcttttatattttagcttctgggtagtatacttttatcaaactttgtggcttttgggttttgcttttttggttagaaaggccttccttactgcaagttatagataattggctcctgatttctcctggaattgttactgatttttttttgaagtttgaatgttttatctattgatttttttttttttctgatgaagacatccatttctgttttccccaagaattatttaaatgttccaataccattttaaaaagagtccattccttccccatttgtaaattcctaaacgactttaggcctacttttggaatctgttctgttcctttaaaatatcttttccatcttcattattgtagttttaaaataatctttaaggtttggtaagtatagagtgttattgttccctcccatcccagcccccccaccccattttagaagtttccttttttaaaattttttgagataggcttattttattaggtccccccaccccaaacacatacacactgttaatatttcaatgggatcccattgaaattataggttaattttaggggcatattgaaatttttataatatcaaggtgtctaagaacatgatggtgttttacattttcctaaattttgtatttatatttattagagcttcagacattttttgtacatagcttttgtgcatatgtctgttgttgaggacacttgtaggatttattttttggttgttgctgtaagtagaatttttttgtataaaatttttattttacagctgcctgttgtttacatgtagaaggctaatggattgttagttaacttgctgcttaagtggatctttgactagaacctttttttaaaaaattgttttatactagattgcttttgaaattagttcttcggatagtgctttttcactgctcaaggattccttctactccttccatccctactttcattttacacttaatttatggcattttttgtttgtttttttttagacagagtttcactcttgttgcctaggctggagtgcaatgcgctttctcggctcactgcagcctccacctcctgggatcaagtgattctcctgcctcagcctcccaagtagctgggattatagtcatgcgccaccacaccctgctaatgttgtatttttagtagagacggggtttctccgttttggtcaggctggtcttgaactttgcctgccttggcctcccaaagtgctgggattacaggcgtgagccaccgcgcccggcctaatttatggcatttttagttttttattacatgatgcctgtttgttttgtcagagttatgtgggcattttaagatatttttttttccgcctatccatagcaagctgtgaacattttaagattttgaatacacttcagatgtgttatactgcctggttattaatgattatcttaaattatagttaagagtttcaaatgtaaacattattggactgtgcgagtgaacaagacaagtgaccatttaataaggatgccttgaaatcttctgtgtttgcatatgtatgggaagaagaaaaagacatgtcaaaggctttgttctgagaaatatgggacctgagccaggtgggtgtgaataggaagagagacagtcgaaatccccaaagattggatggagacttaaaggcataaagccccctgccatgtgcagacaaatgtggctgttatggtgtctcctatcggattttggcgaagacccagccctgtcaatttgggtctcttgagcaggcggggagacctaccatcattctggtggcttgggaatacaaaaatacatttaaaagtattgactgtgtcctgtgtcaagtggactaaattttagagaaatctggccattagaaacacctttgtctagaatttaggacttggggattagattttatggagtaggatgttagaaatcgttcactacagtccaaatagattttaaggacttggtgtcaggccttactctagtaaatcttatggcagaatgatactagcaataagagtagatgctcaagggccggggcgtggtggctcacgcctgtaatcccagcactttgggaagccaaggtgggcggatcacgaggtcggagttcgagaccagcctggcggacatggtgaaacccagtctctgctaaatatacaaaaattagctgggcgtggtggcgtgtgcctgtaatcccagctacttgggaggctgaggcaggagaagtgcttgaaccagggagttggaggttgcggccagctgagattgcaccactgcactccagcctggcaacagagtgagactccatctcaaaaaaaaaaaagaaagtagttgtacagagctgtgttttaaagtttgtgaaaaatgtgcactcaaagttgatactgatgtttatggtggaagcgtttgtgggaaaggtggaagtggtgatttttagatagaaaaaaggtttttattacaaaggagagtgagagattattataaaggtgagaaaggagtgaaagttcctagtgatttagagttctgatttgaactaatccactatgaattatacagagactagaaagattaatttgtgagacttttcaaactttgtgagagtttgttgaagaactagaacacgttagtggaagttgaaaatatggctgtcttctgatggaagagatgctttactaatattcataaacatggaaattcccagtttctgaaatttgttaaaaaatggcaagggtataatacagttatatttgctggtaacataactgaatgtgctgaccaaagtgatttttgaaagcgaatgtggtccaggtgtggtggctcatgcctataatctcagcactttgggaggctgaggcgagtggatcagctgaggtcaggagttcgagaccagcctggcccacatggcaaaactctgtctctactaaaaatacaaaaaaattagctgggtgtggtggtgtagtcccagctactggggaggttgaggtaggaggatcgcttgagccagggaggtggaggttgctgtgagcccagataacaccactgtactccagcctgggcaacagagcgagactgcctcaaaaaaaaaaaaaaaaaaaaagacgtgaatgtgccctactagaaatagagaaactggccagaaagtcattattatagcatggtcagataatcagagcctgaactacagtggcaactcttaatatttaaatttagggaggattaattaataaatatctccagaattgcaaggcaggagctactatagcagtcttttttgtttttttctttgagatggagttttgctgttgtcgcccaggctggagtgtagtggtgtagcctcggctcactgcaacctctgcctcttgggttcaagcgatcctcctgcctcggcctcccgagtagctgggattacaggcagctgctaccacatctggctaatttttgcatttttagaagagatggagtttcaccatgttggccaggctggtctcgaactcctgacctcaggtgatctgcctgctctggcctcccaaagtgctggcatttcaggcgtgagtcactgcaccgggcctaccatagcaatcttcaagagaaagatatcctgggttttaggcctcagtgaggatgtttgcatagaaatgtcccgtggcacacaaataaatgagacaacaggcagttggagctgaagaagagaactgagccattcccactgccagtttatattttatagtcttaatttgcttagaaaaatgtctaacacagagtatgcccttaaaaattagttgttgtgggttttttttttttttttttttggagatggggccactctgtcacccaggctggagtgcagcagcatggttatggctcactgcaacctctgcctcccaggctcaagtgatcctcccgcctcagccttccaagtagctgggaccacagacacgccaccaggcctggctaatttttttatatttttggtagagatgggattccactgtcttgcctaggatggtctcgaactcttgagctcaaggtgtccgcctttcttgttcttccaaagtgctgggtgcctgggcttgctttgttttttattacttaagttacccttcttccatttactttgtaagtttcaaaaaaaaaaaaaaacaacttttttgttgttgtaagttgccttttccctttattctcttctttcttttgggtttattccttcaaatctctttactgttagttaatggacttttgggaaggagtgagataaacagatgtgttcatttttgtcttactttgaccaggtactatacatgtgtttatatagctagtgtgccttggacattatggagtctagtgtgataaagatgttttagaaaagtatttcctatgtacaccatggttgaaagtgtgtgtaagcatttgactaacattcagtaatttgcagttctgattcatagtaatataaagtcatttaatgttaattgtaattatataagtgccaaggactgcttgcctatggttacacagtggtggaatcaggatttcagcaacagtaattctacacccaagtcctttgctctttcttgagtatgtcagatcttatggtttctttcagctgtattaatcaaaggaagatagaataagaaggctaattttaatagtaattttaaggctgaaaaatgaccgccaattgttattgagaatctgtattcattccaacataatcgtgaacagtgtactcactatagcccaattttcttttaagggaagggaaagagaagtatgtaggaaaaataagattaagttaatggcaaagatagtattcaaaatggagtcatgcattttactgaaggtgaactataatgttgataacatttataacaaaattgggttcttactttgtgccaggtactgtgctaaacattacttcatttacttctgataaatttttcattaggtggatgatactgtaattaatttcattagatcaaaactgtattcaagaatatacaagtgatagagcttgggtatgaatcctggcagccagtactccagagcttgaactctttgtcacagtagtaaatactgaactcttagtcacaatactaaataactgccttgctgaactaatacctgaggtgttccagggatgtacatttacttttgctaattcccaggtagatgacaccgggtgaaaaatgaggttcagagaggttaagtaacttaaaagatcatgtgtctcataaatagaatagatggaaatcaaactcacatctgcctaattccaaaccttgtgttcttttagtactccctattatctttgaactaatacaaccttttagagttacgaagtgctttaatatctatgcttttataatgtttttgtgtcttgcagggatttatcaaagatgttcatgaagactcccttacagttgtttttgaaaataagtaagttatttttgttgacaaaggccttaattttagagatggcagtgccaaactttttgcttttgggtgttcctactgccagtggaaaaatgattttgcttttagggagtggggaggtttggttgtttgatcataagtctagttttgataattctttatctgtttttctgtccataattgtcacttttttcataaccctcttcgccagaacatgtatggatatgaatcagttttgcagaaatagatggcacaaattagatgataatatgcttaatatttaaaagcccagaattttcaaatgaggttgtagaaggtcttccagttgactactggtcatcagaataagtattaagccatttttaattgcctgaggggtatgcagtctaaaaatgggaaagacagcatgctgggtttggttaggaagggctataaaagagcgctgggctgcgtgcggtggctcatgcctgtaatcccagcactttgggaggccgaggcgggcagatcacttgaggtcaggagtgtgagacagcctggccaacatggtgaaaccctgtctctactaaaaaatacaaaaaaattagctagtcatggtgggggggcgcctgtaattccagctacttaggagactgaggcaggagaattgtttgaacccaggaggtggaggttgcagtgagctgagacggcgccattgcactccagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttgagatgatttctatctttgagcagctgccatttggacagtaatggtgaaaagaaagcatccccaaatcttttacttgtcagctgctactttgcccagccttggcagatagaaacttgagggacattttatgtcatagtatacttcccagacatataaatgacctatgagaaattagagtagggaataattttttactttataatttcagcttttaaaatacaacatgaaaaatgtcagttaactgctaaattggtttaatacattcgtatttgctacagagttaaaagtaagctttttctaggttctaattataatgtatatatccactgtaggaaagataaatggaacgtgagaaaatgaaatcttttgtaattcagctattcaaaataattgctgataattttctgtatttctgtgaacatgtatactaaaaagaattacacagtttatattgttttgtaatatatgaaattgtgtttcctttattgataggtcatgtagttgtgaaactatttgaaataagttgataccactactatttattgggcagctgtccgaatcaaagttagtcatcactgtgaacttagcttatttcatttgcagaataatgtatgtattgctcttatgatgagtaatttgggagaatgtgtactgctgttaggatgagtaatttgggaggtaatgtacaattgttaacaattatgttaattatgaacttattaagagtcatacaaaatctgttctacttcagtaactaatttcttgggaaattattaatagtatgaatgttgttttccttctctttagggaaagctaaatgataaactaacttgaaaaaatatgcaacaccaggcgtagactatatatttttaagttgttaatacaccttttctaatccttcagttggcaaccagaacgccaggttccatttaatgaagttagattaccaccaccacctgatataaaaaaagaaattagtgaaggagatgaagtagaggtatgtatttttaagtttattttcttgtgtctatttttttgatttaaataaatactcttttaggagaattagcttagttgatggaggataaatctaattcattttctctattctttctattggtggtaatagctgtgtaatacagcagtgcttgagttttggagttagaatcggtctcacctgtcccatttttagctttgtagactttaaatttatcattataatttggaagtcatggatgatagtgcatttgaattcttaaaagaacctagcattgaacgctatgcactatggtgttacccttttccttctttttgctaattactttaaataatttgtcttaacgatttgcctgggtgtctttatgaggtgttaatagttattttactatagtgatcattaacagagttcatatgtaacaacgtgaaatattgtaactagctttctgccttctacaatattctagaaatgtctgaggaaaaatttaaaagtacagaaaagcaaaaaaaatacaggaggagggaaagaaaaatcacagctcacagatgaataaaacattgttcatgtcgtgcatgttctttcaggcttgtctcagcatcccaaaatgatgggattacaggcgtgagccaccgtgcccggccctacaaacattttattttattttatttatttattttttgagatggagtttccctcgtcttccaggttgcagtgcaatggcgcgatcttggctcactgcaacctctgcctcccaggttcaagcgattcacctgcctcagcctcctgaatagctggaactacaggcgtgtgtcaccacgcctggctaatttttgtattgttagtagagacgggctttcatgatgttggccaggctgttctcgaactcctgacctcaggtgatctgcccactttgtccccccaaaatgctgggattacaggtgtgagccaccgcgcctagccatttacaaacattttaaacttacatattctgtactaagcactttgcaaatgatttagttatctgccaattttattttactttattttattttttgagatggagtctcactctgtcgcctaagctggagttcaatggagcaatctcagttcactccaacctcctcttcccaggttcaagcgattctcctgccacagccttctgagtatctgggattataggtacccaccatcacgcccagctaattgttttacttgtagtagagacagggtttcgccttgttggccaggctggtcttgaactcctgacctcaggtgatccgcccaccttggcctcccaaagttctgggattacaggtgtgagccaccatacatggcctgattttttaatgacaaattttctttgagctctcattaatctagatagtatgctaggaagtcaaaaattgcagcacttcaatccctgacaaccttaacttagtgtacccactttggtggaagtcaaagataaaagagtgagtaaagtgaatgctttactcattcatgagggacttggctcatggcaccctgacataatttatactttgctttagtaaaagcaaaatagtacacagtgaacttagtgcaaataattaaaatccaggcagaatttttaaatggcagtaagttaagaagtaactttttgtaaggatacctgtaactatctgtgtgtattagagttcttgaggaaaatgttactggtggcatctgggggagacacgaggaaacaaagtggtgaagtgactgctgcaaatcaaggagtgtgaagtggagtccttggtgggtgctatatatggcagtgatgctgcagattactgtgttcatttggactttagattttattgaaaatgtttttctcaatattgtatctctaatagttttctgtgagaataaagggcttgattcattttcatttttcaaaatttatttctgatacagtgttttttggattttgagtaagcaaaagttaggtcaagcaaggaatgatgtaggtttggacatgttctagaattagaaatgtgtggcactcagttttgagagtaatgcttcttacacttttttgttgtttagacacttaaaattggtagcgtcaagtctcagattaaagggaaaactactcttggtggggtggtgagggtgttgttacagtgtactttttccattcctgtccaggagggtccttccctgttcctgaacagtctggctcacccctgtggtctgcctccgcttttgtgaagaagacattggtgttagagattgaatgatttagaaattgaatctagagttttttttaaatttcacgttatgttttatgattcagctctggtcaaatttgctctctagaattttgtaagtcattatctgaaattaaaatgtgattttttttcacttttgaaaaatttaaaaattaatataaggaaaaagtttaagcataatcttgccacccataggattttgtttttttgtcaccgtttattaaggatttatccatattacgtagagtgtttagaaattcggagttagtgctttcccaggtaacgtttcgaaagcctcttccccttctttaaatttaaagtaataaagcttaatgtaaaaaatgaaatggtaaaaaattatataaagtacaaagtaaaccttccatcttaatgtaggtgtacttgtccacccaccctatcttaaatctcatttaccagagttgattctcttgtaagttttttatttgcatgtataaaggacatatttaagttgaaaaaaaattgggattaagttatatatttgtgacttttgtattcacttaattaggacagcaaacattttcgtgtcttctcatttaaatttacctcattttttgtaaccacctcaaaattatttggtgtggatatatcaaattaaaagacattgaaattaccagattttttgctgttagcaaaagaaaacaatgccagagttaaagttaatattcttatgcaagtctggtagtataattcctaagaggttaatgtttttaaaagtattaaaatgtaccatttcatcctccaaaaatgtcttcagaattactttatacttttattaacactggaggtatctttttcatacattaagtgactgtattatattgttcatatgtacagttttgtaaacttggtggatggaaactgatgtctcatgaattctcatttccttaatgaatagtagtatgggaacatcacttaaattagttggttggctcttaaccccttgttctgtgaattgtctattttttgtttgtgcagtttttggtgtaggaagtccttgcattttatggctgagttttatttttttattttattttatttttgagatggagttttgctcctgttgctcaggctggagtgcaatggtgcgatctcggctcactacaacctccacctcccgggttcaagcgattctcctgcctcagcctccctagtagctgggattacaggcatgcgccatcatacccggctgattttgtattttcagtagcgacggggtttctccatgttggtcaggctggtctcaaactcccgacctcaggtgatcagcctgccttggcctcccaaagttctgggattacaggtgtgagccactgtgcccagccctgagtttttatcttttttgtgtttttttcttaggcaatttttttattttttattttttattttttgagatggagtctcactaagttgctcaggttggagtacagtggcacaatctcagttcactgcaacctccacctcccgattttaagtgattgtcgtgccttggcctctgagtagctggaattacaggtgtgagccacaatgcccagctaatttttttatttttagtagagatggtgttttgtgatgttggccaggctggtctcgaacttctggcttcaagtgaacacccgcctcggcctcccaaagtgctgagattataggcgtgagacactgcgcaggcttacttttacatttttaaattatgttttctacatctgcttccctgcactatttttcccttataccggtgggggggtgtgggtggtaatccttttaggttgcttcatatctgatcgccttagttatgaaatgtaattttttggtcaataaacactttttcttaaaatttttctgggattgtgcaaaatagcagaggtaaactgtcattcttcaatcatacttagagatggtcaggctcgattgtttactggtttattataaaggatacaagtcaggaactgccaaatgaaagagatgcatgaggcaaggtcggggtgagggaaggggcttggaaagtagagcttccatgacttctttgagcatgccacatttccagcccatcaatagattcaccagcccgggagctctaccatcatactttttaaacagattatttcagagtcacaaaacggtttgtgtcctcttcttaactgtgtgaatactttattagcttgtccaaggttagtctggaggttgggaagctgataaccagtttcattttttgtttttccaaatgtattcagagggtttggtcagttttgtgccagactcacaacattcttctgcagctctaggaatcctttgaaggaaagaaaaggtgactttgcccttagtaataaatttagaacaaaaatgatccaagagagagctttattaagcttgtaaggtgatttttaaagacttgagccataagaaatttccattcttgtaggtcagaaatggttaagtattgacagtttcatatggtttacactaacattttgttacattaaaaatatattggttgcttaaatacagggtttgcctttctagccccttaggaaatttacatgaagttacagcacataaagtaatgtcatggcccagcagtggacccaagaagacaacatatgatttatagtagaaagttaattttgaaaaggtctaaaatggaaatatttatttttatacctaattagtggttttttatttgccttttaaaaatggtgtcatctctttaaaaatcttcataacacttaatagtaaatatttcataagtatttgcttaatgattgatttttgctgactaaagattgctagaaaaatatgctccgcctgtaaagtttgaaggtaatgtgaaaatgaagagttctttagatttcgtttacattgggtatctagtacagtgttttgggctcttggaagggcagtagaaatatccctcctccctcatttcacatgtaacatttttgctttttattttagatatctgccttgctcagcaagtaatatataagcaacacacatagacacgttacatagtaagcctgacatctaaggtgataacgtgtttagtttttgtttttttctgttttcttttttttttggagatggagtttcggtcttgtccaggctctagtgcaatggcgccatctcggctcagcgcaacctccgcctcctgggttcaagtgattctcctgcctcagcctcccaagtagcagagattacaggcatgtgccaccacacccagctaattttgtatttttggtagagacgggttttctccacattggtcaggctggtctcgaactcctgacctcaggtgatccacccgcctcggcctcccaaagtgccaggattacaggcttgagccaccacgcgcagccctgataatgttttttgtaaggtttcttccttgcatttagcatatttgaaattttaaaaacctgtttttgaactgtgaggttttctggtttagtattcatagttaaaataggaattggcaagtttttgttcttgtggcatatgcctttccttttctagtcatatggcggattgtcaggcattatggttatatatctatatattatattaaaatgttgggataggcgccttgagagaaattggattaaaaaagagaataaaaattatctgaggtaagacactcctttcttttacaactttttagatttttttttttttccaaattttatttttttgagacagggtcttactctgtcacccaggctggagtacaatggtgccatcatggctcacttacagccttgacctcccgggctcaagggatcttccctgtctcagcttcttgagtagctgggatcataggcgtgtgctaccatgctgggctaatttttgtattttttgtagagatgaggttttgccatggtgcccaagcgagtcttgaactcctgggctcaagcagtcacccacctcagcctcccaaagtggtgtgtgctaccatgcctagtctaattcagtattttatttatataaaagatatacatggattatttactctactttttaaaaagttttaagtttgattcttttggccagtctgaagtttttagctgtctgtatttagatgtagtttttctcatcataccaagataccaagaccattgttagtcttactgcttgggaaacgctcgcacataaaggagagacgaacatattctttgttacttgtttttgtcttgcagagtggccagtttctaggacttgatatagtaaagaaagctggtaggaaactgatttgttaaagtgtcagccttaaaggtgaatgagataatactattatttaggtagagaaatcatacatgttcattccagatgttaaacttttctaatgcgcattttcttcttaaaatgtcataatacaaaatggcagatacataatagcagtactcaataaatgtatttcacatgttgaaaatgggtccttatgattgattatttagtttaatagtaaataataggaaaatttctttggaaaaatggaaatatagttaatttactgaagactggtaaaaattctctgtctttgatacttattcttaatttggctacttgaaaggcataggttgggccaggtgcagtggctcacacctgtaatcccagcactttgggaggccgaggcgggcagatcatgaggtcaggagattgagaccatcctggctaacacggtgaaaccccatctctactaaaaatacaaaaaattagccaggtgtggtagcgggtgcctgtagtcccagctactcgggaggctgaggcaggagaatggcgtgaaccccggaggtggagctcgcagtgagctgagattgcgccactgcactccagcctgggcgacagagcgagactccgtctcaaaaaaaaaaaaaaaaaaaaaaaaaaaaggcataggttgaacattatgaacttgaatgaaaaattgatgactttaggatccagattggaattacatttaaatcactcacatttgtttgcttgagtttagagattttttttgaaacagaatttgacttgggatcatttggtggaaagaatcctgaaataggcttttggaatttgattcttcctatttatttcatcctgtactccataaaacgatagtgattaaaatgagtgctattgtgtttttaggcttctcatcatggtcactccacagtctcctggattttagtatgttagagcagtgtgtgggccatttgagagtgtgaattgttcctgcgaaatagtttgcagagttaagtaaaatctgaggaaaaggaatttctgtggggcgctgttattcaatgacagattcgtaaatcaattcagtaattaacatttaggatatagtacactagagcacagttttaatgctggcttattgaagtgatattttattgtgtgagatatactcttcattttgtataggatatgatttgatccatagcactgtaagtgggggtgttttcttttttccttcttcctaagacggagtcttgcttgtcgaccaggctggagtgcagtggcgtgatctcggctcactgcaacctctgcctcctaggttaaagtgattctcctgcctcagcctcctgagtagctgggattacaggcactcgccaccatgcccggctaattttcgtatttttagtagagacggggtttcaccatattggtcaggctggtctcaaactcctgacctcaggtgatccacccgccttggcatcccgaagtgctgagattacaggtgtgagccactgtgcccggcttttttttttttttttttttttttttttaagaaggagtcttgctctgtcatccaggctggagggcagtggtgcgatcttggctcacctcccaggttcaggcgattctcctgcctcaacctcccaagtagctgggattacgggcgcccgcccaccaccatgcccagctaatttttgtacttttagtagagacggggttttgccatgttggccaggttggtctcaaactcctgacctcaggtgatccacccgcctcagcctcccagagtgctgggattacaggtgtgggctgtgcagccaaatttgtagtgtttttgattcaggcttaggaatttaggtttagtcactttatgagagtaacttggtctttcaggggtgaagttatgaagcttacagaagtggatattaagtttaaaatggagttcagcatttcatcgttcagtgagaaaagcctccaggcagttgagatggtttatttagaaagccagattcatgaatgattatgctttggtgaaaatagaataagggggttaggtagttttaagacataacattttcagcaaatgaggcttgatttacccacattaacaagagatattcgaactgcctctctgagatagttactcgaatgggcaccttcttttggttgttaggatattctttttttttttgagatgcagtttcgctcttgttgcctaggctggagggcaatggcgcgatctcagctcaccgcagcctccgcctcccaggttcaagcaattctcctacctcagcctcccgagtagctgggattacaggcatgcaccaccacgcctggctaattttgtatttttagtagagacagggtttctccatgttgaggctggtctcgaactcctgacctcaggtgatccacccacctcggcctcccaaagtgctgggattacaggcgtgagccaccgcgcccggcctagaatattctttttgtaaccctcagtatacttgggaaaacagtcatcactgatcgtttaccaaataattttgtagcagaaagaatgaaagggtagtaaggtcgttattggaccttttttttttttgagacagggtctcgctctgtcacccagtttagagtatagtggcatgatcatggctcactgcagccttgacctcccagtctcaagtgatcctccttcctcagcctcccaagtagctgggactagaggcatgcaccaaccacacctggctaattaaaaaaaaattttttttatagagacgaaatcttcctgtgttgtccaggttggtctcaaactcctgggctcaagcagtcctcctgcctcagcctccaaaagtgctgggattacaggcatgagccactgtgccccccattattagacttttttaaaggccattattgactccatgctggagtatagtgaagcaaacacaactcactgcagccttgacttcctgggctcaagagatccttccaccctaccccaggcccccaagtagctgagattacaggcacatgccaccatgcctggctaacttttgtattttgcatagtgatggtgtttcaccatgttgtccaggctggtctcgaactctggagccaaagtgatctgcccacctcagcctcccagagtactcggattacgggcgtgagccccaccacgcatggccttattagacattttagtgagggtttaaacatagcaaatctaactttttcatattttccaggttttgatgatatatgtatctacaatgaatgcagttctctaaatgtaactaactgctcactgttatacatgaacctagaacataccaatcttataaatattgatagcagatttaaaatatatctctaataaattctagcttattctggttattcttacagttggatcatcagaatgcagtccttgaatactttggaacttttaatgacatctcattctattgaagaagggatagccatctctgtgctgtaattttagcacatttagtcagttggattgactaatctattgaatatttttgcatttcattatctttctttttcgagttacctttgtatacacatctgcttttgacatttccacttacgaagtacattttggcacacaaacatttcttaaaattttatcttcaatttttattttaccttttttttccccctggacagggtctcgttctgtcacccagggttgagtgtagtggtacaatcttggctcactgcagtctcaacttcccaggctccagcaatccttccaccctagccttccatgtaggtggcaccacaggtgcacgctacgacacctggctaatttcttttgtatttttgatagagatggggtttcatcatgttgtccagggtggtcttgaactcctgagctctcaagcagtcgacctgctttggctccccaaagttttgggattataggtgtaagccaccgtgcctgaccacaaacatcttaaaagatggaagaatactgtcatatacccttttagcaaaccaggatgatctgggttcttgttggaggattttgcatgatggagtctcagttgagtcattaactggatgagaatacacatcatctttccctcttctccttagaaatacattgtttgagaacaatgtttgagaaatacatcgtttgagaaatacatcgtttgagaaatacattgagaacattcatctaagatgtcaccatctcagacttcatagtctgaggttttgctttgtaagataatttcacatttatcagtactctttgcatctgttgtctgatatctctaataattagaaaggccttcctctgtaaatttttcttctcttcgcaattatgagtgaaaaaaattcataattatcaactggtcaacggtagctaaaagcagactacaaggatggtgtctttggtctttttgaactgttttgaaagagatgtgatacctcaggctatgcagtaaggaaactgtatgaacattaacagtttatttcactgttgtatcctctaggtgatgccatcattcctctgttccattttagtctttatttaaagcatagctgagaataactgatgaatgttgatgaaattgtaaagtgtttcaagatataggaaaaataagatcactagattctaccttacatttataaaagggcccagtggatacatataataattacagaataagggtgagttctgttctagtcttagagaagtaaactttcttgttttttggaatatgtcgtaaggaagaatataagtcatgagatattgatccctttgaatagttagatctgtttataaaagaaatggaaaagctaaaattgagtttaacggaccctgattggtatattggacttcctgctttttctcatagcttttttctaatcatggtatacgataaagttcattagtaggttttggtttattcatttccagttccagtattcctaccacttccaagattactctcaaatcatcctgatagaagcttcaggctttctaaaagtctttgtttttagttgtttgtgtttatctcccagatggctgttaacagccactgataggtttccctgatgatctctgcaaggacagtcaatcttggtttttattggtttttagtttcttctcagccccccttttctacctttctctatactgaaaatataatacgttaaagaagctctgctgtgtcataagaaataactctaatcccaagtgaaagcttctgtgacctattacgttaataaaactgatatttatagatataaagaatatgacttgtttttttgtggatagtttttattttgttttttttgagatggagttttgctctaggtgcctaggctggagtgcaatggtgtgatctctgctcactgcatcctccaccctctggacatgattctcctgcctcagccctccgagtagatgagattacaggcacctgccaccatgcccggctaatttttatattttagtagagacagggtttaccgtgttggtcagccttgtctcgaactcctgacctcaggttatccacccaccttggcctcccaaagtgctgggattacaggtgtgagccactgcgtccggcctggataggaattttgtaagatacttaatgtattctgctagatggactgaatgtgtgtaatttttttgttcagttaaacaattttagtacatttgatttaggttctttagcacgggatctaaatgtcatatcctcgatggaatttaaaaattacgttaatcactttctgagaacaatttttaatattaacaatgttgacagaaacaggaagacctgtgttttacattatttaaaactcctttgtaagagcatttctttaaaataatacttatgtttagtaaacctcatgaatatggaattaatttctaagaagctaaattgcccaaaaaagtagttttatttttaagtagtaaatttaagttacatatcactttctttaaattgcatttaatatgccaatttaaataaaatagcatttttcattcttaagtttattgggattgggtattaataaaaagtcatttacagcattgaaatcttttgggatgaatggatataggcatttttttttcttctcaggtatattcaagagcaaatgaccaagagccatgtgggtggtggttggctaaagttcggatgatgaaaggagaagtaagtactcttcacacttgctttgtgactagtttctaaggaagtacctcagtgcttggtttttgtaaatcttatttcaactgttagttttatttctaaaagcctacctgagaaatagttgatcagacatttccattagcattaatttctgtttgtgttctgtattggcaaacaccaaagctgctctccagaggtacacctcaagcatgtaaggaccgccaaggttcatgcttgtaagaacctataatctagtttaggcaaatcagattgatgtagctaagctgtgcttagtattttatgccacatgggggagggtccgttggttaagctgagcaaggtaattagaacttcatttaaacttcattatttttgttcagatgggatttttaaagtattttgatgtcttttagttttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgagtaattttatatactattgaattgttctgtgaattaagaagatttttcagtcctacaaaacattttccctaatgcccaatcaaaccttctgatggaaaatcatcttaatgaacaaaggttttagtggggcttgtcaaaatgaaacactgactttgtattgtgactctcctctgactttaatctgttattgagttcttacacataaattgatttctctctaggtgtgctaatgaaaatgcacataaagattttaagaaagcagtaggagcatgcagaattttttaccatccagaaacaacacagctaatgatactggtaagatagtaccatattataaggtagcttattaatggatattgcacagattttataattacatatttcagaagagaaaagctaagatcaacttagtgtatagtgaatttattaatatagtgtgggagaaaaatttgtttgcagctataaaatgttaattacattcttaacatcataaaattcttaatgtgtgagattccggatttttccccaatcaaacatattctgaatagcagatctaaataatacaggaattcagaaaggaaagtgtgattactcagagtagtgagtgttaggtgaaagaagtgtagtagatgagaagcaaggaaggctttgcatagaagatgggatggtgtttgtgctatttggaagaatgattaaagttttgagtaattagcttgtttgtttatagtctgccagtgaagcaactgtgaagagagtaaacatcttaagtgacatgcatttgcgaagtattcgtacgaagttgatgcttatgtccagaaatgaagaggccactaagcatttagaagtaagtgggtttacttacaaaagagttttctgtgtcccatttagtttttgtttgttttttggagacagattctggctctgttgcccaggctagagtgcagtggcacaatcttggcttactgcaacctccacctcccggattcaagcggttctcctgcctcagcctccgtgtagctgggattgcaggtgtgccccaccaagcccagctaatttttgtattttagtagaggtggggttttgccatgttggccaggctggtctcgagctcctgggctcaagtgattgcccgcctcagcctctcaaagtgctgggattacaggcatgagccaccgaacctggcccccatttagttttatatttttcaagttccttgcttcaaacgaaggcagcccaggacctctgtttcgtgactgtttggagttgtgtccgtagaacaattgcttttccattttaccttttatcaaacatagcctttcctttgcgaaatgcctgttgacttgttggtaggacttagatgacaggtgccaaagagctaagaaactagggatactcagtagactgtattgctagttctttactttgtatttaacctttttatttttttaactgccttgtcatctgtcagtcatgatatctttcatcagtaactagttcactgtaacaactcttgtgtgagaggagaggaggactaggagtgaggcatcatgtggcatgtagtattaaaatattaagcttatcattatatctctgtcttatcctaaggtactctgttttgtcctgttcttccctgctacactagtaggatacttgttcttcccactcactcacactttctagatctagatgaacacatgtgcatgcacacactgtgatgtctcagagaaattaagatatgtttattatccttaggacaaatttggaaatgttctcattaatttaaaaattctgaacaagggatatgtgaacaaatctgcctgtatctggaaaagtgttttagactaataaaatagatgaataaaacagtttcttttccccattcattttatgacattagatgagtttcctttgtttcttaagaaacttgagttttggcctttttaaaaaaatttatgtgggttttcggtggttttttcttcttgggtttttctttatactgtggtaaagtacatatgaaacttagcatcttaaccatttttaagtgtacacttagtattaagtatgtttacattattgatcaatcttcagtacatctcatcttgtaaaactgcaaatctataccctttagacagctgctcattttcccctttccacagcccctgacaaccatcattctattttctgttgctataaatttgactattttagatacctcatgtaagtaaaatcattttagtcttttttgtgactggcatattttacttagcatcaaggttcatctatgtagcatgtgtcagaatttcctttttaaggcagaatgtatataccacattatgttcattcattaattggtctgtggatttgggttgctttcacctctttactgtcgtaaataatgctatgaacatggatttgcaataaaacattttgtggccgcgtgtggtagctcatgcctataatcccagcactttgggaggctgaagtgggaggattgctttagcccaaaagttcgagaccagcctgggtaacatagtgagagctcgtctctacaaaaaataaattaaaaaaaaaaaattagctgggctcagtggtgcgtgcctgtatttccaactattcaggaggctgaagtgggacgattgcttgagcccaggagattgagttggcagtgagccatgatcacgccactgcaccctagccttggtgacagagtgagaccctgtctggaaaaaaaccaaaccatacaaaaaagccattttgtattttgatcttttatattactaattttccttttttattagtgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagaggtaagttctctttctcctgccttggcctttagtgtattaaccatctattgtttgattatatttttatctgaaattccagtttcccatgaaacatttttgaggtagaatttattcaattagcatcagtcagcctagtagtcttacttatgaagctgaattgaagttaactttgtattgaggggagtgaaagatttactaagtaattaaatatgtagtttttttattgaggtttcttaaccgcttctgagtttacttcagttttatacccgttaacaaataatctatcgaagtatttttttgaatgtttactgtgtgccaggcactggcaggagtaaatggcatatattagaatagcttttctagaacttgagtttgtataatacttcgtcactggttaatcatgacgtttgcaggggtagaaaattagtaagttatttttaaaatgttattcagccaggtgcagtggcacacacctgcagtcccagctacttgggaatctgaggcaggaggattgcttgagcctatgagtttgaatctagccagggcaacatagagtttagaaaagtatatataaatttttatatatacatacacatgcatcttatctatatttttatatatgtaaattgagaccatccttcaaattagagtaactggatttttattttttaaagagacaagattttgccatgttgcacaggcttgtctcgaactcctgagctcaagcaatccacctgcctcagccttccaaagtgccgggactataggcgtgagccaccgtgcctggcctggagttttttttgaatgacaattttgtgtcttgacttttcatacatagctcttatgaacagctgctttcacatagtaaagctgactagaagcttcacttttaatttcaaaacctttaaaagtagacagtataacatagtaattaagaagacagacagacacggtggctcacgtctgtaaccccagcaagtttggatgctgaagcaggaagatcacttgagtccaggaatgagaggctgcagtgagctatgatcatgccattgtcctctagcctgagcaacagagagcaaggtcctgtcttgttgagaaggaggagggaaaaaaaaaaaagacgagctttggagctatactgcctggattggaattcactttaagtaggctgctttgagtaggcttggagtttgttacttgtataagtgttctcattataaaataataatagtgcttaccttaatacagttcttaaggattagatgcattgtaaaaaatgttgattgcatatggtatatcatgtagtgtgcacacaataatttgagctatggttttaaaatttaaaaaaaattttatttgcttttttttttttttttttttaaagagacagggtctactctgttgctcaggctggagtgcagtggcgtgatcatagctcactgcagcctccaacccctgggctcaagccatcctctggcctcagcctcttgaatagctaggactacaggcatgtgctgccatgctgggctaatttaaatatatatctgtatattttgtagagatggaggtttcctatgttgcccaggctggtctcaaactcttggccttaaacgatcctcctatattggcctcccaaagtgcagggattacaggcgtgagcccactgcatctggccttatctgtggttattaaagaacacacgttaaaagtgaaagtgactttattgagaagtagaaagtctgtgtagagactcactcccaaccctctagttgtttaaaattgtactcattagaaattatgaattttgataatcttaccagtaggtacttttaaaaaatgcatctctgcaaaaatagctttttaagtcatatacctgattttgagaataaataaatcagacaattttaacaatttgtattgttaacatttaacatgagaatttcaagcaggaggtatagactagtatatttaggattgggttaaagttttggctgttcagcagctgtgtaatttaaactctgacactaaatttctcagcagcttaaagattttagagatgttattttatttttggttttaatagtactgactgatttggggtttttaaaaatgatttttttttaagtactttgtgaatcacttcacctgaaatctctccccagtggaatgagcataatcttttagtagaacataatcattcagaattttctcttttctcatcttcttgttttggattatgggttgctccgagattgaaacaggatttcatttttacttttcccctcatctacagagtgctgatgctgtaaaaaaggctagaggtttcttggaatttgtggaggattttattcaggttcctaggaatctcgttggtaggtacttttactaaatgttaaataagttaataaacattatttagttacatatagcgacttaattgaaaactagtcttgtagtctgataaccttattccagttatgtgtagatttatttagatagcaatacttcttttctttttttggtgataacattttgtgtaacttgttattgtcatatgttaaaaagtaaagatgtttcttctgtacaggatgactcactaataaggcccagggtttttataagtttgtcattacagtttttcatcagtcttttcatcccttgggatcttccctattattctcactcctttactctctttttatcactgatatatattcatcaaaattatgatagtactttttgagaaggtattggtgatatttgttttgtttagtgcagaagaaaaataacagtgaactaacaatagggtaataaacttctacacagtaggtcctgaatagtaggttgttgcaaggcatagaataataagaagttgtgggcaggagagaaggatgataatatgaggggaggtttcactgtttattatttgacaccattattgaaactgttgtacccatggattatagttaagtgacaagaatttgcatttgaagctatggttaaatgagcattatagcttggaatgagttaatttatagctctgttattaatatgcactacatctgtgctgtctttttgctatttgaggcaattgggaaggctttggttatgtgttaagtatgcagtgactatactaaaaattgacttacctaaacatttaatataaaaagaagcatcaagataatgtagtgtagttttactaggagggggacgagtttttgttccctgttatctctcattatttttttttgacgctagggaaatactttcagcttcttgggttccatttatataatgcggcctgttctgcctttaggaaatgatgtttagctacggacattctatttgttaaattgtataaaacaaacgttaatagaaaaataaatacttccattctaaaaagattttttttttttttttttttttggtcattagtaagtagtatattcaggaaaagtagtttaaaacacaggaatttgtttcttggaatttaactgttagtatttatgtaaaaataaattttttttttttttttttggagatggagtcttgctttgtcactcaggctggagtgcagttgcagcgatgcaatctcggctcactgcaacctctgcctcctgggttcaagcgattctactgcctcagcctcccaagtagctgggactacaggcgcctgccaccacgcctggctaatttttgtatttttagtagagatgtggtttcaccatattggccaggctggtcttgaactcctgctcctgatcttgtgatccgcccacctcggcctcccaaagtgctgggattacaggcgtgatccaccgcgcccggatgtaaaaagcctttcaattctcctcaaacatttggataggtatgacattactgccaattgtgtaagctctactttattagttcttggtataccgttgttcactgtagactgaactgctagaaagatgagatgttaaaattcaatataaacttgaagaattttgtataattataattatacaaaatataggtagggtgcacaatgttatcaaatgtttatcagtatcaaatgaaatcacctttgataagctgcttttgaaaatgctgcctttttaaagaaatcgttaattattgacatctgtcagtactaacattgtggtagctgctctacagatgtaattttgacttaactaaggtttcctcacttgtaaaaatgatttggcagtgggtttgtgaaagggaaccaggtttcttttcaatccaagtctgtcaattataaaagatagccttggtcttagagagttgtggtaggtgttgtgagtaaaagtttctgatatttcaaaaataagaaaattgggtatatttgtagttctttgttctctttattcactgaagtgagtacctgttgtctcttttcctgtatcctgtctacgttggctttggtgatgtgggttgtgtgctctataggaaatacacattagcagtgactattacacactggtgaaatactcaggagtagtacaagaatttctattggttgtcatgtgtaaaaatacagtgtttccctccataatgttttatggatgaagcaggcttttgaataatagtacattcttagtccaaatgaaagaaaaagagaactgaggattaaaagggaatgagaacacttgggtaagttccagagaggatttccttacacattcgggttctgagagttctaagatgaccattcccacccctcccaaatcaaagggaaaaatatctgaacgttgatttgaaaatggttcaaaacctttcacctccagaagccttccttaatcacttctctctgtcccttcagcatttatattcagtgctcaatttatactacaggtctacttcagtttgtcaatatggtctggaatttaaactatggaaatgatcatttaaaatattgacggtctgtggtgggactaaataaaacttgcaggtaggttcctgccaaggaccccagaagggtgatggatgatcactcaaaactggtatagttcacaagaaggaagtggcaaaggttctgggggaggaatatggtatgtcaacctaatctttgtttttcgaaagacatttgcttacttttagcagggtcaaggatggagttgctgcttgagcttcactgtgttaacaatgaaggttgcttttatgtgctgctgctagggctgctcagagaagatacacgtcatgtgaattccctgccctactttttttttttttaacatgttcaattgctgctgcttttaaatttaggcttattaatggggaaggaggcttgagagtaggaatacaagagagaaaaacccattatagtccttttattgtactgaccagtctactgttgtcgttcttattcattctttaatagaaactgttcaggcatgcaacaggaaaatcttccattttaactctttcaaccaaggtttaagtttttgtgaaaagtgatatacttaaattaactgaggatgtggacttgataacaaatatgctgtcgctgttcactgtctaagggatacatcggttccatatggtgaaggttacttaatagtacttgttaataggtacacaactcagtgttgctttgttatttatgtgagtatgtgctaatctttagatagtcctttagggaaagagagccttttgacccctttatttattaatatactcaataactgctgtttgacagacttacaagttaagtgtagaaagttaaatacttgaattttatgtaattttacaatattttatacctagcaagacagcatatcatgtacatgctttatgtcattttttatatagctgtggagtacttgaaaaacttcttggtgtaaaatataatacatgtaaatattcattctaaagttatcttcaagtcatagaaatctcttggacccatagaaacttgaaaataaaagcaagattgatgaatttgctacttatgtgaattaataaagtgctaatgattaatgtcaaaatagtttttctctttgcctttatgtatacatccaaggttttgaaatgggttggatattttaaaaatatgaaaatgatataagcatattttaaaagtctagattttgagaattccttacatgtgagcactgttgtcagtcccagttagtaaccttaggcgtgctgaaagagaagtaagtttcagaccaagggtgaaatttcttggtagtctgtagggcgagttaattgatagtaaaaagatgggagcttcacttgatggttgtaatttagtagcaagttacaaataattggggctgacactgaaagaatagcagaattgagttttagcttaccattgtatttgttttctcttactaaaggaaaagtaattggaaaaaatggcaaagttattcaagaaatagtggacaaatctggtgtggttcgagtgagaattgaaggggacaatgaaaataaattacccagagaagacgtaagtatttaaaatgtaatctgcctctttaaaatgtcctttttttggccaacttaatagttgtaaacattttgtctgttttatctgatacagagggtttttcttctttttaaaattatgtttttataatattatttcatacacttagaaaacaagtcattttctactatgtgggccttgttcttagttgttttgatagtacttcagtaaaaaaagccagttcttgacataaagatttctatttgataatcttaacagttatttttcatacgtagagtgtaaagctgtagaacttgatactccaaaaggaattttttttttcaatagtttttggggtataggtggtttttggttacatggttaagctgcttcagtggtgatttctgagattttagtgcacctgtcacctgagcactgtacactgtatccaatatgtagtcttttatctctcacccccctcccaaccttcctccacactgagtctccaaagtccattatagcattcttttgcctttgcgtcttcatagctaagctcccacttacaagtgagaacatatgatatttggttttccattcctgaattacttcatttagaataatggcctccatccaagttgctgcaaaagacattattttgttcctttttatggctgagtaatattccatggtatatatataccacattttttttgtatccacccattggttgatgggcactgaggttggttccatatctttgccattgtgaactgtgctgacaaaggaattcttgattgtactctccttaactattttatagaatctgaaagtattgaccatttcttaattgaaatccccttacacttttacattgctatagaatctgaaagtattgacttttttttttttttttttcctggagacagagtcttactctgtcaccagggtggagtgcagtggcatgatctcggctcactgcaacctctgcctccctcattcaagcgagtctcctgcctcagcttcctgagtagctgggactacaggtgtgcgccatcacgcccagctaatttttgcatttttagtagagatggggtttcaccatgttggccaggatggtctcgatctcttgaccttgtgatccacctgcctccacctcccaaagtgctgggattacgggcgtgagccaccgtgcccggccttgaccatttcttaattgaaatccccttaacgcttttacgttgctatagaatctgaaagtattgaccatttcttaattgaaatcccattacgttgctgttaattcgttaattctgatcctagctttctaaaattttttgtcgtgtttcttcccacatgttgatgatgttttgtctccttaaaattcctgttttttggtcatatcattaatgctgtacaatgagttttttatgagaatgtttagtgtttttttttttcctgagattttgattatccttagaacagaaactattcttatacattagcagaagattctggcagttaacaaatagatgttatttggaattaggtaactagatgaaattggctggctcggttgctaattttatgacttcagcaagttactttgttaactgtaaaactggtaatactatttcttagtcaatttttaaatgagtattaaatcaaatacatgaaatgaataatccagacctgaaaacaggctatgtgcttaagatttttttaggttcttgccctcccacccccctttttattcactttgaatgcccttttatctgcttgtgaactcctgaggacagtgttaagacttcttcactccctaatcttaaataaggagtttcccttgtttcatgctttcatagttgaaatgacttcttcaaagccactgtgaacctctgtaatagctgtgctatatccctagcacttgccctgttgcctaagttttaaatgaaccatatctaaaaatcattactcttaaaaattactttgaaaataattgagtcatatatagaactaaaatgtcttaaaccacgcttagtttcatatttagaacaaaaaaatccctaaaccattctgtttaactgttagaaaccattctgtaaaatgaagaaaatgggagacatggaaactgattgggggagttaagctttactctcatttttctcagccattaagaagctggaagtatgtttctttaaagaagaaaaattcacagtgtgccatcttatttctcttttctgccactttttaaaaatcttcttattcagaagttcagcaaagtaaaccaagtctggcctaatactttgatttacttgaatacctctacgtatcttaataattcctttaattttacattgtgtaaatatttatgctctggaggtgatatttcttttagtggtcaggaagtacctcttgtagtacacagacactcaagattttgttacctgagcacatactgtagggataactgggttaatgtgctttattatgctttaaagctatacctactaaggtgatgtatctatctagtctgtaagtttatagacagtttgaaggaaaatcgttgttttttgtttctggagacagattcttgctctcttgtccaggctggagggcagtggcacagtcttggctcactgcaatctctgcctcccaggctcaagctatcttcctacctcagcctcccaagtagctgggactacaggcatgtgctaccctgccagctaatttttgtatattttgtagagatgggctttctccatgctgcccaggctggtctcgaactcatgaactcaagtgatccacctgcctcagcctcccaaagtgctaggattacaggtgtgagtcaccatgacctgccagaaaatcattttaactttaaaagttgatttatatacttggaaaattaaattaattataaatcagaaaacttgatataaactgattttttaaaattatttttaaagtgtttagcacacagaagacaatttacaacagtaaattggggtgcaaatatgacaagttattgaaaatctgagtatttcaacttacatggattttagcatttttttctccttaaatcttgaagtttagtacatgtaaattgctgcgtgtttcagaagagttttcctaattatatattggggctgggtacagtggctcacgcctgtaacctctttacgaagtcaataatcccagcgctttgggaagccaaggcaggaggattgcttgaggcaaggagttgggcaacagagcaagaccctgtctctacaaaaaataaaaagtaatagctggttgtggtgacacgcatctatagtcccagctactctggaggctgagacaggagaatcacttgagcccaggagtttgatgctgcagtgagctgtgattgtaacactgcactgtagcctgggcaacagagcaagacgtcatctcaaaaaaaaaaaaaaaaaaaaaaaaaaaaagtgtgtgtgtgtgtgcctgcctgtcagtttcatgtcacttttaggctagaactttgttaaaatattaaacactgaatacttttttttttttttaaacagggtatggttccatttgtatttgttggcactaaagaaagcattggaaatgtgcaggttcttctagagtatcatattgcctatctaaaggtttgtatacggttcatactatattctgatattgttgctgcatttactacataaatgttgtacatttgctacaaatttaaaatgtcctcacattaaacattttatatttgaagtaaacttcaaatctttaaatattttttgttaattcagcttcagatttgccattgttctacatgagaatttaaaaagtcctttgtcatcataaaatgattggccttgtgtgcataatttctcttctttctgagcttttatatttctttctttcttaagaaatgattcctttgtcttcatgcaatttgactctcagatcacttatgtatctgcatgttcatactggagccattttgtttttacttttgtactttacatacaaatagggtacagaaccaggagtgacattgggcttccttggtaactttggcattatgcaaatcatctgcatcatctccactgacattactcgataatttgtaaccattgttaacaaaatagtctatttgagttgatacataaagagcaagggtttttagaaaaatatgacccataaattattaaacattttaattttattttctactctttcccttttattcctgctgtgtttctttttaaagtataataatatcctcacctgttctctgcctctagtatgttttcctcccagtctgtcgtatcattgttgctgttactattttgagatcactctgataatgtcatttcttttcttttgaaattcatctttatatgaaaagtcgcaattaaagctggcattttgaagccagtgctttatctttcagtactcatcttttaaccaagagctttctctagacatctaacctttgcatcctgtaatgacctcaatttctgaatgacaaagtctagcactccttctaggtcacaactcgtgtcactgctttgataggaaagtagcttgttaatagtacctttcatagatgctacctgtatctcattcagcaattctaactccttgagggcaaaatctggtaatattgtataattgttagctatttaataaataacttattttaaagctgtctgttaaacatccccttgattggggagagtccatgtcttcttttatattgtatgcctatagtagcatgtttggcacactctagaccattcagtaaatgttgaacagaaacagcaaatgacctcatcaattctgttgactaggaacacaatgctctttaccatctaattgcctaaggtcacagctttgatagggagtacagctttagctttaggctttaggaaaacaaaaagttatatataagaagacttactcttttttgttttgattgtaggaagtagaacagctaagaatggaacgcctacagattgatgaacagctgcgacagattggtatgggtttcagaccttcttccaccagagggcctgaaaaagagaaaggatatgccactgatgaaagtaccgtctcttctgtacaaggttctaggtcttatagcggaagaggcagaggtcgtcggggacctaattacacctccggttatggtaaaaaaaaattttttttttttttttttggtaatagtaataatagtagttatagtttaggtgctctaacacattttcttataattagttcattactctgtcttggctttgagggtagaaggtagttctgaaggtttagtacacgtcttaatagtagtgatagtatacattaaaatgacagtaaaatatataaaatttccaagcagttatgtaatgaagcaaagcatgtttttaagttggtagttcattgtcatgtttattatatttacaaagaatacatatgtaacttgtttttcaaatactttactagtacagttttatacatttcccagtaaatacctagtaatggtggtggtgatacttctaggaatcatcttttgtctaccctctttaagtaaaaaatgaaaagtgtgcgaatcactgccaagattgcatatagcaagtctttttactagcttttaaaaaatattttacttactcatttggcgtatttgaatatattaacatctcacatctggaattattttatttaacaacatttcactaaaatgaagactctgaaagccagaatctaatttaacactttataaatgaacattttctaaaatgtatttcactgtgaggattgggtctaacccagataggaagggggacagtggagtggtgatagtcaacaattctctaatcctaaattctcccttattcttcttcagctttggagttgttccatttttctacatttggacttggatcttagcagtgacctgatttgtttttttccttcgccccttctctttattttctcttttccttttcttttcttcactcctatacttactcccttttgaggaaatataaaaccttttccaaaatgtaaggcatttaaggaaaatagaaataaatgcaaatttcatgctttaattgaaggatcatctaatgctgacaaagttatattaaacctgaactatcttcaatttgttgtagagttgtaagtttgtgtccctgccctttaatatcatatctttatgttctcattttcttatatatgtttttatttaatgcagtattgaaacctaaacagcaaaattctaataaagaagtgttcagcatataaagggatgaaaattgcagactattattatatttctgaaaatgtttaatgcaaaagacagttaaccagtaatcacatagaaatcaaatatattctcattgatttttgaaccatacattattagcatagataatcagacttggcttattggatgatgcgtatgatgaattcattgaataattttattagcttttgtgggaagtcggcttattgatgagagcttactctggcaaaatgcttttgttgagagtagataattatgtgagaggtagagaaacatctggattcaagaaagctgtgcaaattgttcagtagatggcactcttagctctgaatcttagtggaattgataacattttatttcttgaaatagttactgaacctgagtgggcttggaaaagcaagaaaaaccatttgaatttggttgtagacgttcatgtatacattatatcagagggacttgtagttgatttatatatatatatatatatatatatataatgagtactgtagttttatcagtttaataggaactataagaaacatttcccagtataacatctctgaagttggtatgtgtgttaaattggacatcttacaactttagcagcattttcttttttaatggcacataaaataatgtcttaaaattgatggcctcttggagtcgataaaacgtgattatttttagctgttaagcttagcacaaccaaccattgaaaaatgatataaaccatcttcataaggtgattttagaagtttgaggggaaaatatgattttaaaattggttaaaaacacgatgtcattatgttttgttacttttttttttttgagacggagtttcgctcttgttgcccaggctggagtgcagtggcacaatctcggctcaccgcaacctctccctcctgggttcaagtgattctcctgcctcagcttcctgagtagctgggattacaggcatgcaccaccatgcctgactaattttgtatttttagtagagacagggtttctccatgttggtcaggctcgtctcaaactccagacctcaggtgatctgtctacctcgcctcccaaagtgctgggattacaggcgtgagccaccagcctggcctagtgtcattacttttaaagcttgtttaaaaaaacgactttgaatcaccaacctgtgttttacaaaattgagaggctggaataaatggtttccctgattttattagagtatttgttttctattgcagtaataaattatcacaaacttagaggcttgaccacagaaatttattatcttatagttctgttggtcagaaggctgacatgggtctcactaggctaaaatcttgtcagctgggctacgtttctttctggaaagtctagcggggattcccctttcagtagtttagaaaatttctctacttttaaagacccagtgagattagtttggacccacctggataatccaggataatctctctatctcaaggtccttaaccttagtcacatttgcagagtcctttttgctatcacagaaacatttaatatgtgttattaacagttatttaatatgagtaatgttgagcactagccaatacattaaaattttggggggtacggcctcaatatctgttttacctgctgaaatctatgatttagacattccctctaagtctcttgaatactatatgtaggttaaatttaaggaagactttacttgctgtgacacggggttagataaatactacactggatttctaaggatacttcaatatgaacttttgagagagtcttcagaatgaagtattcttcatttgccctgaattttggtaatgttttcaggtagggtataggtttgtaaataaattcagaagttcttaaacattctgaaaggctttttttttcactattcaaggaaagataaattgccttcattacaacttttatgacatcctgttaataaagtactttttgtcatttggtgaaataaatgttaggggaaattaattcccttccctgagattctaatcccaacaaagaattgaaagtgagtaatagaaatttgatgtattctttgaaaaatacacatccaactaattacctaattgtttttataattgactagttacatctattaacaccatgtagagaaaaggtaggcatcctagagttatcgttaaaggagaaaggaagtgaggcaccttcatgtataaaactttacattttattccctgcaccttaatacttaaaacttcttatgtctgaagagctcttgtttgcatttttcctcaaatgattgcagagtttaaatatagggaacttcaaggtatttcatgaaatcactcttatctgagagtttagcaaatgaacttcaaaataatgcagcaaattatttggttgagaaaattgttatacactctgccaggcatttgaggacatataagatggagttccaccctttatcatagaccaattttgaagtaattccacagggggaaaaaataacaacatggcacagtctgtgatagatgtggggcgattttaggataacaaaaaatggggagagatctgtcttagttgcagtggtctgaagttagaatttgaactaggccctgaaggagatatatttggtcatataagagggaaagaagaagtggcatcccagaactaacaagtggaaatgaatatgatagtgattgagtcatatgtatctgacatttgagttacagtaattattaaataatgataatgtaggcctctgattatatctttgtggtgtttaaataaatttttgaaaggtcaccattacaatagttgcagtgttagaaatggtctgtaaacttttaaaggcaatgctgaatatttgtctcactggtcatggcttcagttctgttgtcaggtgagagaccttctgtttcagagaaaccttaaattctgtttagtaattgcaaatattaggttggtgcaaaagtaattgcagtttttgccattaaaagtaagaaaagcaaaaagtaaaagtagttacttttaatggcaaaaaccgcaatttaagatgctagtaaaacatgccatcattttatatacaacctactggaaaaattacttctagcttataataaagatgccatcaattataagaaatatcttgatttcagagatgttaacatgtgaaaagtataccctagaatcaatgaaattatggtgaaatacactatacagttaaactattcagttttctaaatatgattaatttactcaaatattgaagttatttttattgtactaataatttaggttactaaaacccaaatcagcagaaacatttgactatccatactaagtacattctaatattgataaatgatgttctgtatggttttttttttttggtgccaaaacctaggaattaatgttctgtatattttctgtaatttttctgttgactgcatttctgcacatcagttttttttttaacttccatgactttgtatttcctggatattatccccttttgctgatgagatggtcacacctttgactatattacatgacatagcacatcttagcagactgcagtgagggattcttctgctggttttgaagaagtgagcggccttctgcacatcagtttattttttaatctgtattaactagtagatactatactagtatattaatagtataataattgattattccttagtacgtttcagattgattttaactttcatggatctttctttgaagcagccaaacagtattgcttatttaaacaataatttgtaggacataattttgaacattttaaaaggctttttatagaaatctaagtggtttatgttcttttcttttccaaggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctggtagtcttttctatactctgtcagcatccattatttgtaaacagtttaattttacaaaagttaattcatctcccagggccacccatttttggaagtttctcttgctactcattgtcttagagaaagtagtggaccatatagcagtatcaggaaaagccctcgtagagtgtttctcagtgaaggtttacttagaatatactggtcagaactttagttggcagcttttctttatatgatgagggtcagatgtttctctcttcaggttttggaggcttatttaattagaattttttttgttttccctagaattttggggttatgtttttttgtttgccagacagacccagagatttctaatgcacagagagatgtcagtacttttctatacttaatattgaaaacgaagtgaagagcattcttagctacactatgtagtactttgggaacagggaaaaattgtggaattaactaagttttttaattgttggaggaactgtgctgtaaagaggagtgtttggatgactaaagatttgagggtgtaggaaacgttttacttaattacttctgtcttctaaaatttttttatgctttacattaagttgtaggagtttccagaatatccttggttaccataacgggctagggagttaattgccagggatagatacatagactatattaaggatataactttaacatatcattatggtataccacgttaagaaacccgcaccttccttaatgttatacccatgaaaacttatgtagtattttaatattatagaaagtgtgtgtagatacattaaatatagatgccaactgtgcttacaaattacaaaaactggaacaaatcagggcaaaaattaggaacttgttctttgtttgtttagattttctccctttccacagtaatactctttgagccttaagtttagtttacaggctttcagggtaatagtttttatattttagtacactttgtacagttaccaaggtgtttaaaattacagtatactgaattgcaaaataaatgtacttgacctagtgttttatgattaatggatacgcttagtgtcttttgcaaagatgcttagcttgctagctgttaccaaaggaatcttaggaaaaatcggaattaggtgaatttcttctataaatttgattgttggaggtaataaatgcacataggtaagatgggtatttttcttatgaattgtaccttacagtttttccttttccaccttcacatcaccttccataatgtttctaaagatggagtactagtcagcattcgtttcaacattttcctttcataaccagttagaagttcaaccttatttaattggctgctttgtttcaacttgtcttgattgcttcagttcagttacggatttctattatgtcatggaatgcaggtattgaatattatttgggaaacagtccatcaacatcaacacaacaaagctgcagtcattttgaactcagttaaggggatgaaagctcgctcttataattatttcttaacagctgaatatttgtttcttttcatttttgtttttctagtctctgggcaggattaccttgaaatgtgaatgcaagaattagcatttaatacactattttctaatgtatattttaaaaacaaggcacaggaaatgttaggaagccaagatgtctgcttactttctgctttaatttttcatcaccacttaaagttttatcatatttaattatctttgttattttccaggtaaataatattgaaaacattttatttgaagacagtgcatttttattgggggagactgaagtttatttgtcattgatatagttcaatatagatcaaacattcataattgcagtactcttaaacgaatatttcttgcctctgacatgaatatagtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggtatgtaagcacttagggaagagaaatatatatatatatatatatatatatatatatatatataattgtaaactattgttagtatatgaagcttttttcaaagaaatatgcaattcacaaattgactttttcttagtgtttactttgaacaaggtagatagctttttgtctatcttaaatgtttagttctcagatttgttatagccaaattatttgaaacttggagggttaaagtgccctttgatgccattaaatcagtacaaatattcagctggcaaggtacttagtgcttttattgtccccaagctaaaatcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaactaatcaatttttgcattctttccaaaaccagttctttcatgtgttttccccaaataaagaatgtaaattctggcatctttactattttaaatttagtggttgtagagacatttgggaaaactggttaagagaattagttcccatccctaaaagttcatgttttaaagatagttggaaatttttagagcaattaaatattgtcaaaaaatagaaagtgtccagaaaatatttgttttccttccccttctttcctcccctcctttaatgttggaaatatattttagggctgggtgcagtggctcatacctgtaatcccagcactttgggaggccaggtagcaggattgcttgagcccaggagtttgagaccagcttgggcagtgggatcctgtctagagaaaatacagaaattagctgggtgtggtagtgcgcacctgtagtcccagctactcttgagactgaggcaggagaatcactttagcctgggaggtcgaggccgcagtgaagggtgatcgtgccactgcacgctagcctgggtgacagtgagaccctgtctcaaaaaaaaatgttttagatgaagagattatttcattttttgaaggtggtacagcagtgaatacatttctggccctactgtaaacaagaaaattcaggctatcagtatgaacttaacagaatatattacaacatttattaactagatgtatggtggtttattaccaagtcaacaggtataaaaggagtaacagtggggtttgttggagaagaggcaaaaatttctgtatggtattaattgcaacttgagtagtttggaggcttcaacagtttgacaatgatttctgttccatactacatctattcctgttttacttctttgggattactacttccctcttttaaaactcctcacattccctagcttgccccttctcccaaaagatagggtgggtaaaacaagcacaaaactgttaacccttgatcctagtagcagttctaggaggcagcctccctctaaagctaatatcaatattctgtttaaaacactcatttaatttgatctcatctgctcaaaatttcttgttgctcttagtgtaaattaagcagtgaatattctttaccacacttagaatgtgacaatacacactggtgtccagttgattaacttggatccattcgaggaaattctagagtccatgtcattacagaaattgcctgtatttttttctagatattgttaattattaatctgtattggacttttaaggggcttgtattataaggactggctataaacaggtttttatttgaattaacagaggtttcttttggcttccttttatttaggtagcggataccccagctaagtgcttgttaatttagttgataactatatcaaaatattattctgtctctgtacacagtggatgaaaggttctagaattgtttcaacaatgtgttaggttggtgcagtttttgcacccacctcaaaatggcaaaaaccacaattacttttgcaccaacttaatttagcagcaggctttccaattagatgttttcctaggtgtcactgagggccgaacttggaaacagtgcattcactatgctgttccccacactggctagaattgttcttgtaataggtttgctaccatgtatgtagacataataaagtggattatgacaatagccctttttccaatattgtaaactctttttaatgtagttataaatatattagcaatgaatttaaataatttaaaaagcttcaagatgagcgtactgtttcttacagtttggaaggaaggaggcagtttcagatttgaaacatctttagtggttttctagtaaatgatgtatgtaagttctgaaataggttgttcctttgtggttttaaaagatttacataatagttctagaaagttcttggatcttatgaaagtgttagcatgttatttcataattaagaaacgtgaattgtaaataccatccagctttttattataccagaatgatttagttgttttcatagaatttatactttatggaccaattctccccatacctagtgactttaaataaataatttaaaatttactggagatttcattctttacataattaacttgctcccataatttaaagtatatattgtacttttacatatcagggattttctgaaacagtttgcaatagaaaatacttgaaagaaaaaagggtggttcttttggtatttcttaaaatcagtgaattctaagtttcaattcttttttttttttttttgaaacagagtttcactattattgcccaggctggagtgcagtggcacagtcttggctcattgcaccctccacctcccgggttcaagcaatgctcttgcctcagcctcccaggtagctggaattacaggctgtgtcaccacgcctggctaattctgacggggtttcaccatgttggtcaggctggtctcgaactcctgacctcaggtgatctgcccaccttggcctcccaaagtgctgggtttacaggtgtgagccaccatgcccggccctaagtttcagttcttgaagagagagtgttgatgtataaagtgagtcagtccacatactgtagaacataggtcatttgttgaagttgggttgacgtgacagtagggtgttaggttgggtttagtctttttcctaatccactactgccacttctttgcaaatacacatttcagatcgtccctaccaagattggcaaagggggtgtgggaggggtgtcattgaatacactctggaccttttcccactctgatcaatgtccacatttttagggtggtggtctgtcatctttagtttgcttgtagtttcttattttaatcactcagaatcgtttctagtgtgaaacgttaaaacaaaaccatagaataaaccacacttggatatcttaattgtgctttaaaaaaaaacacacacacacatttgagtaaatatttttgtatctgaaattttcaaatttaagtatatcatactgtgatttggaccaaatttgccccattcccccctccccccgactccccgataattgcaaacactgggcttagaacactgcgtttgtatttccttttactggttgtgggtttctctaacaactttgttccacaacattagggtcaaccagaagcaaatagctggattcttgggaaagaggaatttaatctagatttcctcaatctcaagcttgaaattttcttcagcaccaaaagcccaggtagatttttaaagctttgtttttggttggaggtgatacccagcttaagaaaattttgacactgggtgacccaccactagtttaatagtgaaattaccctttatccataaataaactttagaaatattttttcaacacctgtaatttttttctcatctttaacagtcacagttgcagattatatttctagagctgagtctcagagcagacaaagaaacctcccaagggaaactttggctaaaaacaagaaagaaatggtaaggagaatttaacctgtaggttttttttttttttaatttttggtatggtttagctttatttttttactacttttactgtgtgatcacttgtttccacaaatagacaatactattttagttaaagactcttgaatatgttcttggccccaggtaactaaagatatgcatgcttgagcctgaaatactttttagttagagcttcaaatagcatttataaaattcattctgcccaaagatactgggcatagagactattgcctaattcaggagcaataggctatatacctcttctcattgatggatatagaccttttaaattttagttcttttaaatgctttacagtatttgatatgtaaatgtgatttctcaaaataaggtgagtaaagtaggtgattatttgtttaatattaactgtttatgtcattttcatggtgagctttccagtgttttaaaattaggtacagttttcattagtttagatgttttctgtggtttgggcactgctaggtactagagatacaaagttgaaagacccatagagtggaatactttgttatttgttttgaattttaaagatgttttaatactttgatccattgtggtatataaaactgaaatttttaattagctaattagtgtttatgtagctgttttcctcctcagctatagatttcatttataaagaagttgaaaaagttgtctccctttggcaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatttgctgaatttttttaactttctactttttacaccaattgttgcaaaatagttggagctattaataggcttaggatagtatactttgctttttaaaaagcatttatacttgctcataaatagcattaaaatgtcagttggccatttaatcattttgtaatgaatcatctgaaatctttacacaagtttaggctgttagatgcataggtaattaataatacatgtgataattagcaaaaaaacctaacaaaattctaatcaaaggcaactttggaagacaatgggggatagaagggatgacaagcaatttttaaataataggccaatgatttgctttattcattctcaacttattttgaaggctctcatatcagtgaccaaaaatcagttattaaactttatgtatatattttagccagagcttaatttttatgaagataaagacatgaagtttaacaatggacaacagttagtacagctaattgtgaggtcaagtaattgttagacataggggaaggctttgttccacaatattatatggaccactgaacaagaatgacagccctttgttatcacttggcatatgaaaagtgttgtgtgcatagtttgtgttaattttttatgtgcataaaaatgtgattttaatttatatgctctgaaggataattcagggtatagttaaaaatgtacaatgtgccagttcagtatatataaccctagccctcaaattattctgattaaggttaaaatgtgctggtattacgtgctttttcctgaggccttctgattggttcttggtaacagaattttaaagtaaggtgtgagtagtgcaactcctgtcctttatatataaagatatcaagtaatttcatgtcctgatatttaaaaaaattacccacaaatgtgtttttttaaatcgatcaaagctagcaacaggttaaattgtctcagttctcttacataattgggttaaaaattataaggtattagaagaattttaattaatgccaaattggtaaatatggtgtaaaaaaaaaaaaaaagacttttcattttctcccacatagaatagtcagatatattaaacatcccttttccataaagatggtttcaatgggaatggaagaaacaaaatcttaaaagagtgagtatagctgaaccaattcttcattctagcaataaccacactaagttcattactttacaaatgactaaacccaatgtcttgtcctttaaaaaatataggtagtgcagaattgtgataaatacgcatttgtttttttagagagccccactccccaaagggtagccattaattcaggtagccttttaaatgtatttgagagggttccgtctttttggctgctatcctagttaggtgagatgttgctatg

SEQ ID NO: 17233 - DNA, 11020 bp, Human; identical to SEQ ID NO: 11831

SEQ ID NO: 17234 - DNA, 135010 bp, Human
  misc_feature (1)...(135010): n = A,T,C or G
tatcagccttgcatgtattccttgcttttatacactagtttgcttaaattgcttttatcatctagtaataatttggagattgttccacatcagcacacgtagagcaacttcattcttttcaatggtactgtattttaaccactttctacagaaggatctttaggttttccccagacgtttgttactcgaaacagtgctctaacaaatatctttacacagccttaatttatctgttgcataaatgtctagacaaggaaatgctggggaaaacagtatgcacatataaagttatgactggtattattacatttccttccaaagaggtttatcgtttttatccccaccaacaatgtaatgagggtctacttcccaaacccatgctaactcaatatatctttaccagcccaaaggatgaaaaacagtgtctcactgatttaatttgtatttaatctaagattaaattttaagttttgtaaaaccaagtttatctctgtaattggagaaaacatcatccattaacgtgaaaggtaataagctgatgagactaaattcaaagcaaaagctcgctgagaggatctgcccaatgaggaagatgacagtagtgtctgattttttgctcagtgccacctcctccttttccaacagatagcatttgggagtgctgagttataagaaagtgtggtgcgctcgaggcttgcttgagggtatggaaatcttgagataggtctggagaaccagggagagttaaaagagaaaaaaagtaagaaaaaaaaaagaacttaaggactatctgatctgagagaggcttacaaaaattagcgttttggttcactatttctcgctatttctgcatttcattaactggcagggatcactggatactctgtcatgaatacatatgttgggtgtagttagagaacctcaatgtcattgaacccgtcttgtgggttttttggagagaatgagagtatgctgggagacatgctctgcttgcaaatgatcaacccccgaggccaaccccattcatcatttattttgaggaactgatgatcaagacaggaatatgtatgcctgcctacaaaatcctcaaatcaggccactgaatgttcgacatgagaactttgaatcacatagaagatactccaaaggcagagaaaaatagaaagccttccgacgccctgaaaaaatcttgaccatccctgacttcccccaatatgtaagaaaacctgtattattattacacacacactcccacacacaccccgccctcccccacacacacaccctctatcctcactcgatcttattctattcgctctatttttgagccttggatgttaaagtaaggaacgaagcttagtggggaagcactgaagtgcatggcgcaaatttagatttaagcctcacgttagatttcagatttgcacatcgagtcccgcccctatccaatccggggacgtcaccgccctagtcttcggctgttttaaaagcaagcggtttttaaaacccccaatcctgctctttgtgttggcctcctcggagttgcccctctgcaagccaacaattcgggatagaaaacacctccgtggtgttttcccggggccctcccgcgccgcgttcggccgccagcccgctcgagctcccgcgccaacgcctcaggggttcgccctccgccccccgccgccgcgcccggcccacgcgcagggcccctctccagcgccccctccccggcacgctgcggctggcgctccccagccccgcctgacgctgcagctgggccggagactcgccattggattaaaaatagcgtcgccagtccgccccaagcccgcggtgcccgctcccgccccgcagcccgctctccccgcccgccccggctcggccggctgccgttgcccgcgcagcccgcccgtcagcccgctcgctggcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccgtaagtgaggcgcctcgggggagggtcgcggggccggcggcctgcggcacgtgaagccgggggagaagatgcgcagtggcggccgggacctcttctcttcctccgggcggcagagttggctcaggaacactgcagttcggcagacacttagtgagcgccccagggctgctgcagccgaggactggctcgtgctggtggttttgctccgccagcctccccaggctggaagggcccgattcccagcagcttgcacacagccccgccgccgtttaaagatagatgaaatacaagagttccctgttccgaactgcacgttgcagatcgtttgcgtcctccgcggggcagagcgcagggcgggtaggtggacgggatgatccccccacaccccgggacacacacagcccttctttttctgggaccacttgctttgctcagggatccccacttctggacaattctgatttgctctctgagcttttcttccaccagttcccatttcaccccactccttttcttgtctttagaatgtcagggccaggcgcggtggctcacgtctgaaatcctagcactttttaagaggcggaggcgggcggatcgtttgaggtcaggagttcgagaccagcctggctaatatggcgaaaccccatctctactaaaaaagaaccccaaaattagccgggcgcggtggcgggagcctgtagtcccagctactcgggaggctgaggcttgataatcgcttgaaccgggaaagatgaggctgtaatgggccgagatcgcgccactgccctccaacctgggcgacagaccgagactccgtctcaaaaaaaaaaaaaaaaaaaaaatgttagacgaaaccttccggtgcctccactcgggcagcagaaataggggatctactggattgcgatggttttcttaagccttccccaccttgcccttctaaatgagtcacttggactgacatgcgcaagtataaattattaaaagttcaatcccgagtcgtgacctcggagaatgaggaggaagctgagagggatcgccgccttccacccggggcggttggtggtggttttcacctggttctatgtgaatgtgtgagaagcagcaggagggtgaatgtccctttcaaaagtcaaaatgggcttcaaagtgactcagctgtctggcgtttatcatgtctttttgaggaccaggttatttttatccacccactttagatctcatatgtcacccggcagatctcaatgcattgggaggcgcatggattggatggaccgaggcaggtctcgcaatggtctaatgtattttattcatagcatgtggactattgtcagaggggaaaagaaaagtccaaatgagcggcaacatttccaaagtttcctttattatctgtgggttgattttggctggcttcaaagcacttttgctcgacacacactggagtatcagagttagtatcctctctgtgacatttagtttttttatttatggtaactccatatcatttgagggatgaaacctaacttaatttttgattgtttactttttttttctttcgaaaagatccacagagtggagtgtgacaatcggcagtccttttttaggatgttatccataaattatttgaaaatgccattttcagattgtatggccagtgttgggcagttcccactaatagcttctaaaggtggagagggatgatggtcctaacttaagcaattgacagattgttacctccaggaagaagaaagtggcctaagttttttaggatagcacaacatggaaagtgggtcaaatgactttccccatgttttgatttgggctcttcttcaagttctgcttacaaactttgctcttggaagtttttgctgcataatgcagtggataacaggtgtgggaaaaaaggctgattgttttaattcatttccacaaatagttattgggagcttactgtgtgtgtttctagaatgttactattctagaaacatctcgtccagtgtagactgatgattgcaatcatatcacagcagttccttaggggagactgggattatttacaaggctgatgaatcagtatatttcattatctatgtttcaggggaggaagggaaggtttgataatatttatcttaaagcacagtgcgtgataatgggaaggttttttttgttttgttttgttttttttttgagttttgctcttgttgcccaggctggagtgcaatggcacaatctcagctcactgcaacctctgcctcctggattcaagtgattctcctgcctcagcctgccaagtagctgggattacaggcgtgtgccaccacacctggctagttttgtatttttagtagaggtgggtttcgccatgttggttaggctgctctcgaactcctgacctcaagtgatccactcaccttggcctcccaaagtgccaggattacaggcgtgagccactgcacccagccagtattttgttatggtatgtaacactatactatgaatccaataagggattcttcagcacctactatgtgccatctcatacatgcatgactgtaaggagcataaagagcaaaatccattggtgctaaacacgccagaaactttaatccacaagtgccacgggatgtcttagggaaaaggccaaaaccagctgagtggaaaaaagaaatcatccctgcattggttactgttgaaaaaggttatgtacaaagatggctagaaaataagggagatcaacattcaaggccagggaaattatatgtgcaaagaagatacaacgtgtgaatatttcccactaatttgcctgtaatgtatttggaataaaaagatacatttggcaagtagcaagaagtgaggtagaaccaagtagagagtagatgatgggggccttgaatctggaaaacatttgatcttgattttatatggtcagttatggaaagctattcttggtcatgtgatttaaagtggtgttggaggaagattgtgaatcaacaaattcacagtgtacctaccatgtctaaggcactgtctgtagacctttgccattcttcacctttgtgggatatgagtagtgtattagtatctctcttcccttcttcccacctcctagggcttaacacatagcagatgctcaataacagctattttgggatgagtgagaatttgtttttcacctacctctttgatttcatcctggacccaccctcccaccttgacgtgtaggttcacctctccatggtttggttcattgtgcaaggtctgtaatgcaccttcccagtggagcttcttttcaagactgaattcaagtggttcttgctctatgaatcatttccatattgccttccaccagaccccataagcattcctgtctaacccccagtgacatgttcacgtgcttgtctctgcctttgagtgcgaccttcctggagagtggggactttgtgttatttccagcagctggtctagcatctggtatatataccaggagctcagtgaatgctttggaaatgtatgaattccatggagttacaggccctgcacatggtgaggataaaacatatgggaaatactgagaaaggaatcatgggggattaccacatagaatgaggtgatttcattgattgttggggacagtcgtgaaggagagagcccagactggcagtgtttgaatcctatctccgtcactcagtgtgtaacttctctgagccccagtttctccatctgtaaaatggagacagtaacaacctatctcaaaaggttattttgtggattaaataaattaatacataaagtgtgtctggccaattagtaatcacatacacatttgctttaaaaaaggaggaaaggccggggcgcggtggctaacgcctgtaatcccaccactttgggaggccgaggcaggtggatcacctgaggtcaggagtttgacaggaggtggaggttgcagtgagccaggattgcaccactgcactccagcctgggcaacagagtgagactccgtctcaaaaaaataaaataaaataaaaaaattaaaaaggaggaaatagagaagaatggaaggaagaaagaagaaagaaaaatagtcagtcatggccgggtgctgtggctcccacctgtaattccagcactttgggaggctgaggtggacagatcacaacatcaagagatcgagaccatcctggccaacgtggtgaaaccctgtctctactaaaaaaaatacaaaaatcatctgggtgtggtggcacgcacctgtagtcccagctactcgggaggctgaggcaggagaatcgcttgaacctgggaggcagaggttgcagtaagccgagattgcgtcactgcactccagcctggtgacagaggggaattccgtctcaaaaaaaaaaaaaaaaaaaaaaaaagaaagaaaaagagttaatcacaagttgtaagcccaagagtctggttgtcaggggttgtgtaggaagttttgtgtgcttaagtggaggagggatgtcttggttcacacttctgctcataagcctccctggaccagcatggaaatctcctctcatctctttggttgttgagctcctcatttctatgagtgtactttgtcctgtgtctcttcagtttccaggtggtcagttccagtgaggcgagtctctggcttgtccatgtgtaagactcatttccttttctttctcagcctcctgagtagctgggattacaggtgcccaccaccacgcctggctaattttttgtatttttagtagagacggggtttcactatgttggccaggctggtcctgaactcctgacctcgtgatccgcccaccttggcctcccaaagtgctgtgattacaggcgggagccactgcacctggccaactgatttccttttctaagaccaccttcctcttgtgatcatttgtctgggctctctctcaaccttcatcttctgcttcagacttcatcctttcctctgaatgcctgcattacgtagagtctgtgtcatgccgcacagcggttctagtctgtcctcatagtttgccctcttgtgctaattctgcccccctccccacctgcattgtaagtggagctgtttatgccttgccttagcttgggtcaactgaaaacggggaggcttagacaaggcagtttattttggaaagttatcccagggaacagaagtggaattatgagcaagagaatagtgacaaagagaaagaaggaaagccagtccaagagtgagttatggagctggcttccacagtgggcagctagagctaaacctcactggggactccttgggtaactgcagaatgtgcctcagaattgtccacttgagatggagctggggagagtactgtatttatccactggctcccatcccccattggtcaaggtttgttctaggggtggaaaagccctcgctcttccaagtctgtatttataggcactaagcctgcaaatgggaagtattttgacaagctgagcaggaccagcagcagctgagaagcaagaggtcctcagtgcagctgaggctaagactgttgggccacacctgctgtgacaatcagctgcatacagtggctgaaccaaaaaggtggccggaggggatatgatactcagcataaatggttgccccttactcccacctcttcttcccttctcgcattgggactgttttttaagaaggagcttttttcccatttttgaaagctctgagatggctcggtgatattgagatgtcactgttggttctttgtcttcctgggagtctttggaaactctgatggacaggggccatcaggtgggagtggctggtttagatatccaccaggaaagactttgagatctccatctacttgtgggaacacttcatgttaggggctcagtgaatcctctgtctttctgtcctttcttccacaagtatttagtggtgtgcctggtattctctcaggcattgccagtaataataatgacatctcacatgtatatagagcagttttcaaagtgtgctccctgaaccagcagcactagcatgtcttgggaactgctaattctgtttcagaagatctgggggtgggggtgtagcagtctgtgtgttaataagctctttgcatgattctgagacatgccaaagtttgagaccgagtgatagggcacttactaggtgccatgcatcattccaagccttctaattattgcatatattattatacctacatgaactcatttaatcatcacaacaaccctatgttatatactattaccattttgcagatcaggaaactcaagtacaaagatcacccagagagtaagtaggagagctgggatgtgaatctgaattgtctgactctagaatctgtttttaaaaaaccattttggctgggcgcggtggctcacacctgtaatcccagcactttgggaggctgaggtgggtggatcaccttatgaggtcaggagttcgagaccagcctggccaacatggtgaaaccccgtctctactaaaaatacaaaaattagccgggctgggtagcgggcgcctgtagtcccagctactcaggaggctgaggcagggagaatcgcttgaacctgggaggcagaggttgcagtgagccaagatcccgctattccactccagcctgggcgacagagcgagactctgtctcaaaaaacaaacaaacaaaacattttaactcgatttaattgtacaattcagtggcattaaattacattcgcatggaaacattttaactcgttttaattgtacaattcagtggcattaaattacattcgcattgttgtgtaactatcactatgcattgttgtgtgaatatcactactgtcgatctccagtttttcatccttccaaactgaaactctgtatccatttgacaataaacccccacttctcccttctcctagccccttgtaatgtccattcaactttctgtctctatgaatttgcttattctaggcactttatataagtggaatcacacagtatttgtcctttcgtgtctggcttatttcatttagcataatgttatcaaggttcagtgttgtagcatgcatcagaatttccttccttcttaaggctgaataatattccatcatatatatgtacatgtattacattttatttgtccattcacctgttaatggacatcgggttgtttctaccttttgactgttgtgaataaagctgcttcagttgttggtgtacaagtatttgtttgagtccctgtagattctctgcattttaccattgtactatgcacgttgccttgcaggcaatgagacttcccatcataatgtttacttgtagggagaaaaaaaagttaatttaggatctctgtggaaaactcttcctcctgatggataaactgatacaaggtagtaaagcaaaatttcagagcagacagacttttttccactttgaagatataaacttaaagtaaatcttattagtttcacatgtcaaaagcttccttccaaaagcaactagctgaaaagttgttctcgagcagtgattctcaagctttttgacctctttatactctttaactatttttgagaaccgcaaaaagcttttgtgtgatttctgttgctatttaccatattagaagttaaaactgagaaaaatttaaaacaatttgaacaattacattctattggcttttgaaatgatgtcattgcatgtcacgtagccttgggaaaatgccactgtgtgctatgagagaatgagagagagaaaggcaagtaacttcatgttatgaaaatagttttgacctcccaaattacttaaagactctggggtgtcagagggttaccaggccttactttggaaaccaaagttctagagtttaggcaagaagatataaccacttattccagtcacttacctcacctgaaatgtagcctatgggttcacattaaattattatcttaattttagctcaaccatagatgtcatatgttgcatgcacattctttttgaagcaaattaaaatttagagagtttgattgacactttttgaaaaaattagagctacttgagctgggaatttactatttcatagataggatttttttttttttattctctgaactgtgagtttcattgtagggtgacctggctgggctgtttctttggggaagcttaaatgttagtgtgatttttttttcttcctttggctaccaggtaggagactattctaatctcttgcctggaaaatacaggcctgtctaccagtatttagggaactgagtgggagtggagggtgaaggtggtctcagcatctgggtattcgataccagctggatattgcctgtaggttctcagctgtgtccctgctttgctaagcttctcccatcattgcaggggctggctcctggacattgcatttcccagagtcccttggtggcaagattctgatactgatttttccagtaagagatttagaaggcaaaagagaaggagaagccactttgctattgcaactgtggcacctggtcgatgtgaggttttcctagcagcatctgagtgtccttctgggacacagttacctcagtggtggggattctgacgtcatctgtgcagtttcttgtgacgcttgtacatcctgagttcctgaacataggcagtgatttctctgactgtggctctcatgccctttccatgattttttaagcttttaatttcctgtatcaaatctcttcctgcctgtaatacctgaatagcatctattttctgaccaaatctggactgatacacatacattctcttagtccccatgttcgtgatggtgcctctattcttaactaagctcattcttccccagcgctgaaacctttgtttttgtctgctttagagaatcactctctagttctttgccaggagagggaggggcctcttggagtggaggtgaggtttggggctctgacggctacatagaaaacctttctctttattttagctcctacttcaccccatcttccagagttatcttgaattgccagttctggagtcttttgggcattctggggtgaagatcaggttggatcttggctttccctgctgctggcctaggattcagctctgttgccatcttagtcttttagcattcatttacctgccgtccagctttccagactttagtgctatagcttatgtcttgaaaaaatccctttgctgtcctttgattggggtttcagaaaggagtgaaatggatgtctttgtgtcatttgccatgtgtaccctaaaatcctgcttttctaaaatcataatcaagaagtcacttgctgtcccttttggacagtagttcattacctttaaagttgtaccatttttagagctttggaatgtgagagatgatgctgatcctgtcagaaagactttttggaaaagttcatgttctctgctcattttggatctggacatctgtgcaactctgaattctctttttcctcccctgcattcctctccctatggactggagctcagttaaaggagcggccatccattttagtgccccagattgagaggtgtatggtatcatccattctacctccctctctctctttttattttttaagttgtgataaaatacatataacataaactttaccatcttaaccattttaaaatgtacagttcagtggcattggagtacattcacactgttttgcagttatcaccactgtctgtcttcagaattcttttcatcttgcaaaacagaaactctgtaccctttaaacaatgactccctgttctccccttttctcagcctctgacaaccaccattcaactttttgtctctaagatttggccactctaggtactttatacaagtggaatcatgcaatatttgtcctttttgactgattcatttcacttggcataatgtcctcaaggttaatccatgttgttgtgtcaattttcttcctttgtaaggcaggataatatcccattgtgtgtatataccgcatcttgtttatccagtcatctgtcagggacactgggttgcttccaccttttggctcctgtgaatagtgctgccatgaacatggctatctcactgtctcttttagcatcatatcccatcagtcaccaaattctggtatatcctcctctctcccttgcactgctaaggctcgggccctcatcctttctcacctggactgtggcagaagcttcctaacaaccaccttactttcccttccagtctgtcacactacactcttggatatttttaaaataggggtctgatcatctcatttgcccgccttgaaatcctcaatggtgccattcagacttttctaacatggcacatcacctcagtttaccttgttgatccagctttcctgcccctctgcttactttctgtctgtcccaaaagactttccattctctaggtgctccatgctcttgcccctccatgtgcttgctcatgctcttgcgttggcctggaatgcattctctcaccctcatcctcctggaaaagccctgttcgtcctttaaagccagctcagatgttctttgtgaggactcctcccatcctcagaagctgagttagatatctgttttcctttgccttcactttgtacatctctgtcatgggtgggatacagattgtggggatgtggaatagctgaggtcttggagaattaaaaggaaaagagtagagaactgaaaactacacaatttgtgaacctgtgccattaagcctgcatcttttctgattttctgggtgtgtttttttttttttggagtcttggtctgtcgctcaggctggagtgcagtggcatgatcttggctcactgcaacctctgcctcctgggttcaagctgggattacaggtgtgtaccaccatgcccggatattttttttgtatttttactagggatggggtttcaccatgttggtcaggctggtctcaaactcctgacctcaaatgatccacctgccttggcttcccaaagtgctgggattacaggcatgagccaccgcacccagccgccaatatgatattttcatgttatcttattatctgaaacatcataggtttgacccttgaaaagccagggaaaagtgtctcgagtacttgctgaatgttttatatgttgtgattctagggtgcttggtaaaagatcccacattgggcccctcagggagatgacaagaggactgggatctatggttgcagatcaggcctctgtctggtctgttcagtattgtggtgatcagttaggactccccttgttcccaggcacagggaagatgtgaacaggaacacctatttttagggctagaacaacaggacaatgtaacaatgacaagaatttaatgaatctgaatatgcctctggacagagatgttgcttgaggtgcaagatagtatgtgcctcatgtggtaagattaaaaaggaaagatggtgcgtggtggctcacacctgtaatcccagcactttgggaggctgaggtgggcggatcacctgaggtcaggagttcaagatcagcctggccaacatggtgaaactccgtctctactaaaaatacaaaacttagcctggcatggtggcaggtgcctgtaatcccagctactcaggaggctgaggcaggagaatcgcttaaacccaggaggcggaggtgcagtgagccaagatcgcgccattgcactccagcctgggacaacagagtgagaccttgtctcaaaagaaaaaaaaaagattaaaaaggaaacattctgctttgtgttagttaacaagtgttaatactgacttatggcttcctgtgcactctgcactgcagttggtattataggggtagagagggtgtaagtgggagggaaacagaggaccatggcaggatctctatcgtagtggagtgtgtatgctaatttcaagtgtctattatggaaagtctggcatgaggacataaccgcttgagctaactccaatccgtcaagtgtctattatgagtcaaacactatgccaggcacttttatgtacgtcatctcatttaattatgatagtaattggcttacatgttatagttacgattttgcccctgttttacggatgaggaaatggagagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgatctcggctcactgccacctccgcctcctcgattccagtgattcttgtgcctcagtctcctgagtagctgggaccacaggcatgcaccaccatgcccagctaatttttgtatttttagtagaggcagggtttctccatgttggccagggcattcttgaactcctgacctcaagtgatctgcctgccttggcttctcaaagtgctgggattacaggcatgagccactgcacccagctggatatttaaactttaaacagtgtggtgcttaaaatttgtgagaggagattttagacctgggaataatcaacaaaatctagtagagttactggcgtggacaactggatggaatccgaagagacagtgctttggaggggtaggggtggacaaaggtatggagttgggaccaacttggcttgtatgtgagatagtaaattgtcttatggaagagaagattcctggggagactggaaagcaaggttgaatcctctgtgggatgtgaaagaggttggtcttgataaggttagacctgagggaccagccacttatgagcaagggaacagcatgaggatggtggtcattccggaagtggaatgaggaataggtgggagtggctacaggaagcagggttgaaagtaattcacatattgtatcatttgtgtaaagctgctgagttgctcttttggaggtgccatttggggcaggttctgccattgagtgtccagcctgttctttggaagaagcctcagttagtgtgaattctctttctaggtccccagtttcattgctggacaaaagctgattagggcgagtaggctgtgagagcctctaagtcttgcagctccttcaccagtgtctcggagcccagcactttgggtcttgccactgtttttgtcagggagctgtcaatctggagtggccacttcccagggactccagctgtccttttgcatttggggagtggagctggcaaagcctgctgaaacctctctcctgccccgcaggaaagcttggcagggtgcctggcacaggctgcttacttgagtggggctgctgtcctttgcctgtccctcctgctttccttgaatgaaagtcttgaaaaaaagagaaactgctcttttccccaagcccccacgagagcatgtgcttgccgacagccgcccacctggctcctgtcaccaaaacgacatctgcttctcagtagcaccaggcagcccgcagggggctagactggcctgggctcaaatccacctccacttactacttagtagccatgtgacttcagcaaatgctttaatgtcactgaattcctgtgagccttggtttccccctctgtagtagtgccttaccttgcagggttgttgtaatcacagctgcccattcaacatatcttattgctgtcctctctggaactctcctctccctagctctcacttttaagctagtggatctgtagcagaggtacttgcccttttatcagtggtttagtgagcggttcccttcgagaagaagatgaaatggcatttacggagtcttggggttgccgaagagagacatcttttactcggtaattctgcataaggctctccccaacagtgaaagcttttgctggcctctttgatgggaactctgttctgggccattattcatactcaaattcagatcagagggatgggcttttatgggttagcctggaaattcaatcttcatgtttatcagggggatttcatcctgaagaaaatcatcacttttaaaaaataaaataaaaataagaaatgactctaaaaggtgtactgttgacaaggtggtttcacattttctttttgtatgtgtaagccgggaactgctgcaggtgctcagttgagtgtgttcgtatgccgatggtttccatgttccccatttgtcctgaaactgttgtagtagctggacctcgtgccctgcccctggccttccccagctgcagtgggggacagcatcctcattgctcaaaatacccagaagaatgattcttttttttgagacagagtttcgctcttcttgcccagtctggagtgcaatggagcaatctcggctcgccgcaacctctgtctcctgggttcaagtgattcttctgtctcagcctcctgagtagctgggattaacaggcatgcgtcaccacacctggctaatttttatatttttagtagagacggggtttctccatattggtaaggctggtctcgaattcctgacctcaggtgatctggccgctttggcctgccgaagtgctgggattacaggtgtgagccaccgtgcccggctgattcggttttatacttaccaaaaaagttaataaatgatgcctcagtagaacagtaagtttatagtgtagtcaaaacttagttgttcagcctctgcctttagctgtgcaggaccaggctgtacagctctaatgcgtaggagtcctctgcagaaagggagacacccaaagtcagagcaagctggaggaatcattactgcattaacatttcaacatttatttatttatattttttttagagatggggtctcgctatgctgcccaggctggcatcgacctcctgggctcaagtggtcctcccgcctcagccttttgagtagctgggactacaggtgtgcaccaccatgcctgctgctggattaatatttctggttttttcttaacatttcatggccacagatgttttatcagtgtttagcagtaaggcctatactctcctgggattacatgcgtttgttctttcctacttagtttatgtgaacacatttacttcaatggatctgctgttgaaaccaagattttggattttgcaactattgtatgctggtaattctgttttactggtgacctgtttggttattccctgctatccagtctattttctttctttctctgtttatttgttttttgagacaaggtctcactctgttgtccaggctagagtgcagtggtgtgatcttggctcactgcaaccttgacctcctgggcttaagtaggtctcctgccttggcctcccaaagtgctgagattacaggcatgagccactgcgcccagtcctatcttctgatagtgctttttctccattatatttcccccttctgtgtgcttgctgcccttgatctggaatcttgttttactttcttattgttcacctgcttcttatctatgggtgattaatttgctcatttgcttcttatttatgggtgcttaatttttgcattttaaaactcttgtctggtttgctctagaagcgagaatatactggagatctgtgctctggttattggaacactcatgtctttcattcggacatggaagtacctgagaggttgaattaataggtaggtggtggcttgatgaaagcaaaagttgggcagagacaggagggtgctcttatggactcagtaatgaatcagaaccattaggagttgtcctcacttccacccttttccacatgcctctacatctaatccacctcctgggctagtgcgctctatcctaaaattatatcctggctgggcgcggtggctcacgcctctaatcccagcactttgggaggccaaggcaagcagatcacctgaggtcaggagtttgagaccagcctagccaacatggtgaaactccatctctactaaaaatacaaaaattagccagcatggcggcacacgcctgtggtcccagctacttgggatgctgaggcacgagaatctcttgaactcgggaggcagaggtgcagtgagctgagattgcgccactggactccagcctgggcaaaagagcaagactccgtctcaaaaaaaaaaaattaaataaataaataaaaaaaataatatcctgacactgcccgtttccctgtctctgctgtcagcccccttccctcctcctcctgccatcttccccaggctaagccaccatctggccttgtttagacagaggctgtctaaaagaactttctgagatgatggaattgttttgtgtctcagctgtccagtaaggtagccactagccatctttggctgttgagcacttgaaatgtggccagtgcggtagaggaactgaatttttaatttaacttaatttaaatttaaatatgcacatgtggctggtggctaccatattagacagtgtgggtctagactatagcctctcaaatgtatattttcttgacccccccctccataattcttccacagtagccagagtgatctttgaaaaatgtagatgagatcatggcacttctcactttagaagcctccagtggctttgcttctgcccagtgtgcacccagctctcccctggcgtgccaggcttccttgagctgacctttgcagccctctcctcctgtactgtcgccacctttttctcatgcttctccaggaccctgctggcttcctaccctcaaagcagtagccaagccttttctggagttgggacctttgcacatgcttttgcatctggagagggtactcttccttctttgcttgcctgactgctcatcatctttgaagtctcagcctcctagagacaaccctgtcccccatctgtataaagaccccaatcctcaggctcctcttatcactgctggaaattatcttcgatgtctctttcttgcgtgttgcctgtctctctttactaggacttaaatgtcattagggcaccacccttgctgggtctctgatgtcttgcattgagggactgaacacattccttctgccgctcacccccatggccttcttttgcctctagagaagacatcacggcctcactctcacggcttcttttccattctccacattgagcatccccttttgtaaacatgagtgggagccaactagagtacagtgttcccgattagtttcatttttcccagttgtaatcacagtctcatttgcctccctgaggttacacgccgtatcacctctattttacttgttcctgaatttcctcagctataaatctcaagatattctcttattaatatcaaattattggccgggcgcagtggctcatgcctgtaatccagcaatttttttatttttttattttttttgagacagattctcgctctgtcacctaggctggagtgcagtggcatgatctccgctcactgcaacctctgcctcctgggttctagcgattcttctgcctcagcctcccgagtagctgggattacaggtgtgtgccaccatgcctggctaatttttgtatttttggtagagacggggttttaccatgttggccaagctggctcgaactcctgacctcaggtgatccgtctgtctcggcctcacaaagtgctgggattacaggtgtgaaccaccatgtccggccaatcccagcactttcggaggccaagatgggtggatcacttgagatctggagttcgagaccagtctggacaacatgtcgaaaccccgtctctactaaaaatacaaaaattaaccaggtgtggtggtgggcaccagtaatcccagctacttgggaggctgaggcaggagaaacccttgaacccgggaggcagagatggctccactgcatttctgggcaacagagtgagactctctcaaagataaaaaattaaaatctcaagttattgccaccatgcgtttactttgagtagtgggaatatacagcccccataaagctgtgtggttgggaagccaggtttgaaaaaagggagcatatctaaatacattcagttaaaaaacttttatttatattttaattaaaaaatgaatctatgttcctgaagagaaatttaaaaataccagaagaaaacaggaagaaaaaaaattcccacattgtctccccatgctgagataacaacatacgccaggaagagtgtgcatgtcatgtatattataacatcatacacagtgttttgttacctgctttcttagcccaaaaatactatgtacttatttttctatcagtaaatactcatccacaagtcaattttaaatagctgaagagtgttacatttcatggaggtaccataaattatttggcaaatctgttcttggccatttgggttacttctttttataattacaagcagctcatttggttaatttttttttcctgtccgctcttttttgagtcgatgttctagaaaatacggtgttctggtcttcttggccttccttttccaagggtgtgtgagtcaccgtcttcccgcggtgttagtatgtgatttgtcctggcgtggatttgttgtgactccatctacctacatcatgtttctctttgcagcaatgaccgcttgttttccacaggagacactgttctgtagttataaaaacaagtgttacgcagcgactgtttcctgagcgcgttgctcacataagctcatgctcccttcctgtcttccagtgggaaggctggttgccaagaaaacatcatcataaacaaagttctctgaacacctaccgattgacaaagtagtgtatttttatttaaaatgactattcacttgctactctgaaacatgttgcaatcttgacctttatatttgccaccgttttaacattcttttaaacggcaggcaatataaaatcagtgactttgtctttgatgttatttctgaatagtacatagagggatacaatacaaagtagcaaatgaatggctaagtatatactgtatgtatattgaaatgcattgaagacaggattttaacaatacatggggcttctaatgctgctcctttctttttctttttttttctttttttttttttgagacagtgtgtcgctctgttgccagtctggagtgcaatggcgcgatcttggctcactgcaatctctgcctgccgggttcaagcaattcccctgcctcagcctactgaatagctgggactacaggtgtgtaccaccatgcgcggctaatttttttgttagctgggactacaggtgtgtaccactattcccggctaatttcttggtattttagtagagatggggtttcaccatgttggccaggatgggcttgatctcctgacctgcctcccaaagtgatgggattacaggcgtgagcctctgaacccggccagtgctgctcctttcttaccgtttgattatggggctggagaagttgtcaagggaaatcattatagagccctgtgcagtatttcttgactttcttctgattttggatgtcaaagtcttgcatcttggtcaaatttctggttagtgcatcataaaaatgatcattagaatcctatttagcttaggattgtgcacagaactgcacattggtcattctgggctgggtgtcctctgagcaccggaggcaggtaggatccaaggtgggacggtggtgcagagaaggcagccactttcctgaagaaccatgtgagactggcttggttacagcaggtgggagagctggggcagtagggttcaagtgtccaggctgctaagagtgacttcagccaaacaaacctgaaaagctagaatttctgctggtgcctcaggctgtttttctatgcgtggccatgagttttattttgagaattcccattgtttagtcgtgccagagactttaagtggaagctgtattatgatgcattttaaattcagatcagaagggcactgaggaatagtttgagagagagagacccaataacaaatagtggagacaaaaactatcattcatcctacaaaagtttgttcaatcctgccctgtagcaggtactgtttttgggattcagtggtgaatatgacacagttttcctgcccccctgccctgtaccaggtactatttttaggattcagcaataaatgatacaattttcctgccttcaaggagcaaatgtgtatttcagcttctaaaggtactggcggcaaactcaaggaagcctgggtttctcatagcgatagatttcaatgagcatgacactgattgtgaaatgaaagcagatttagggtcaaggactgtcagaagaggggctgagcagggagatgtgggagtagttcctgggcagagactggcagagtgtggcgtttgggaagcgcctgcagtgaggaggcattgatggggctgctgtgaaggctgcaggcctgaccttgtgtcctgaaagtcttttagataatgctttcctggcgggtgagacactcttagacttgggccgagttcacctagccctagacaagtgctacctaaagtgtgtcagctgactgggctgagagatgagtacaacactaagagtagtgtttcgagatttctttctttcgtttttttcttgagacggagtttcgctcttgttgcccaggctggagtgcaatggcgcgatcttggctcaccgcaacctccgcctttcgggttcaaacgattctcctgcctcagccttcctgagtagctgggattacaggcatgtgccactacgcccggctaattttgtatttttagtagaggcggggtttctccatgttggccaggctggtctcgaactcctgacctcaggtgattcacccgcctcagcctcccaaagtgttgggattacaggtgtgagccactgcgcccggcctgttttgagatttgtatagcaacttgacattgcagccacagccaagtgtgtgaccagtggatctgtttgcccaggacatagaccagtttgggttttgtggaacttaaggtgtgtggtgagtaagaccatatctggctggagctttgaactagtcatgtgcagtgggaacatgtgtctttccttaacaaatgaaaacaacacaaaacaaaaaacaaaaacaacctcatccatcgtgacaatagttggagaagcaccactgtagaccaagcaagactcattacacacaattcataactttgtctttttaaataatgttgcagtattttcttgtgcttatatgtcacagtttcttaactcctctatttggggccattgctacattattttattatagatactgcatgtgtgaatatttttgcacaaattagtttttttttttaattcttctctcgggcctgtacccagaggggaaatactgtgccaaagggtcactgtttttttgctctctagaaaggctgagccgatttatattgtaggagaggatatacgggttttctctgtggcttcaggctgtgcaattttaacagtttttgctggtttatgaggcatgtacctgtgccttgagattgttttaatatgcctacttaagggggttgtgaggatgtgatggtttgattttaatattttctcacattggaaactaaatggttttttaaaaaattctttcctagcactttgggaagccgaggcaggtggatcgatcacaaggtcaggagattgagaccatcctggctaacacggtgaaaccctgtctctactaaaaatacaaaaaattagccaggcatggtggcgggcgcctgtagtcccagctactcgggaggctgaggcaggagaatggtgtgaacccgggaggtggagtttgcagtgagcagagatcacgccactgtactccagcctgggcgacagagtgacactccatctcaaaaaaaaaaaaaaatttcttaagttgaacttgaatgttgacattcccttttaaaagtgggctgaatatatgagtctgctctttttagttttgtaattgcttatttcttggatctatttggactttattaccatgtttcgtataagttgtagatctaggttaattttcttctatactgatgttaattttcctagtaacttttattggtgattcttttctgcatttttgtatctcctgtgatttgacatatattaaatagttatcttagaatgaatatatttgtggggcctccattcttatgctaccattaatattttaaaaaaatttacccaatgctatatgagttttatctgtaacctattttattattattattattattattattattgagatggagtctcgctctgttgcccaagctggagtgcagtggcatgatctcagctcactgcaacccctgcctcccgggttcaaggaattctcctgcctcagcctcctgagtagctgggactagaagcgtgtgccgccacgcctggctaatttttgtgtttttagtagcaatgaggtttcaccatgttgtccaggctggtctggaactcctggcctcaagtgatctgcccatcttggcctcccaaagtgctgggattacaggcttgagccactgtgcccagcctgtaatctattttaatttaatagagctgtctaccaccattactttaaaaaaagttttattttgtatcctgcctgatatggtttggctgtgtccccacccaaatcttatctttgaattgtagttcccataatccccacatgtcgtaggagggacctggtgggagataattgaatcatggggttggtaacccccatcctgttctcgtgatagtgagtgaattttcatgagatctgatggttttataaggagcttttccccctttgctcagcacttctccttccagccgccctgtgaagaaggtgcctttctttcccttcaccttccgccatgattttgtttcctgaggccttcccagccatgcggaactgtgagtcagttaaacctctttcctttataaattacccagtctcgggtgtttcattatagtagtgtgagaatggactcatacactgtcctttgattcttccagttgcatttcactgtcatcttgaacctggcctgattgcttggctgcccttttgtccacatggaggcatgcgctttaccatgctttcttgggtggtgatcttagtgagaagatggctggttaatgagaggatgaggttgagggtttgaaactgtgagtcaagaagcttagcttgattgtgggctgtataccattctctgtgctttggtcacaaggaaattgggagacagttatccacatagactttttatcaggattgaaagaagctgttgggagcagaggccatcgggtgctgactctgtatgtgaaagacagtgtatgataggaccaatatttaggtattaatagggcaagagagaagaaagcatggattattagactggggtgtttgtttgttctatatgtgacaggtttgaaagggttttctgtgttaatgttccctgaattttaagaactactggtgaatgtattgggcagtgcctccctgtcagcactggccatgtaaaggggcacacactacctctgtggccagccttggtgtccagtggaacatgcctgttgatgttttttttcctcgctctattgcgcaggctggcgtgcagtggcatgatctcggctcactgcaatctctgcctcctgggttcaagcgattctcctgcctcagcctcccaagtagctggattacaggcacctgccaccatgcctagctaagttttgtatttttagtagagactggattttaccacgttggtcaggctggtctcgaactcctgacctcaaatgatccacctgcctcggcctcccaaagtgctggaattacaggcgtgagccactgtgcccggccacctgttgatgttataatgaaatccttccttatgtggccattcctctatgagtgtcaaataatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgcttgaacccaggaggtggaggttgcgttgagccaagatcgcgccattgcattccagcctgggcaacaagaacaaaattcaatgagaaaataaaataaaataaaataaaataaatttccatcagattccctaataagtaaaaaactcttgacaatgaaattagcaaagactatgattacttaagaaactatagactcttggatatagagtatttctatatttttctttagaaaaatactgtccttgaacatttttgttcttctgattgctaatttcttggttcttctactagttgcctagtgtttttttctgacagattaatatttgttactcccagcctatgtggctgtcagactcacttattcttcctcctgcttgttttccccaattataaaatgattcagataatgagataataataattagcccataatgtataataaacaacatttatgtattgccatatagcacagaaagcactttgatatatttcaccccctttaaatttcatgcaactctgtgtcgtgggaattattgctacggccatgtttatagaggagaacactggagctcagagccctatatggcagcctgccttaggccagagagctagctggtgacagagcatgacctctattacagatcccatattttccccagtaaatcttctggttcaaattcattgactgaattacattttattagaagagaatggaactttttaaaaaaatcacaatggatttaatgaataattgactattatagtgatgcagtatgtttttcttaggaggtctatctatccaaagaacatgtttatttagaaaactcttgaaaatacttacctaatctgttgattaaatgcatgtaatgtgttgtctctagttgaaggacttttctaattttatttaaatgatttcaggtaaaggcagaaaagttatccacaagcacaagctatattataattataagcttttttggatgctattttttttttttgagacagggtctctttctgtcacccaggctggatggcacaatcatggctcactgcaaccttgacctccctgggctaaagtgaccctcccacctcagcctcctaagtagctgggacaaaaggctggctaatttttgtattattatttttttgtagagacagggtttctccatgttgcccagactggtcttgaactcctgggctcaaacaatctgcctgcctcagcctcccaaaatgctgggattggatgctgttttgaagtcaagctttaaaaatttcatttgcaagtgtttgttgctaatgtctgaaattgcagttgactctggtctattaacttgtatcctgtgatcttgctaaattcacttattgctcttactagttgttattttcactagtgtgtgtagattccttagaattttcaatatggcctgtattgtcattaggaaatagagaccactttacttctttctttgtgatctttataccttttatttatttatttatttagtttgcttattgcaatgtatatgctacagtaggaggcacatacttgagttaatgctgttaaatgttcacattgtgagaggactgtttatatcctcacttagaaattccagatacaatgttagagaatttgattattagaaaattgtttaagttaacaatctttattggagttttaaacaattattggaattttaaacaattttttggaatttaaaaaattttattggaatttaaacaaattttaaacaaataaattttaaacaaacaaattttaaacaatttttattggaatttaaacaaattttaaacaaaattattggaattttaaacaatttttaaatatatttgtaataaacatcaatgtttgttttgatattgtactttgtgctctactgaaatgcactgtaaggaattttgtaaggtatttattggcaattttgacaggcattcaaaagttagttttacattattttattattattatttttattatttggacaggtgagactaaccatagcttaagaaaatccacttcctttgaggaaaggttggctaattttgtagcctaagtttacagaaaagcatgttaagcaaagtgagagaaaacaagagatgaaattaagatagaaaatcaagtatctaaaattcagacatatccttgactgttcattgtagcagtatgtctttaactaaataatattatgtgctttgaaatgtggcatagagggataaaaggagaaatagattcaactctaacacttccatgctgtgtgaacttgggtaagtgacctatccttagtttttttttttttttttttttttttgatactgttaagtagaaataacaataagcaacttgcagtggttagcattagaaataatatacatatacataagatgggcatggtggctcacacctgtaatcccaacactttaggaggcttaagtgggcggattgcttgagcccaggagtttgagaccagcctaggcaacatggcaaaaccctatctctacaagaaatgcaaaaattagctgggtatggtggcacgtgcctatagtcccagctacttgggaagctgaagtgggaggatcttgggcccaggagactgaggctgcagtgagccgggatcctgccattacactccagcctggggaacagagtgagacgctgttgaaaacaacaacaacaacaacaacaacaacaaaaagaaagagagagagagagaaagagaacaatatacatgaagcatatcagacatgcaataacgtgcattataagatttcatcctttattatgtacttattgttattgcagattgagtatcccttatctgaaatgcttggcactagaagtgtttcagatttttaaattttttggatcttggaatatttgcattatatttactagttcagcatccctaatctgaaaatcggaaatccagaatgctccaaaatctgaaactttttgaacagcaacatgatgctttaacaaaaatgctcattgaagcatttcagacttttggattagagatattcaagctgtatttattacatttttttttcccccaagacagagtcttgctttgtcacccaggctggagtgcagtggcacttagctcactgcaacctccacctcccaggttcaagcgattctcctgcctcagcctaccgagtagctgggattacaggcacgcaccaccacgcccggctaatttttgtattcttagtagagacggggtttcaccatgttggccaggctgttcttgaactcttgacctcgtgatccgcctgtctcagcctcccaaagtgctgggattacaggcatgagtcaccgtgcccggcgctacattgttatagtttattcatgaatactgtcaaatatcatgtgtcaccaaaagaagggaataatatctttgaagaaccctttcctgctaaaaggacctaaaactttgcattcctcaccaatgaatgaggaagaacgataataaaatatcacagtgaaaattttgccaactttcttctatctttctcttcctttgctctattgtcagacaagcatgtttatttcctagagcctctgaggtgagaacctcactgtgaacgtagccagcatttgggaaacgattgctcggctgtccataggagcacttggagccagggctggggtgaagccaccgctgtgggtgtctgtggagctgccgaatagtcattgatgatgactacagtgttgtgaccaagcgagttacagagaaacgccacactttgagacaaattaaagagtcctttattagctggcgaccgagaggcagctaacgctaaaaattctctcggcccctgaggaaggggctagttttgtttctatactgtggtctaaataggcgaggggggattttagctgaagcaatttttacagaagcagaactggcaaaaagttaaaaaagtaattggttacaaatgtagttacaaaaaataaacagttccaggtgcaggggcttaaactatcacaaagagataaatgcaggggttttgggtgccatccaccgagcgcgtcctcaggagctggcggtgcagcttgcctcaatatcttatcagtaggtacattcctggacgtgctttgagtcagtttacactagttacgccttaagggaggggggtgaaagggggctgcaagtgaagaaactaaaatggagtctgtccggctctctgtctgctaggacagagtcacttgggttaaaacaaggtagggtatcacagcaggagcctcggtggccctttgccaggcctcgtcttcagcgtttgccttccttccctttccctctttctacatctgactactgggctaggtgtcgtcggctaatgtactttttctctttcttctagaattctgaaggtggactctatgtatgcatgaatacatttttggcctttggaagggaacatgttgaaagacattttcgaaaaactggacagagtgtatacatgcacctgaaaagacatgtgcgagaggtgagagcggcactttcagagaactggccttgatgtcttccctgtaacgttgtctcagtgtgctttctcacgtggaaatttgaccatgcccacataacttccgattccctttgacgatgagaaacaaaaacagcactgcttgcaaaatccagagggtctcccaaaccttatcgtaaccagttttatttttcttcctctaaacttctgattggtgtttttaagaatacatagattgactaattggaaaaaaaaaaccgaaactaggtttaaaaatacagaaaagtacagagacacccatggatccaaaaatcataaaaaaaaaccatttgaatgttcctgcttcagatgtgttttgttttgttttttagtataagaaatagagcttccttaaaaattcaagttccttttgtccctctccctcgccagaagtaaccactgctttgaactttttctgtgtcatgcatgccattatattttattaacaaatgcatattcaagaacaatatatagtataactttatatgttttaaagatgtagataaatgctatcatacgcctaactataattctgtgaagagtttttcccctcggcatccaaatgtttcatttcttttggaatctgtccatgtcgagatacatctggatgtatttaattcatttcaatagtttggtttttcatcttatgagtaccttgtaatttattttcttctcgtattgatgaacatttagatcatttctattttttgctactgtaaagaatgcagcaattaacatttttatacacttcacctgggggtacatgtgccagagttcttcaggaaatagatctggaagtggtagtgcaggctcatgttatgcttatctttgtttttattagatagtgccaagtctctccccagagtgattgtacctatttacactctgatctgcaataattatgatttcttgctttcccacaccctcaccaacccttggtcagagttctgtttttgccaaatatttagatgaagtggcatctaaatatttggcacatctctttgtactttctattctggttttttttttttcttgttggatttgcctatttatatttttggcctatttctttatggatttatctttttcttataagtgtgatgagttatttttacattctggataccaaacctttgtttgttacatactagatttcctttgagtctgtgccttactaaatttcctttgagtctgtggcttgtcgttttactttgtttatgaattattttgtagaatagaagttgtaagttttgaattagttagatttattaaactttttgtcgtatgagttgtgctttttgtatcttgtctaagaaattgtttcctacctcaaggtcataaagacattttatactagtctgttttcagttgctgataaagacatacttaagattgggcaatttacaaaagaaagaggtttaacagacttacagttccatgtggctggggaggtgtcacaatcatggtagaaggcaaaaaggagcaagtcacatcttacgtggatggtagcaggcaaagagagagcttgtgcagggaaattcccatttttaaaaccatcagatctcatgagactcgttcactatcatgagaacagtgcaggaaagacccgcccccataattcaatcacctcccaccggattcctcccatgacatgggggaattgtgggagttataattccagaggagatttgagtggggacacagccaaactatatcacatttcttacagttgtttttaaatttttatttaagtgtgtgtgaacgtgactgttttaacattttaggtctttaatccatctataacttatttttgtatttgtatgaagaatgggaatctattttttcatattgataaccagttgtttcactattcatagagcagtacaacttttcccagtaatttatagtatcacccttttcgttttatttatttattttttgagacggagtctctctctgtcaccaggctggagtgcagtggcgcgatcttggctcactgcaacctcggcctcctgggttcaagtgattctcctgcctcagcctcctgagtagctgggactacaggtgcgcgccaccatgcccggctaacttttgtatttttagtagagacagggtttcaccatgttggccaggatggtctcgctatctcgacctcatgatccgcccccttcggcctcccaaagtgctgggattacaggtatgagccaccacgcctggcagtatcaccctttacacacacacacacacacacacacacacacacacacacacacacacacattttgtttgttttttgagacatggtctcactctgtcacccaggctggagtgcagtggcgccaccacggctcattgtagcctcaacctcctgggctcaagtgatcctcccacctcagccccccaagtagctgagaccacaggcatgggtcacaacatctggctaatttctgtattttttgtagagatggggttttgccatgtttcccaggtgaccatggtgctccgtcttgtgctcctgagcctaagcaatccactggcctcagcctcccaaagtgctgggattacagctgagagccactgtgcctggctaccctttttatattttaacttgctgttcacatttgggtctctcttcactctctcagttgtgttctgttgatcttatttgtctgtctctgcattggtatggcaagccttgatatcttttagtgcaagcactttttccatgtttatttatttttctttcttttttttttctgatgctgtggttgaagccatatttatttttttttccagaattttcctgggtatttctagccatttatttttctatatggattatggaattagttcatctagcttaaaaaatcctattgggattttgatgacaatcacattgaatttatagattaacctataatccacatccttgtgtaagctctatgagggcagggactttctttggttttgtccactgctgtgtccttagcacttaacagtgcctagcatatagtaggtgcttcataaatatttattaagtatttaacatatcgtacctcttttttcacatttcctttttgtcattcaataatttttgtaattttttataaaggaactcatattttgttagattttttttttagtaccctataatttttttttttaaccattactgccatcctttattttttacacattaactggttattgatggtatttggaaatattgttaattaataaatgttgattttatatttagcaatgctgttcaacttttactttagttataatagtttgtgcacgattttggatcttctcaatggtcaatgctgatttgaagtttctctaatttctcaccttagccttcctaatacagtctctgtttaagttcctaacaaagaagagggggagagcaggaggaagagaatgaagaaaggccagaaagtcagataaggcataaactcaatgatcaggttcaaaataattttgacttgctactgaatgatttccactcactaattctgttaggtggtacctaataattcttgtgaagtctgttttgtgacttaatataaagtgatgaaattttagaaaactaaaaaaaaaaaaaaaagaaagaaacagaggcccagagacttagtaacttgctcagggtcacaaagttagcagcagaactgtggaatgctggtaaacttgtacagttagctctgcctctggaattttgagttaaatgtttcactctctgaccaaaatttctactcatttttgctctttcactcatttattcctattttgatcatttgttgtaggtcctgaagaccttcaggcccgtgacttgtttagcttacttctcatgattcatttttttcaacattctgtaatccacagcaccctgaactgacttttattctcctgtcttgcctccttaactgtcctccagaactccaaacagttgctccattgatgtcactgtctacttccatgcacagactgctggaaaccccacactatgatgggtttgagcgtgtcacattttgggcctttcctcttccattgcgccctctccctgcccagcaaaccttctagtctgtatcctgtcccactcccgtgagtggccattctaacctttggatgctttccttaagccttttctatacattccttggtatcctcatcatactcataaaattatcttgacttgtactttgcaggaaaaaagggaatccctggacaggaactcacttaacttattccttgtgtcctggaagctcactcagtggctcacacctgtcatcccagtgctttgggaggccaaggtgggagcctggcttgaggacaggagtttgagaccaccctgggcaacatagtgagactccgtcttgacaaaaaataaaataattagcctggaatggtggcgcatgccttagtctcagctacttgggaggctgaggcgggaggaatacttgagcccaggaatttcaggttacagagtgagctattatcaggccactgtacacctgagcaacagagtgagactctgtctcttagaaaaacaaaaccaacgccacacaaccatctttctaatttgtgtccttcttcagtcattgcattcttttattaaaagcttctttaaaaacttttctgatctggtctgtactacatctgccactaagactcaacattgcagtctgatcttgttaatccactaacactgcccaggttgtcagtcacctcttaggtgtcacacttggtggatatgttttagctctaatgttacttgactttttgagtatttgcatgtttgagcttgttttcctttggaactgttcctctcctgttttctttgacaccattctttcttggcttccgcttatcctttctcagtttctttcaccaacatctcttcctttgtttacctcttagttatcggcatttcctaggatgccatttggccatcctgtcttcttcctcagaaggatacttttcttcatcagggttatccatatttttgtttaaccactttctctaagctgatgacattcaaattaatatctctctggaggtgaagatctgatcatcttattctgatctggatttttctactccagcatttcataggtacttcaaggttggtgtgcccagactgaacacagtattctcttgctaaaaaatttccttcctcttcaattctggagacctagatattctttgatctgctttccctctgtgtcttactggtgatcttgttacctgggcttcccaaatagctctgaggtccaccctgtcttctccattcctgctgttcttgtctgagtgctcattatccttaaaaggactagtgctggccaggtgcggtggctcacacctataatcccaacattttgggaggctgaggtgggtggatcacctgaggtcgggagttcgagaccagcctgaccaacatggagaaaccctgtctctactaaaaatacaaaatcagctgggcatggtggcgcatgcctgtagtcccagctactcgggaggctggcgcaggagaatcgcttggacctgggaggctgaagttgcggtaagccaagatcatgccattgcactccagcctgggcaacaagagtgaaactctgtctcaaaaaaaaaaaaaaaaaaaaaaaaaaggactagtgctgttgcttcctgactaaccttccttccctcaaacttgctgccttcaatcccacccagtctgcacactgctcccagagccatctttccaaatgcacatatctatggcacactggcacttaaatctctgatgtttctccctcttctacaggatgaagtccaaactcttttgcatgtaattataaggtgctcatgatctggagcctgcagcctttctaaccctcactcttatttcaccaagtttgtgctccagacatagcaaatcacttcttctttctggagcacactgtgattttatgcttttgtgtatgctgttttctctgtctaggatgtcttacttctatccccactcccctcttacctgttttactccctgtaatcaggatatccatccatccatccatccgtccatccatccatccatccatccatccatccatccatccatccatatatccatccatccatccgtatatccatccatccgtatatccatccatccatccattcatcaatccatccatccatccatccatccatccatccatccatccatccatccatctatccaacaaatatttactcagtagctgctatatgccaggattgctgctgctcttaccagccctgcccacacccttttcctcaaatgaactgctcatttcctccttacgatatgactgtgccttttttgaatctttcttagcactcatcagaatctgtggtaccatttgtttacatatatgctcccctactatgctggctagctccttaaaagatggaacatgtcttcattcagttggaagtctgagctccagcatagaatctgacacatgggcacagtcatatttgctgatggaggagttttattttctcaaaccttgttgattttggttgttgactgatgcagaggtgatggtctttagaaggaggttctacttttttgcaagtctaagatgtgaatctcacagtctgggacaggcttgtgttctagcaagttttcatgcaacccctccttgttatccttccggcatcatgcaggaagggaggaggcagtgagactaaaataattaaaaggacaccatacaattctgtagagagatttcaggggacctccaggattgttaaaggtgctttgcaataggttttatttcatccctttttgaagcagttaagtggaaagggggaagaaagaggctctgagataatagaggagcgactctaagagaggagatgtgcatttggcatcagtatttggagggacaggtttttgagaaagtgttctgtaatgcagattcctaagatgtgaactgtaaacctgtagtagaagctgtaaaaacttaatgtgagaatcacaaggatgagtcagccttcaaagtcaactattaaaatgtgagaaagcagacttaggactcatgagaggacaaactgagaagcagaaaatgtgcagcaaggtctcgacacctgtggctgcttggaatgatgcggcgttaaacccacacatggtggtctgctggaaacatgcttttttctagtaactgaaaaaacatacactgtggaaatatggttttggcattatacttgatttgagagtaaaatgttttgtgtgagcatcagatgaatggcctcttttgtattaccactcgatgggcattttatttcattactgctgatggcttccatcataggtagaaaatacacgatgctgggtggggtgcggtggctcacacctgtaatcccagcactttgggaggccgaggtgggcagatcacgaggtcaggagttcaagaccagcctgaccaacacagtgaaaccccgtctctactaaaaatattaaaaattagctgggtgtggtggcagccgcttgtaatctcagctactcgggaggttgaggcaggagactcgcttgaacccaggaggcggaggttgctgtgagccgagactgcgccactgcactccagcctgggcgactgtgtgagactccatctcaaaaaaaaaagccaaaaaaaaagaaaatacacgatgcttacgatggcaaacatagccacttgtcggtgctccaaaaatgtttagggaggttagattgagatttcacatgaccagactatcaatgactattgatatttattaagcctttcaacagtagttgttaggcatgcccagggccaagcactagagacccactgggtaagcaggagaataagatcctcaccttctggagccccatcatctttcctgagtttttcaatgtcaggcctgggctcctgccctcttgggagcaggtgctgatttgaaatttaagtatcgacttcaccttgatccctggtttccatttctttttccagaagcgttttctttataatttaataaaaataagcaggtggatagcattgcccttcacctacctgcattaacctgggtcagttccctgtttatcctggaattgctaatctagatggaatatttcttcttggccttctgtaaaaactaggaacctctgagatgtgcttttccctcacaaagatgtttattttataggccgcattttaatgatcttttgttttcttttcagaaggtaagaggggcgtctggtggagcgttaccaaaaaggaggaattccaagatttttttaggtaaatagttatcagtagcatgctcagattttgtgtttgtgtgtgtgtatatgtgcatactcatgtgcatctttgatttagagtaataggttgtttattgctgtacaatttaaggatgagaggcacagatttaaggcccgcctccactttgcgtttacctaccagtgaagtgtgcttttagccctcttagttgggtttagtgctttgaagcaattatacttacagtgacttgagagtaattataattctgcttcagttctgtttattgcttactttatttttattttttgagacagggtctggctctctcgcctaggctggaatgcagtggcgccatcttggctcactacaacctgcgcctcccgggctcaagccattctcccacctcagcctcccaagtagctgagaccacaggcacacaccaccacgactggctaattttttgtactttttgtagagacggagtttcaccatgttgcccaggctggtctggaactcctgagctcaagcgatccaactgcctcggctgggatttcaggcgtgaaccactgcacccggccaattttttgctgactttcaatagctggctcttgcagtgactcacgcctgtattcccagcacgttgggaggctgaggcaggaggattgcttgaacctaggagtttgagatcagcctgggtaacataaaaaggccctgtcgttaccaaaaaattaaaaaattagccgggtatagtggtgtgtgtctgtagtctcagtgacttgggaggctgaggcaggaggatcacttgagcccaggaagttgaggctgtagtgagctatgattgccactgcactccagcctgggtgacagagcgggatcctgtctttaaaaaaaaaaaaaaaagaagtcaatttttttctttttatttctaaaattagccaaactacagacttcattcagatttcataatttttctcccgctcatgtcctttctttgttacaagatatgatccagggttccgcattgtattcagttgtcatgtttctttaatcctttccagactctgatcattcttcagtttttctttgtctttaataattgtgacacttttgaagagtgctggtcagttattttgtagactagacctcagtttggctttatctgatgttttctcatgaaaaatgtgaagtatgtacgtatgcatttttggaaagaatcctacagagatagtgtgcccttcttagtgcatggtatcaggggtacatgatgttaacatgttgtcatactggtcatgctgaacttgatcattgttaaggtagtgtctgctgggtttcttcactgtaaagttatagtgtaattaagaaatattttgagagtgatactttgagactgtgctaaatattttgtttctcctcaaagttttgctcactaattttagcatcagtggaccttgcctgcaataatgatggctctagtgtttgactaatggtgatttgaaaatttcccttattggaagggccagttttgtttatgcaagtgactactgatttctatatcatataattatggtcatattaagcttctgatatggttttctcaagcgaaaaagtggtttgataatatttgaccaaacaagtttatgtgcctaaatgcctcagattattgtttgaaaggatttgcaaaattgtttccatagtatgatttcatttttgtaaaaaaatcctatacatacatatacatatgtatatacagatatagacatgtatatgtatgtatgcatgcatgtatgaatgtatatctgtgtgtgtgcacacacttctacacacacatacacatgtgtacatatataactgggagatcagaagagtctggaagaatactccaaactgttaatagtagctctttcccggtaatagaatggaagtgattctgattttcatctttttgcttctctatatttaaactttttctgtaacaaacatgttactgtgatgaaaagacacatgaattatttgaaaagtgaagccattgaaaactgttgtggagctgagtttctttcctggtttgattctcagttactctgtgctggatccaaccttgctgtcttctcctgcttctcagctcatgcttttctgtacgaggcttatctgcagttggttcttctaccttggccaatcttccttacttctcaacctgtctttggaccacaacccagtttaaccaactaaacccaaaccaagctagcatgaaccccaaagctgaaattattgaatatcttctgatgctttggttattagtcttccagcacctttgcactaatatagatcatatgatttcatttgaattaagtaacgtcagcaggttcttcttgaaggcagaactaactaaacatttcgacttaccattgttaatttttattattttctttggttgaatgaagaagttagctgaccttggcctttaatttttgtgtcttcttttcataagacctggaggtttgatttttttctagtgattattttggttgtagaggatattgtcaggaaactgttttagaaattaatttgaaagttagcactgaggttttgtgcttcaaactgtgtggaccccttccttccattcttccgtaggggactacctaccattttgtttcagtgaggctttttctacaggttattctctgtattcaggcaagatttcatatcttagaaaaccacaaggtgcatatagaactcacagccccaaaaaagtgttctatgactatattaatttaaaaatgaatgccattagccccacattccatttctccctattgttttatatccaggttctttacaaatttacctccgtcatcccagtaggagttctttctttttcggtttttgagacaggaactcattctgttgcccaggctggagtgcagtgccacaatcatagctccctgcagcctcaccctgccaggctcaagtgatcctcatgcctcagcctcccaagtagctgggactacaggcacacaccaccacacatggttaattaaaaaaaattttttttaaagtgatggggtctcactgtgttgcccaggctggtcttgaacttctatgctcaagcaatcttctgacctcagtctcccaaagtgctgggattacatgtgtgagctgctgtgcctggccaggaagttattttttacaggaattcattttttgcaagttctgatttaaagccccctcaactgatgcttctcatctcctaggaacaggcacttttctcttgtcacattggtcccagccctgagttaatgtgacctataaattaatttcagtgatgggctgtgtattagggttacatctggtttatgtaacggtaaatttaaaacactagtaactttgtttatttatttatttatttatttgagccggagtcttgctctgtcacccaggttggtgtgtagtggtgtgatgtcggctcactgcaatatccgccctccgagttcaagcaattctcctgcctcagcctcccgagtagctgggattacaggtgcccaccaccatgcccagctaatttttgtatttttttttttgtagagacgaggtttcaccatgttggtcaggctggtctcgaactcctgacctcaggtggtctgcccaccttggcctcccaaagtgctgggattacaggcgtgaaccaccacacctggcctatttatttttgagacagcatctcactgtgtcactcaggctggagtgcagtggcataatcatggacactgcagactcggcctcctgtagggctcaagtgaacctcccacctcagcctcccaagtagctgggaccacaggcatgcgccaccatgcctggctaatttttgtatttttctgtgaagacagggttctgccatgttgcccaggctggtctcaaactccggggctcaagtgatctgcctgccttggcctcccagaatgctgggattacagatgtgagccactgtgcccggccgattctggtaactttaaacaagatagatgcttattttgctgtcatgtagaggatgttgggaaacagtaagtgtggtgatgtgatggcctcatgttcaccagggatctaggctcttcccatattcctgcttcaccctccatcctggcccatgatttccaacctcatggtcaccttacggtccaaaatggctactggaactccaaccatcacatcctgattctggaaagcatgaaagaggaaaggggaggccgggcgcggtggctcatgcctgtaatctcagcactttgggaggccaaggtgggtggatcacctgaggtcaggagttcggcagcctggccaacgtggtgaaaccctgtctctactaaaaatacaaaaaattagctgggcatggtggcacatgactgtaatcccagctatttgtgaggctgaggcaggagaattgcttgaacctgggaggcggaggttgcagtgagctgagatcgcaccattgcactccagcctgggcaaagagtgaaactccatctcaaaaaaaaaaaaaaaaaaaaaaaagaaacaaagaaaagaggagaaagaggaaggacaaaatagtctaatctcccagcagagtcaccttgcctttgtcagccttctcatagagcccccaatcagtttacgcctctctggcagaacttggtcacgtggccacatctagctgcacaggagactggaaaataaagcccaccagcgggctctgctgagtaaagttggggtctcttattaggaagaaggggacagtgggtattgggaggcagctagtagcctctgccacagactctttccctcaaagggatgctgggattgtttcctcatggagaggaagataactcagagctctcttgcagtttctctgttattttttggctaggaagtactatttcactggtactgaaatgaaattatgatgctccttcttcggcttcatgaagcagatgtaggtggccaatgctttatcttgggtggaggtgttttattcccattcatttgatgactttgtgaataattccttttccatcagctcaacagtgacattgaaaccattgaatcatttggttacaacctgcaattgactttacaagggaagctgaggccactggctggtgccaaaaggcttcctggtgtcctgagcagcaccctgcctctcagtggtcaaatcactttccctccatattactttgatgttcattcaagtgaaatgacctcagtactagcttttgctgctatttttttttttttaactagcaacgacaattattggtaattgaaaaatcatttaaattctatacttttaaaacatttaggattaaaattttttttcaatatgtacctcatgggtaaagcttaaaattgagaagttataaagggctcctcagtgaaaattaagtttttttcccctcccttccctgtatcctagccacttggttactgcctccagagacaaattttctgtgtgtacatctttgtatatattgtgtattctctcagcgattgtctatacataagtaatgcttttagatttcttttttctgtagtccctagggagccattaacccttcggctcccaaactgtgttctgaggcaccctggagtgctacagtgagctcaccagggcactgaaggatattttaagtctctgagggaacatattggtgctcaaacattgcatgaactaaacacagtgtagttttactattaggttaccctgtattccttccaataactccatatctttgtaaagctggagttttttttagtggtttctgtggtaaaagtcaagcaccatgtgaaaatcaatgtgaaataggaaataagggtggcagtggctgatccgattcagggaagttgtgcattgcccaacagctgaacacatcccattagtgaaggactggggctatttcagagtaaaatattttttctttcaacttatacgtattttttgctaatggttagttgttagaacataaatacttaaccaagtttttttgatctaactactaaataaacagagccattaggcatttttttttttttttttttgagatggagtcttgctcttgttgcccaggctggagtgcaatggcatgatcttggctcaccgcaacctccgcctcccgggttcaagcgattctcctgcattagcctcctgagtagctgggattacaggcgctggccaccacacctggctaatttttttgtatttttagtagagacggggtttcgccatgttggcaaaacctgacctcgaactcctgacctcgtgatctgcccaccttggcctcctaaagtgctgggattacaggcgtgagccactgcgcctggccaggcatttcttttggcttagggttgctgtgaaaaaaattgctgggatgcttaggggtgctgtgaactgggagagttcagctagaaagggacactattaggttgtgttgtagaaagataacttggaaaaatatgaaagttggtgagtttggggtataagctgatatgaaggagatagtagagaagcgaggaggtaagggagttctggatccttcaagaaataccctatggctcataatgtgattctgccctaattccatatatatatattttacaataaagctacaaatatgcatagatatataaataactggtaatgcatttaatttaaaaaataccatatgtttgatacatcataaaaaacagtgttaaatatttacatctttatggagtctgtcctagttttcacaaataggtgtaaaggagttcagttctctgtgtctgaaagtggaacttccaaggagccaccacttcacctcagaaaacttaaattccacttttttttggcttagaccaggtgtttaaacttgttaaggaatagattgaaaacagaaaatttgtgcaaagtttcgctaatgggcctgttcagaaagttcatctgcccctctgataaccagaaggttctaataaactacattttgctatttctttctgaagtgggtaaaataatatgttcttttgaaggtaaatagttggttagattttgcagcccttggacagatcgcttacctccaacaattaaagttaatatggtcagggtgagagaacactgacctgggaatcagagccctggctttgtgtagggacccattctttccttcactgtccttcatagcttaggcatcttggggaaatgggtagtcctagccacttctcccagggatctgggaggatcatcaaagcagagtttatatttatttatttatttttaaacttagagaaggctttcttgggtattgccacttaatagccacaatagaaggtagcagctggggagaagttgggggtccctagggtatgattactctgtagcttcttcaactaaatatttttggggtgatgagacatgatttagagatgtggaaattttaggttatacttagggctgtggggtcatatgtgttcaagaggaaccttagatttgtcccctgaaatcagaatgtatgttacctctgatggacttttccctaatttggattaagttttttgggaaagatcatgcccctcttccattccattgaattaaaagtaaaagtaaacttaaactaagtgtaaagaagcacaacaaagttctgcttttctgcatgacagcagtcttgcttcctcttaaacatctgagtcgccaattaaaatacaatgcaactcttttgatattcttgttttgctgttgtttttagcatgttgatgttgttgacttcctgaagtccccattcacagacatttacagggtgtgtagtgtgtgccaggcacagtacaggggctaggaacataggaggtaagactcatttccggctctctgagctgacagtctagaagaatttgaaggtgataacttctgaatactcagatttcacagaagatccccacatggtaccatggtcttgcagccaaagggaagggaaggcacttttggttgtgttagttgtcaggaatagggagaaagtgatgatgatgatggtgatggcagatattgtttgtggagtcccctagtacctaccagatcctgtactagggtgccttaaaactttatcttgtttaatccacttaacagtcttgtggggtagataatatctatggtttacaagaagaatgaacttagaaacaaattttctagggttacatagctagtaaatgccagagtggggtttttttttttcttgtattttatttatgccaggtaagatttgaattaactttaaatgagcatgttttctgtggaaaggagacagataatatcttgtatgagctgaatctgcacacataaacacaagatttatgccctggttacttaaaattgttatatatacaatattataataaagaaaaatttaagaataaagttcactcactctatttccatttgtttaggtttctttctcatttttgtctatgagcataatataaagtctttacagtgaagatgaattttgtgtttttagcattaacatagcataaacattttctgttcctacatagtctaaataactatgatttaaataatattctattgggttgaatactattttttttttttttctgagatggagtcttgctctgttgctcaggctagagtgcagtggtgcaatctcggctcactgcaacctcctcctcctgggtttaagcaattccctgcctcatcctcctgagtagctgggattacaggtgcgtgccaccacacccggctaatttttgtattttgagtagagacagggtttcaccatcttggccaggctggtcttgaactcctgacctcgtgatccacctgcctcggccttccaaagtactggattataggtgtgagccaccatgcctggccgggttgaatacctttttttattaaacatttagattccaacttaaaaaaatataaatattgaagcattcacattttcataatatatagaatctttctttgaattatatcctttaaattaatgcctgtacttactaattaaacttctttaatattacattttgtcaaatgaacctcacttctattgctacctagtaatgtttggtttggttctttattttggtatttctgactcttacaatttagaatcttttattaaaacattgaaaccaggcgtggtgattcacgcctttaatcccagcattttgagatgctgaggtggggggattgcttgaggcaaggtatttgagactggcctgagccacatagtgagatcctgtttttacaaaagataaaaaaaattagccaagcctggcagtcctagcttctcaggagggtgaggtgggaggatagctagagcttgggagtttgatgttgtagtaagctatgatcacaccagtggactcaagtcttggcaacagagtgacaccctgcctcaaaaaaaaaaaaaaaagcttagattgcattttagctgtatcttatttattttatttatttatttatttatttatttatttatttatttatttttactacaaactgccctacctttgggaatttaagagcagagctgtacacaaacatatactaggtttttgattgaaaacatacaaggtaataacagaatctagatcctttggttctcaggtgggtgctccattaagtaaaataactttcttctgtctatagagcctatgtttctgtgtgtgttcatgggcctgttcatgtgtaggtttgtgtgcatgtgagtggaatagctagctctttgtcaccatagttccaagcataaatatacaaacatgatctgggatgctggcatccctgtgaaagtgatgctgaaatgtccatatacatattgtgacaagacatttccctgagccttcgtttaacctttaccagagatgaaccaagcaaagaggggacgacttgataggtaacaggctagaggagctcatcttccttactgagaattctccacagctgaggacaatatgactactcacattatagggcttccacctcggatctactaggcaataactcaacactttaagagagggagagggagagagcaagagggagattttgtttttaaataatagctaacatttattgactacctattatatgccaagcctcttgttctcgtttatctcctgtataaactatgtgagatacatgctattatcttcatgctataaatgagaaaactaaggcttagagagtttatgacttgcccaaagtaacattaagttttggagctagtcttgaacctaagtttgtcaactctaaaaccatacttccatattatgatgttgcaaaaaaaaaccccaagaaaccaaacaaccattccagcctattgttgtgaaatcaggaaccaggtacctgacacatcgtaattaccaatccttgcctttttaagagtttctaagaaattttctttctgagaaattccttctgagaattgagtatcttgcacatttgtctattttaactgtaaagctttatgaaatggctcagtcttcatacatcagtcactgatacataagtattcataacttgatggaaaggcctgctattggtggttgaggacagatggacggccctgtcagaggagaaagttgtaaatgtcacacccttggtatttcatcatcaccttggatttctggcttttccagtgagtgctgccatagtgtgggatattattttcctcacttcttgttctttgtttttgttttctcctcagatctagatactgatgacgatttaaatagcgacgattatgaatatgaagatgaagccaaacttgttatattcccagatcactatgaaatagcactaccaaatattgaggagttaccagccctggtcagtgagtgtgcacggctgctagctagatgcgcatggctctgtgtcaggtgtgtgtgcgtgtgcgatgtgtgtgtgcgggggtggggtggggtgggaaaagccggttgaatgagagaagaggatgaaaatgagcatgaacacgcacatacctcttctcttctgtgacaggagtcttgccggcttacatttcagtagtgctgggccttttgctgtctcttacttcaagtgctgttagggctttgttgctcattagctggtctcttccaggttgggctggcttcttgcctcctaaatcacaatctgttccttagattttcaaactctgcaccccagatctacagggactgctggagagggactcttttctgatcagaaggataacagtctttttatcatgtttattatgttggccttccatgtaacattttgtttggaaaaaaatagaagtgctccactgctgaaacaatagcgacgcagttacaaaaagaacaaagcatttacaaactacagatctgcgggagctctgggattaagtgaaccttcttttcagttttactccctatgtgaactaagactacttcctaggttttagatatttttagctgtgagcttcccccttcctcttcccttctcttttcttccttttcctttctttcgaatccagttttgtggacggaccgtaattttcttgaatgacttgaagctggatctgctggtagtgatagagggaagccaggttttgttttccttcgattctcgcgtgctggaagtgggcgcagagttcctgtggggaccctgtttttcctgctctttgctcatttcttgtattgcctgtaccactttgtcctctttccttttttttgttttggtctcccatttctttttctttgttttttttcttttttgagacggagtctcgctctgttgcccaggctggagtgccgtggcgcgatctcggctcactgcaagctccacctcccgggttcacgccgttctcctgcctcagcctcccgagtagctgggactccaggcgcccgccaccacgcctagagatttttttgtatttttagtgcagatggggtttcaccatgttagccaggatggtctcgatctcctgacctcgtgatccacctgcctcggcctcccaaagtgctgggattataggcgtgagccaccgcgcccggcctggtctcccatttcttttcctctttccattctgtgcacaccttgccttcccagagcctggccacagatggcagtggggccagggtgggttgagtttagacatgcctgttcattttttccctcctcaaaccatgccagaaccaaagccagctctttaggtcccagagtcttctggacgttgcatgactctctctgtagccatctgctcacttgtccctgccaagaggggacatttgtgcttggggtttccatgtcactagggactcggtttccaccattcattcccttttgccccaatctactttatatctaagatcacagaaatcagaattttgtgtgtatttatttattgtgcctcttcttttagtactaagtgcacagtgttcagtagggcatacagaattaaattacctttgctttctccaattccatgttgactcatgtggctgttaccaaggataaaatatattagtggacaaaatggccttacctcatcccattacctgaaattatataccaatgcttatatttctgtaatactgagagttcttactgccttgtttaatataactcttatttctgctgtcagaagagaagaaacattgtgaataaatgttatgataaattattttcctttcagcccctcatgaataagtctttatgttaaaaaaattaataaaaaagccttttcttattgttgtacttggagtataatttgaaatgtgaatagtcttatttaaaataagagaagtgccatagaaatctgaatccagcaagatatatcatcatttttactatagagtcttttagtattaagaaatactttaagaatgaaaaaagaagagagaattatttggaagatgagggtggggagataaaaggaaaagcctggacttatctgatggtaatggataggatttatctacatagaagatgctagttactatattttcttttcatgcttttgctatatttttggtgttcgacaattctctttttaaactgttaaatagcaaaaattattgagctcaaaccatctaaccaggtgattcttccttcatcttctgagtgttttagcacagaagaatttcattttcagagagtgactctataggttctaccagaaagttaaagcacctctgggtgatgctgggttcacagagacatagcactgtgagctcggcaggggtcttagagcttgaaatccaatgccttcatttttgacatcaggaattggagcagtggtgtgcttgtaaatgtttaacaacaggctccctagggaaaaaaagctctgttttgtagtgtctgctgattccatggtgtaaatactcccaccatgactgatttcaggttatcaatatgacgtcactgaatgcggtgttggaaagagattggtagtagcagaccattgtacagaatttccagcattccgctgacatgcatgtaaataaaacctcaagaacacatagataataatgagatacagtaaaacaattaggaagtgaagaatttttgattatatgtcaccttttgaaaacattttatttagtcgtaagtttttatgatttaacgttttataatggctgtgtttagcaaccatcttgctgaatttcttaaaatttaaagctggactcttatgagccagtttgagccagttccagtgcagaactgaactggaggcttacaaaggcatgggatggagccaggactagtaccaaggtcttttcgcatcacttgagataacatatccagggaaaaatagttcacagtgtgattacaggatgatggatcctgaccttcagctgtcacccataaaaagggcctttaagtgattttggatgatattctgaaaacactggatcagtgtttgataggcccagaagtctaaggatgttttgttggttgtcacccacaaagatattcaaggacaaaggagaagattctatttgagtcttgttcagaatcacagtgcactgcaaaccagaacgtttagaaaagatctagtaggggtggagacagtcctaaggaggacacagacatgatttgggtagttgatgaaacaaacaaggaggttataataggtcacactcaaaagattaggaggctacacaacagcctccttactgtggtctttccttcacgcctgccctcttccctgcacagcagccagtgtgatcttctgtgaaaattagatcctatccttcttcagcttaaaactctcaacgctactgaccgatgacactgggctactcacagtcaggaacaaggaagaagtcctggccagaagtgctaaggtggcatgtcccaaacccataaagcctggaaggggcttgtggtgaactcagctctattttctatgggcatttctggaaggtgatgggggatgagttttcaaaatggaaagaaaaagctaattatacaacagcatttgtagtgggagataaatgggcttttgaaaggcttaactatatttattaagtcccgatctctaatggattataagcttgttgaggccggggacctcctccttgttcctgactgtgagtagctcaatgtcatcaatcagtagtggtcagtataaccttggagagttttaagctggagaaggataggatctaattttcatagcagatcactctggcagatcactctggctgctatgcagagaagaggggcagggctagagggaaggccacgataaggaggttgttgtgaagctatcagggaaccatgatggtggctaggaccaggagaggtggggttggagtggacatgaggcccatcgcagggctgctagaattgcctgtgggctaggtgggggtgaaatggcagctgagggaatttcctccattgtttcttgttccttccttggttctagggtcagaagccaggacccagacacatgggaaactgctactcaggggaaaatgatcagctcactgtgcaggatatgagtgatgtagattacaaattttgttatttatttatttatttatttacagtttagtggagtttattatattagagttgggcatccatcaccactatctaattttagaagatttctcttgccccactaaaaaacccataccccttagccatcatcctccagcgcttcctccatgctccgcctgtggcactcactaatctactttctagctctatagatttgtctactctggacctttcatataaatggaatcatgtaatatgttgctatttgtgactgactttttcacttagaatatattttcaaagtttatctatgttgtagcatgtatcaatatttcattcttttttattggcaaataacattccattgtatgtacatacaacattttgttttacattctatttgttatgtccataagcatttgggttgtttccattatttttattttttattaaaaaaatttttttttgagacagggtttctctcctgttgcccaggttggagtgcaatggtgtgttctcagctcactacagcctctgcctcccaggctcaagcgatcctcctgcctcagtctcccgagtagctgggactacaggcgcatgccaccacacctggctaatttttgtatttttagtagagatagggtttcaccacgttagccaggctggtctcgaactcctgacctcaagtgatctgctggtctcggcctcccaaagtgctaggattacaggtgtgagccaccatgcccggccccatttttttgattattctaaataatgctattatgaacagttgtgtacaggtttttgtgtggacacatattttcatttctcttggatatatacctatggtagaatggctgggtcatgcgataactctgtttaaccatttgatgaactactgaactgttttccaaagtggctgtaccagtttactttgcaaccacaatgtaagtttttaaaagatagctagaaatagcttatagcattaagccaatagcacattggctaataggcatatggccagaatcaattgggtagggagagggcagagagtctgttttcctcctcccctgtggtcagttggtgccgagcagttcatcacagatttgctcatgatgtggactaatctggcacagagacacccaggcatgtccctgtccagggtcacatttgcaccagattaagaaatggagccatgctgcttacattccattcaagtgcccttgaccacatgccattgtgtgatgagttgaggatattggatatctgagtgtacatttgttatgaggaaaacacaccacttgggtaaatcctgggcattcctgtatctaatttcacccttgcaaattgttcacctcctacttttcaccctgcttgctaagtggtaggaattgttaaatctgacctctaagcttgggcttagaaaatgaatttagtttcttgctatctgtgacattgtcaatactacaaacactaggccagggacaaaacctagcttgatccagggaaagtgcaggaaaacaggatccctctcttgcgacaactacgctgtttgcgtttcttcagtttttaaattcatattctagtgaatttgctattcactagcaaatcgttattttctcaaactgtttttatatattacatctgggtttgtcttataggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaaggtgagagtcagatagcagaatggaactttactccctaaaactgtccaaaggaatatttgttttctacttcttttttgaataggaagttatattttttcttaccagatgccttttattaaaagtaaatataaaacttctctaaaattgtctgtagctttgtagtagatgctgaatgtgcccagtccatacccctaagcccttccctgccctgaagctgccagttgcaagcacttgcaacgctttgcatgagagctttttctgcttgctgaagccagttatgccagtgcacgggacagtcagaaacatcagagtgaagctccctccctcctcctggagcagccctaaaccggtgactgtggcatgggtggattaataccccagttttctgcccctgcaggtgggatatctgtctcttgcaattccccatgtggcctgagccccagtcgcccacagtgtacatttgctcactgacatatcctgtaccagcttcctaccctttcttgtctttcttccccacttccctgggatcacctcccggacaagccatttaccttcacttttttgtctcagagtcttgttttagggcagtccaacttacaagtctttggttgtcacattttggctggaatactctttgggctccattcatatctcctcttattaggtgctggtgtgtttacagaggcaggtgttggcggataggcagatggattaggaatgtgtctgatttggttgaatcctgacagttgcatggcattcaccttctgtgtggtctttggaaacgagagttacttctggacctccatttctccgtttgtaaaaatagagatggtaatactgatgctgaaaggtgtttattagaattaaatgagacttctgtaaggtacttggcatatagttgacgtttagcatttagtcaagttggtctcctttctaattaatttagatttgcagtgtagtcggatttgtataaactagctttactgtatgtgattaatgctttagaactttagtcatttatacacacaggattcttaatattttaaacttgttcaagctccattgtccctcatagaggagttttaaggaaatgaactcctctcctagcctgaagttttgtgtcagttttcgaaagtaaaaaagccacttggagatgctgggaggggctagtccacatctgggaggcaggcagggtgctgagtgatcctgctgctctgggagaggaacaataattttttttttttttttgagacagagtcttgctctgtcacccaggctggagtgcagtggcacaatctcggcccactgcaacctccgcctctcgggttcaagcagttctccctgccttagcctcccgagtagctgggatttgggattacaggtgcccaccaccacacctggctaatcattgtatttttaatagagacgggggtttcgccatgttggccaggctggtcttgaactcctgacctcagttgatgtgcccgcctcggcctcccaaagtgctggggttacaggcgtgaaccaccacgcccggccaacaatgtcttgaggggagaaaatggggaagcatcagtctctgttattccactgagcctttgttgtgacctgcctacttgaaaccctctgtcttcttagatgttaagttttaaaattatgccctggctgttctgactactctccaatggctttccagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcaggtgagtgcgcctttaccgactttgggaacatgcagtggcttcctcttagatttaaccaatccctgaatccaggtggttggaaggtgcaggctctggatgcagacagcccaggtttgaattctaattctgcctcttattagttttgaggtcttgggcaagttttctaatctccctaagctttagaatcctcatcttgaggataacgatgatgatacctctttcctgtgtttgttagtgtgcataaagcatttagctcagtgcacgctgtaaggtcctaatacaagttgctgctgttgttattatccttctgtgtatctcttggctaaggaggacagagcaggaaacaggatttgtgaagtgagtgtgcataatcaagtctactgttagaacagcaggaggaagccctggaatccattacagggattaagtatcattttaggaacaaatggattaattatggagaatatgagttttaaaggatactgtgcattaaaagagtccctgaaatcacctggcagtgatggtgttcacattctccgggggattagaattgtttccttcttgcactgtcagcttcagagttggttctgtttctttttgtcctcacatggtgtgctttgaaacattagcttttggccatgtttgtacagttaataccttctaccattttgcgagggaaaaaggcaataatatcaggatcagtaatgagaaacttaaatattgagcagtggctatgagaacccatcatctaatcatcattggaaacatttgttaaacacagatctggactgatacccagctggtcttctccattttcccaggctttatttagtctctgtttcttctttgctgtgaggtaagatgtttttaggggaaatataaaaacatgtcttctctcttttctcttttttctctgttatttttcgatgatggaattagcctgcttcagagttaattgcccaagatcttttcattaaataaggggacatggctcaccaatcattgttttttcattgaaccggtgtagtttttcatttgatacataactgaggactggcagttaggtcgtgtcaggattctttggtttcacattttagagaattttcctgctttcaagttttgtggaattattttaactcattaaagacaagtagctgagaaatcctagctattggtaccaaagattttcccccaaagtgaataaagatacacaagcccaggtcttatcctaaatcttccaggattgaaaggaaattcaagacaagcgtttggattcagggttacagcgcggtgtttacaggtgattgttattcaatgagtgggtgttgaatgacttttctctaagcccttctccttgtccttttaggggattgtagaaagatttgcaatgtaggaattctgtcggataaagttgcaaggggacaataattcagattttccgactttctatgctgtcttgtgtagttgcctttatatgaccagttattggaaattcagttctcagaacagcctgttcaacactataactgttcgtatatgcagcttagttcttctgactttttaggatgaaagcaagtctatgtcttactcatctttgggttctatacaaaatcttacatgtcttaggcacaaatacttttgttaattgaaccaactggtatataagcatttaaatacagtcctgtgtcacttaaggatggtgatatgttccgagaatgcatcattaggtgatttctttgttgtgtgaacattgcagagtatacttggacaaacttagatggcatagcctccttcacaaccaagctatatgatgtaacctgttgctcctcagctacaaacctatacagcacagtactgtactgactgctgtagtaacacaatggtaagtatttgtgtatctggacatatctaaacatagaaaagatacagcaacaacatggtataaaagatagaaaatggtcacctgtacagggcacttaccgtgaatggaacacgcagggctggaggttgctctgggtgagtcagtgagtgagtggggagtgagtgtgaaggcctcggactttagtgttcactactgcagactataaacaccatacacttggctacactaaacttatgaaaacattgtccttttcaataataaattaacctcttactgtaatgtttttactttatgaacttaatttttttagcttttggacatttttgtagtaacacttagcttaaaacacaaatacattatacagctgtacacttttttttgttttgttttgttttttgagacagagtctcactctgtcacccaggctggagtgcggtggcgtgatctcagctcactgcaacctccacctcccagattcaagtgattctcctgcctcagcctcctgagtagctgggaggtgccccaaccacgcccaggtaatttttgtatttttagtagagatggggtttcaccatgttggtcaggttggccttgaactcctgacctcaggtgatccacccacctcggcctctcaaagtgttgggattacaggcgagagccaccatgcccagccaaatttttttttaaaatatctttattttataagcttttttccatttttattttgctttttaaacgtttttattaaaaactaagacacaaacacacacattagcctaggcctacacagggtcaggatcatcggtatcactgtcttccacctccacaggttgtcccactggaaagtcttctgggacaataacatgcatggacctgtcatctcctatgataacaatgccttgttctggaatgccttctgaaggacctgcccgaggctgttgtacagttaactttttttcgtatataagtaaaataacaataaaagtatagtatagtaaacacataatatggtaacatagtcatttattattattatcaagaattatgtactgtacgtaaaaccatatgtgctatacttatatgtgactggcagcgcaataggtttgtttacaccagcatcactacaagcatgggagtgatgtgagtaatgctgtaatgctacaacatgatggttatatcactaggtggcaggaatttttcatctccattataaccttatgggaccactgccatatatgcagtccattgttgaccaaaatgttgttattcagtgagtgattgtaattagattctatttaaatgtatgctaataataaaggccaagaattaattctattctttgtgtatctttcgttttctagaagctttcttttctaatgggaaacttattttaaaattgctaaatagagtaactctagtttcttttctttcagttttaagaaagttttatattttcctcttgattttgcaacaaacagatattcagtgtaacatatgtagaaaacagagataaaagtttagataaatcaatacaaaatactagtaataccaccctgtagactactcactgttaataatttaggtatttcattttagtcttttctcttttttttaaagggttaatcagttcatacacacacatgtacacacgcacacccacctcacatttttacaaaaatgtgatcatactgtataaagttttattccttatttttctctatttaacattatgtttttctatgctattaaatattcttcagtattttatgatggtttcataaatcatttcactattctgtaagtggttacaattttttttctattctgatgaacatccttgtatatatgcaaatctttgggtgtttgtctagttatttctttagaataaattgctgtgacaaaaagagttaaatctttaaaattttcagttaccaagattctcttttaaacagttgtaataatttacattcccatcaacagtgtatgacagtacccatttcaacaaatccttgacaactttttttattaagacttaaaaaaaaaacctttgctaatctggtatcttgttttaatttgcatttctgatgaggctgaatatttttcttagtattcttggccatttgtagttcttttttgtgaatttcttaggccaatgtttttgtaggtttaggtttttaaaaattgttttttaagaactctttgattattaagaatattaacccattgtcttccatagttgttactgtttttgtgaagaagaaataacttttaaggtttttcttgtcatataattgacagtatttgaatgcatctgtttcaatcatagaaagtataaaacatttggcaacagcaatgcagatcgtatacactgtgataagggttgtgaattcatttagctaaaataatgttaactttttgaaaaagatcaggctttgattcctgcgaatattgtgcagagtcagttttaataaaagtattttctgtctaattgtaatttcatattagtttatgggatgcatacattctattttggtttcctttaaatctgtttaatagatcgcaagctgtaacatattgtttatttaaaagccacataaattaataaaaacatgcataaagtttccttaaatgtctaatgatgagccttgtggacattgaggcccaggggtagggtgccctctgtctgggggtagccatctctcggtgaagtttccactgctgagggtctgctcttccacactcgctgggctcactcagtccagttcaactcacaagagacgaagtctcaaagtcagggcatttgttttttagttcataatgagagccacaactgccagtaagtaggatgtttatgtccgcttgaccagtacattccttccctgtgggaagctgaattatatttagaagattgcttagtgaacgtggaatccaagaaggttgtggactcaaatatttaatggtagtgtgatctgatcatcctgatttcctttcccccaataaggacatatttgtctaatgagacactgctactcatccttgaggtctcaacttagatttagtttttcaaagaagccctggtccctcagtccaggccagagtggtggcatgcatagcaagaacgggccccacatgaaattctactctgggtccccatgggtacagcaacaaacaaaccaagaagcagatcactacacaaacaaacaaaaagctttcctctgtgggaggacgcattgtttcggcgaggcagggatgaggttcttggtagaaagggagtagggcaggacggagacgggatagggtgtgtttttcttccatcacagaaactagtttacccgagaagatgctttagtgtcttgggtgattgtaggagagtcttccagagatgcccaaggcagctgtgaaattgcctcttctattggctgtaccagctccatagcatctcaagctggtctttcttctttggtcatctttacccccgacctgggcataagctcccttgagtttctcccagccccagggtttggaatcagggcacggactacttcatgttagttttggcctggcctcggcccctgctgtgtgcctctgtggtacttcctgctgctctgtcatggtactttccacaagaccctgttaacagtttatttaatggtggtcacccaggacggcagggcctaaggccacatttcttgggcactgttatatctctagcatctagtagtgtgcctcacacatagtaggtgctcagcaaatattatggagcaaacaaatggaggaagacacaccaacaaaatctgcttctatttgggaggctgtgttttgaggattgcttgggcccaggagtttgagaccagcctgggcagcatagtgagaccctgtctcaaaaattttaaaaaaggcagagaatattggctcctctgatttaccttttttctactttactgacatcttttttactcttacctgttttcctttcctgactacagtctaggttttgtctgtcctggcggttctctttcttttcctttttcttttttttttttttgtttgaggcagggtctcactctgttgcccaggctggagagcagtggtggaatcatggcttactgcagcctcaacttcctgggctcaagtgagcctcccagctcagcctcccaagtactgggagcacaggtgcttgccaccacactccatactcggctaatttttttccatttttttttgtagaaatggagtcttactatgttgcccaggctggccttgaactcctgggctcaagtgatcctcctgccttagcctcccaaagtgctgggattatagatgtgggccactatgcctggtcctgttctctctctctatttttttaaattgagacagaatctcactatgttgcccaggctggtcttgaactcctgggctcaagctatcctcctgcctcagcctctaaaagtcctaggattataacctattctctctttaaagagatcctacatgctggcctcatttaatttgtgtttatttttctttctttttttttttttttgagatggagtctcactttctggcccaggctggagtgcaatggtgtgatctcagctcactgcaacctccgcctcctgggttcaagcaattctcctgcctcagcctcccaagtagctgggattacaggcacgcacaaccacgcccagctaatttttgtatttttagtagagacggggtttcaccatgttggccaggctggtctcgaactcctgaccttgtgatccgcctgtctttgcctcccaaagtgctgagattacatgcgtgagccactgtgcccggccttgtgtttatttttttagtgtagctgctggagttgtcttgtttttcttcttttcctgtctgttgcagatggcttagaggcacacagatgtgaactcccggtggagagatgcagtttgggtggacagatctgcactgactctgaggagaatctctcttcattttctcctctccgatttattacttggtgtttgaccaggagctttgctttttctctccatttgtgagagaagggcaccaaagctggctttcctagtttttgttctgttttgttttgttttgagacgcagtttcacttttgttgcccaggctgcagtgcagtggtgtaatcttggctcacagcaacctccgcctcccaggttcaagtgtttctcctgcctcagcctcccgagtagctgggattacaggcatgtgccaccacgccaagctaattctgtatttttagtagagacggggtttcttcatgttggtcaggctggtcttgaactcccgacctcaggtgatccacctgccttggcctcccaaagtgctgggattacaggtgtgagccaccgtgcccggccttccatagttttaacacaaggacttgctgaggtacatccttacctctctctcccttctactttcctgtaggggaatctggagggagaatttggacttctgccattttctggggcctaggataagggcataaagtcacatgactaaaccatgagacccttcacaccaaaccagcatttcttctaagactatttgaaatattaaactttaaacttatgagggcagggactctgcatatcttatttaacattatatcctcagggtatacatgtatttggtatttagttaatatttgctgaatacgatgaatgagtgagttaaccttggtggttgaacaaggatgacccgcgccaggcatgctagacttaacagcatagtcctaatagcataccgtccaatagcatcgttttaatctctgggaattacttagaaaacattttttccatcaaaatataataaatttagaaaaaacagaggagaaaaaaagacatcttctcattcagagattacaaattattattaccattttgatctgggttcttacagattctcaatcttgcttctggttcatctctatctctgtctctgctctctaagcttttccttaattaatatttgagcttactgcacatactgtttcctagcatgcttgtcacaaaaggatattcttgttctaaaatttttttttaatcttttttcttccgcagattgctgcctcatgctcttgtggtttagtttgtcatttaacttgaaatgaaaggatgactggtttgcttctaaaatgaatgcagttactcatgaaacactgcttgggctattcctgggaggatacctctgtgaactccctaactgtggttcttggcttcaagttttaggccaagctggggagcgtgatggataatacttgtcaaaagttgcctatttactaccatagtttctgcactaagacctgactttgctaagctgaggttgggaataaaatgagtttcccagtgaaaaacatacaagacagcattttcagccactgaggccactgaaaactttttttctctgactacatatttataaattcttcctgattgccaagtttgaagatcacagttcattttcaggtttcttgtatgttactcactaaacactttttgtcttggggatgagaaataactatagcatttgaccaaatcatgtcatatttttggagcagttaatggctggaggtatgaaatatgattttctcaatgtggcaagagcctaatgggttacgaactgtggagggctgtgtggttttcacttatttcaaaatcctaggccaatgccagtggttcaattctggcagttttattattttctaatacagccctgatcattagaggcttaaagtcttaagtcttcaaactatctccctaattaataacaactaaagtgcctagggagtgccattttcaccttccagctagtatttaagtggaattttttgatcccttgtcatagattaaaaatactgttgatgtatttgtttcaatttattagttcaaaggtttttgcttattttattaatatttaaacttttggaaatgtttcttaattgggctgagattttgtcttttgtttcgcttttgagaatgctgaattatatttaaaaaatataaatgagggttgctatccacagttatcatgggcctctgggggaagaggaatagaaaagacaactacacaatgtttaacttattaataatagactgaatttctttggggagcagcgagtctccatatatctgggtatgggacagaaggtcacatagcttctatgcattactttttttcctcctggtgatgttccaaggagtagggagctccttggacagtctgtcttatactgtccctaagagtgatatcttcatattcattttccttgttacagattttgtttttcaaatataagagcaaagaaattgtgggttttgagtcttcattccttttaagggcttaggttggttcttcaccaagtctgttggtatcctgttctgatacatacatttttttcttttttttccttctttagaaactttttttttttttcctgttttttggagacagggtcctgctctgtcacccaggctagagtacagtgacattatcatagcttactgtagcctcaaactcctggcctcaagtgatcctcctgccttggtctcccggagtgctgggattacagatgtgagccatgtacctcgctggtgtcctgatataccttcataaatattctgttgtagagggaagaagattgggccaggagttagactacctgggttctgggccacctgtggcctttatgagcttcttttccttatctgcaagatgggcttgaaaatgtctcttctgtcctcttcaccacactgtgtgtgaggatggatagggcagcggattggatagctttggaaaaccaaacagtcctccaacttcactgtgcacctgaagatctcgttaaaaatgcagattctcattcagtcggcctgaggcggggctcaagattctgcatttcttttcttttcttttttttttgagatagagtctctctctgtcgcccaggccagtggcacgatcttgggtcactgcaagcttcgcctcctgggttcacgccattctcctgcctcagcctcccgagtagctgggactacaggcgcccgccaccacgcccggctaattttttgcatttttaatagagacgggtttcaccatgttagccaggatcatctggatctcctggtctcgtgatccgcctgcctcggcctcccaaagaagattctgcatttctaatgagctcccaggtgaagctactgctttgagtccatacaccccactttgagaagccaggttcagtcaaaagcctcatgttgtcaggtgggatattattatccggaggaaagaggcagcccacctcagcacagagcttaccaacactagcgtctctcaaatggctgggatgtggatcccagaggccctggggcagtggggcagggcagggctggctggagtcttgagtatccctggaataccaaacatatggtcattttctgtgtgtactatgaggtgggccattagggaagcgccacacagtcttcacagatctctcgctggttctgtgagatgtggacctgaaggtaggaaagaagggatgtcgggggcaagtgggaggtagaggcggtgagtggtaggtttgagaatacagagggtttcatgggcagaaattcattttctcagatggaacaagctgccctgagggcctgtgtgttctctctgttcccccggaggtcccccctgccgtggcggatggccgtcatcccctcctcctgtgcccatccctcttcctgagctcagagttatgccactgtggttttagttagaaaaatcaagtgttaggcatttatacttgtatacttattagatactgttcttttttgttgcttttcttgttttagaaaacttaaaaaaaactttccaaaatgtgaaaagaatgacatataggtatatttacaaaaaatgcctacatattatttatcatttatcattcgtctttcctcttgttgaatgttagaaagttttcgttttgttcagtgatatagcccaagcctggtgtacagtaggagttcaaaaaatatgtgttggatattcagtgacttgattactgattgcagtgcttattttctcttcatccgctagatgtttattcttttcaagaagaagaacctgttttggatcctcatttggccaagcacttagcgcattttggaattgatatgcttcatatgcatggggtgaggtctccttttgtttctgtttccatcttgcatggggtaggggtggggagacggcaagggaactgcttgatttatttaatatataattcctctaacgtggatcttcattttataggttttagcttttaattgttgcatttacttcttgcatttaattagtagatgttttcttttggttgccagcttagattttttatgctgtaataaaaatggcacctcatcaagtactcttttggtttagttggagtttacttgcaaaattagtctcctttgatgggcagtcgtgtgaatcattctttgttcgcgaaacgcagatggtgtagggagatgacctttaaaattatctgtgaccaacatcactttcattaatttcagggagggaagcaaagctcctaggggatagaacgaataaaccaacacattactgttgatagagaagctctgcttcatttaatactgtgttttcaaattgatgtcatgactatataatatttttcctttaaggaactatttcaatgtgcatttcgttttagccctttccttccaggtcgcctccctctcttcatgttcctattctctttgtctcctctttgtcactcatttttacttttttgtttagttttttctgctcttctttacacctccctcctttttgtttgctgtgttgcattgaatattcccttgaatttagtctccttgcttcttttttgattcctatttgttcttcatcctcctcctatctctttccctttcaatctttctctctttaaaatcttttttttttttttgagatggagtttcgctcttgttgcccaggctggagtgcagtggcgcgatctcagctcactgaaacctccgcctcctgggttcaagcagttctcctgcttcagcctcccgagtagctgggactaaaggcatgtgccaccacacccagctaatttttgtatttttagtagagacggggttttgctatgttgctcaggtgggtctcgaactcctgacttcaggtgatctgcccacctcagcctcccaaagtgttgggattacaggtgtgaaccgctgcgcccggcctctctttaaaatctttttcatgtgtgttttaaaaattgtggtacaatatatataatataaaagctaccattttaactgtttttaagcgtgcagttctctggcattatgtacattcactttgttgtgccaccatcaccgtctctcagtcttttttatttgcattgtttatttctctatgtaattggggaaaaaaatggcagaaacatcctatgctgttagaaataattaacgggacatgacctttgaatgggaatcacatttaaagttgtttttcttcgatgactttgtctcagacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtaagtgccttccatgcagaccagggcacgcggcacctccctgccccatctaggtccagtccactcagtgtgcgctgcgaagcccatctttattgcttcaggacattttgccaccttttctctggcctgccttctacagagactgggtgagaacacttgtcaagtattatggggatcaggtgagataagaagagctttgtggccgggcgcagtgtctaacgcctgtaatctcagcactttgggaggccgaggcgggcagatcacgaggtcaggagttcaagaccagcctgaccaacatgacgaaacccgtctctactaaaaatacaaaaattagccaggggtggtggtgcacgcctgtaattccagctactcaggaggctgaggcaggatcacttgaactcaggaggcagaggttgcagtgagccaagatcatgccactgcactccagcctgggtaacagagcgagaatctgtctcaaaaaaaaaaaaaaaaagagcttcgtaaactcaaaaacaccatacaagggtttgttattagtaatggtttctgctttttgaccatcaccctatgtaccaagaatatattaatcattaatcttcacagcacatctgccaattccctcctatagatgcgctaggagagatccggtggtaggtctggttagtgtctctcttgtgggggactggaatttcctgaaggatttagggctttcattttttgctacttacagtgtggttcatagactagtgcagctccttatactgctggatgtgggccttcaatgagataagtttggaaatcgagagtgagcattgggaaattgtaacaatttgatgttgctgttgtgttttacaagtggcatttcatttttctaataatttcttggaattgtattttttaacttatttttaattattatgggtacataacaggtgtatatatttatggggtatatgtgatattctgatacaggtacgcaatgtgtaataatcacattggggtaattggggtattcatcacctcaagcatttgtcatttctttgtattaggaatattccaatttcactcttttagttattttaaaatatacgacaagttattgttgactgtagtcaccctgttgtgctatcaaatactagatcttgttcattctacttatacttttttacccattaaccatcctaattgtatttttaaaaagcatcatctgtctgagttgaaataaacaaaaaaactgaccctttaccgcagataatttgagaggcactgatttaggtgctccctgactgtgcttgtacaagactgccttcctcctcctacaccgagggggacagcagctatgtctgtggctgttttcttccttgggtgtactgaggacagggagctatagagcccaggggctgtggctggtacactctcaggcagccactgcctacgtgtagagaatcatcctaatgtgttccagaggtaggtttccaccttagtttaagtgcggaagaggacatatatgtgctgaggcaggcaggtgacatgccaggaatagtccaggtcatgttttacccatgtggagttgaaatcctaatggctttaacggcggttcatcaaaagtatgtcacatacccttctctttcctcccttggtgtttggagacatacctcttcttgctgttttctggctttgaaaatttatggtgcattttctatgtctatttttcattttttcatccagccaatagagagtgagttcttttctgctaagcagtgtgctgagtgtgtgggggtcagtggtgaacacaaggacatggtcctcacccccaggcatgaagtaagcaggagatacaggcattaagaaaataatcatagtaacaactgcatgcttataaacatggtacattccatgatggagaaaggagggaggtggtcagagaggagcctatgaagaagggacacacatcctgatgcatgtgcaggaggagtgaagacaggctttatgtttttgagaatttagtatttgaatctctccctagtcttgtttcaagagtcttagaattttatattactaatattttacattctcattctattttctaaacatttactagatatatgagaacatgagcaatgaactattcatacatgtcttcagtcttttcaccctttgaccaaatatcactggattgaaatacttgttcttctcacttctttttcaccagcaggtctaactcagtggagttagattcaggagcagtgtcttcattttgaaagtagaaaaagtgactcagggcctggcatggtggctcatacctgtaaacccagtactttgggaggctgaggcaggaggattacttgaaaccaggagtttgaggccagcctaagcagcaaagttagatcccatccctacaaaaatttaaaaaaaaaaaaaatagccgggcgtggtggtgcacacctgtagtcccagctactcgggaggctgaggtgggaggattgcttgatcccaggagtctgaggttgcagtaagctgtggttgtgccaccgtactcaggctgggcaacagagtgagatcctgtctttaaaaaaataataagaaggccgggtgcagtggctcacgcctgtaatcctagcactttgggaggccgaggtggacagatcacctgagatcaggggtttgagaccagcctggccaacatggtgaaaccccgtctgtactaaaaatacacaaattagccgggcatggtggtgtgtgcctataatcccagctactcaggaggctgaggcaggagaattgcttgagcccaggaggcagaggttgcagtgagccgagattgctctactgcactccagcctgggcaaccgagtgagactctgtctcaagaaaaaaaaaaaaaaaagaaagaaataataataagaaaattaaagaaaggaaagaaaaaaagaaaaatgactcagaaagattaactggcttatgaacagccgtagcataattagggaacttggcctgattccttggtaccctgtctgccatttgaacctagtttacatttcaaaataatttttattgaggattaaatctaaataaactggtatacaaatggaatgacaaccaaggtagattgctagatagcaaaactacatctttttaagaattgctagattacaaacaggaggtataacatctatgaaaattatctagcgtttcttctgcattttaatttaattttgttacaatggaagatttccttcatcagttagaaaagggatatacattgatagcaaaatggacttctctctttttctccctgacctcaggtaccagcaaagtgaacttttctgacatgaaagatttatttttggctgggcatggtggctcatgcctgtaatcccagcactttgggagtctgaggtgggcagatcacttgaggtcaggagtttgagaccagcctggccaacatggcaaaaccccactctactaaaaaattagccaggcgtggtggtgcgtgcctgtgacaccagatactcgggaggctgaggcaggagaattgcttgaagttgggaggcagaggttgcagtgagcccagattgtgccactgtactccatcctgggcgagggagtgagacgctgtcttgaaaaaataaaatttattctctttactcttctatctatcttgccttaaagcataagcctattcattagtgttcatctttccagtgagtttttttttgtcttgtcaagttttgagatgtgattaaaactggatcataagagagctcctgagttcatcatgttatatattgttaggaattcttcagtatagtccctgcatctaaatagtttaactctgaagtttggtttatgtcttgtttgtcctttgaatgggactggcccaaagaagcatgctctgttaattttcctctaggtacataatctgagctacaacttctgagtctgtggacagcaggtgcctagaagtttctagtagttagggaatccaattagaagtcattgccaagtaatagtgtatcatggttctctgctagggtttcattgcaaaaatgctttttctgtttggttattggtactcagttatggaagttaatcgtgtgattgtgtgacataaatgtattcattgaacaaatatttattgagtgtcttttacatgtcagatgctgttcttgtgctggagatgcagtgatttagataaagttgctgccttcatgagatgacattctagtatgtaatctctggaaagacagatactaaacaagatgtattagtctgttctcatgctgctaataaagactgattcactctcacgagaacaggatggaaagacctcctccatgattcagttacctcccacagggtccctcccaccacacatgggaattatgggagctacaattcaagatgagatttgggtggggacacagccaaaccatatcacaagtaaattataaaactgcaaatagtgatgcatgctaagaagaaagtcagtcagaagcagatggtagggagtgaggaagggtgggggcggcccctcttgttttatctgagggtctcgggaggcgacttgtcaacaggcttgagaaggagctgccaagcaaggatctgtgaggcagcatcccaggaaaaagacagcagaaggcatgaccttgagacatgagcaagtctgtcatgccctggggcagcaagagggacaagtggggatgttgtgggctgggggaacacagtggcagatgaggtcagagaagtgggcagagtgggcacatgaagggctggagaaagggatctgcttttggattcttcttcctagagctttcaggcgagagtcaaagacaacggggaaagaacaacacaaagtagagggtgtgaaataggaagtgaatttaagaagtgaaaggagtgattgtgcattatgattggagatcagtgttaaagctggctttgctctgttaggataagcttgccaggagggattatagagtgctccaggggcagtggatgggcagacacagccagcagagtggttccgaacttggcctggtgcctggctgcatgggtccattctgggcctcattactccctccctggtaggctttttttttttttgagatagggtcttgctgtgtcatccaggctgaagtgcagtggtacaatcacggctcactgcagccttgacctcctgggctcaggcaatcctcccaccttagcctctcgagtagctgcaattataggtatgtaccactgcacccagctaatttttaatttttttttgtagagatagggtcttattttgttgtccaggctggtctcaactcttgggttcaagcaatcttcgcccctcggcttccaaaagtactgggattacaggtggcttggagacttttgaagctacctaatgaatttgcatcccaatttctcacctctcaaatgaggataatgataacaacaatctcttcctcatacggttgcaatgaaaactcaacaggctaatataggaagccctccagaaaacggtagctgtcactgctgttaccattattattcattttgagattattggaacaatttttaatgtttttttttttttttttttttaattgatcattcttgggtgtttctcgcagagggggatttggcagggtcacaggacaatagtggagggaaggtcagcagataaacaagtgaacaaaagtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagatagcacagggttgggggtaaggtcacagatcaacaggttcccaaggcagaagaatttttcttagtacagaacaaaatgaaaagtctcccacgtctacctctttctacacagacacggcaaccatccgatttctcaatcttttccccacccttcccccctttctattccacaaaaccgccattgtcatcatggcccgttctcaatgagctgttgggtacacctcccagacggggtggtgccaggcagaggggctcctcacttcccagtaggggcggccgggcagaggcgcccctcacctcccggacggggcggctggctgggcagggggctgaccccccccccacctccctcccggacggggcggctggccgggcagaggggctcctcacttcccagtaggggcggccgggcagaggcgcccctcacctcccggacggggcggctggccaggtggggggctgacccccccacctccctctcggacgaggcggctggctgggcggggggctgacccccccacctccctcccagacggggcggctggccaggtggggggctgatccccaccacctccctcccggacggggcggctggccgggcggggggctgacccccccacctccctcccggacggggcagctggccgggcagaggggctcctcacttcccagtaggggcggccgggcagaggcgcccctcacctcccggacggggcggctggcctggcggggggctgacccccccacctccctgccagacgaggtggctgccgggcagagacgctcctcacttcccagacggggcagttgccgggcggagggtctcctcacttctcagacggggcggccgggcagagacgctcctcacatcccggacggggcggcagggcagaggtgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcagagacactcctcacttcccagacggggtggcggccgggcagaggctgcaatctcagcactttgggaggccaaggcaggctgctgagaggtggatgttgtagcgagccgagatcacgccactgcactccagcctgggcaccattgagcactgagtgaaggagactccgtctgcaatcccggcacctcgggaggccgaggctggcggatcactcgcggttaggggctggagaccggccgggccaacacagcgaaaccccgtctccaccaaaaaaatacgagaaccagtcaggcgtggcggcgcgcgcctacaatcgcaggcagtcggcaggctgaggcaggagaatcaggcagcagtaccgtccagcttcagctcggcatcagagggagaccgtggagagagggagagggagaccgtggggagacggagaggaagagggagagggagagggagagccaatttttaatgttaaagagaaaaattacccaaacacttgttaaagatgataaggcagactttattcaagggggtccatggccataggtataggagcactgcaacagggcctggcaatgggggagacattggactcaactctgattccaacaaggtcaagtggggatttataaacaaggagttgggtggggccaggggatggaaaatcacaaagaagaaacgtcaaggattagctgtttctggctacccagacttaatgggattactgctgaaggcaggccaggctggtcagacagcaaggatgggtgattttcactaaactgacttagcaggatgcttacttaaactggatctacaaggacagagagggaagcccaaggacgggcccagtcaagcagaggcttcagaggagcctgatgatgttttggttaagtcgagtcttgtccctaactgtactgttgtctttatttatttatttttttttgagacagagtcttgctctgtcatccaggctggagtctggtggcatgatcttggctcactgcaacctccacctccagggttcaagtaattctcctgcctcagcctcccaagtagctgggattccaggcacgtgccactgcacctggctattttttgcatttttagtagagatggggttttgctgtgttagctaggctggtcttgaactcctgacctccgatgatccacccgcctcagccttccaaagtgctgggattacaggtatgagccacagcacctggcctctgtaccactgtcatcgaggtggtgattattgtgatggcttagccagtggttcttaactctggttgcgtgttagaatcactcagggaacttttaaaagaaattccaaatcccaggcctcagtctcacgcaatgaaattggaacatttaggggtgcttctggttttgatatatgtaaaagaaactctttgggtgaatctaacttacaacgagggttgagacccactgatagaagcataaacgtttcaggaaggtcatgagtgctggtaggggtagaatctcatgaaaaacttttcttcaggtagattgtttagtttgacaaaggggcaagaaggtcttagcaagaattttgatggcttgttttggttctgttcttcttgcagttgctatgttttaactattgcctctcattttctaggtatgtaggaaaccttcccagaatatttgactactcgcctttagatccaacacaagatttcaacacacagatgtaagtgccagatttgtattttttttttctagaaaaagcatccaataaaatgttcatagtggatatctctgggttgcaaaattaaaggcaattcttcatgtatttttaaaaaagtgttccaaaatgagaatgtgttacttttataagaagataaagttatctacaaaggactgaagaaaatttgaaactggtatcagtatgaagcagaatcaaataaataagttatttgtgtgtaacgcagatcaaatgctccacctaacagcagttgtacttattgatattcatagataaatttaatattactatggaaaaacaacaatgacctttttgtttctgtttctctgtcctggccaggactaagttaggacatggccttctctcaggccagtattcaaagcctccggtgaaatctgaactcattgaacaggtgatgaaggaggagcacaaggtatgtgtccgagcgtttgccatgttgacatgtaggtagggaggagctttagaatgtgggtttcctatgatttggcacatggtggccataaatttagcaagctgtcagaatagtaatgtcatttcagtgtctagggtgcctgtctgtatgctcttaaaaattgtgacaaggaatagccagggttgtgtttatagagacagttgcttcatggattatacatgtgtgccatcattaaccatctttagaaacagtattctttataaaatagagctgagatcgaaggactaaatctcataaaaatataaacattttccctttggtaacacagtctcggcacttacagtgtcttccttctcctaagcctcaactttcttggctagagtttctcaagagtctggttgttaaaaaacaacacacagggtcaggcatggtggctcacacctataatcccggcactttgggaggccgaggtgggtggatcacctgaggttgggagttcgagaccagcctggccaacatggtgaaaccctgtctctactaaaaatacaaaaattagctgggcgtggtggtgcacgcctgtaatcccagttactcaggaagctgaagtgggagaattgcttgaaccaggaggttgcagtgagctgaaactgtgccactgcactccagcctgggcgacagagtaagactccatatcaaacaaacaaacaaacaaaaaacaacacatagattccttagtccctccgtaggactgaggaatcagaatttcaggggagggcttggcattcctcaggtttggtaagctgccgggtggttcttaagcaggctcaagtaggagaaactccgtgggccagtcgttactaattaatagaaccactgaaagataggcttgatgttttaatggccagacctgcatttccactggaccctccctatgctgcttgttgtacaactccagagggtactactcataacttggtctttttgagtggtgcccttggaattgtgtagtgcacagcttacgcatctgtgtttggcaccgtcctctcccgttgccacagatgccctgagtggaacgcgtgccccacttccccgccacctgctctggcttcctagtatcctgtcttgacttactgggcaggctcgttcagttctgtgtctcaagtgtttatcttaaggcagtccttcttagccaatacctgtagactgagagcaagaatcaacagtgaataaataccctcttgttcatcaggaagccagctagttgtggaaatggagcaagcaagagaagggagattgtggaaagaacatatagaggcagccttggggatggggagaaagaagtaggttgtaaagagggtggagagggaaacagacattctgaatggcaagcccaggagaccagaggggtatgggaataggaagaactgaagttctcaagttgcattgttacccagcattgtaagatagcaaggtccttatccaccagaggctggaaggctcccatctgagatacagttgaggaggtggcttgagggtagggctggagtatggggttatccaggcttcttctacttctgtgcttctgtgaaactttgaagaggtgattgtggataaacctcagtccaaaattgtgttatgattggattggttctgcgttctcaaacaggcggtgtcacttcttgcatggctcttctggggcagggtccatgctctgtgctggtggtgaaggagctgggagtcggactcaggagcctggctttcccttctggttctgcaaggagttgtgtgactatgggcaagtcatgccaccttccaatctcaccattcaagtggcagaattgatctaggtggtggtggtgaatgttttaggcccaggagtcccctttctaatgtaaataaaatcatggaccttgcgtgaccgtttctgtgctcttgggatctcctcatttgagaaaatgtgaaatgaaaaatcatcaatttagtgctgtttggaaataaaatttggttttgttaatattacagtgtccttttatgttaaaaaaagtagttcttatatgagcaaggcacactatctatgcagtctacaagtagtatctgtttggagcccttgtctctcttcccccactggattcggtggctgtagtgtagtagctccttacatctccagggtctgaggcttgtaggtgggagccactgctctggatcaaggtatgtgacctggaagcacttgggccatctctgggatgtgttttgcttggtccacacataaaatctaaatttccatcttctcttaaccattcagaacgtctgacagtcccaggcccgcaatgacagctggagccaaggggcagccctcccttcacacaggacacacagtccccagctggctccggtccctttgtgactcatgacctgactgggactctgggtatttggatttgtgacccttgatctagatgacttgtgaaatcctttccagccctcaggtgccacgatctagtggtcttgaagaaagaatcttgattatgagaagcatatatgtgcatctaggcaggggcagggagggcccatccagctgggtgggagacaagtcggtctttggtccagcatcggtaatatttctttaacactcaaatagagctcacattgaccatgattttccttgtggccctgggggtgtccgtttcaagctgttccttgaatagacaaataatttacagcaaaaatctccactttccttgacagtagaaggaattagtttctcaggcatcacgattttcactggcagttggtttcaaaggaaccaatttgtgagactctttccttttctcagttatcagaagccctttggaaggatggtcctgtcccaggcctctggtgtttgtgacttatagatgagcctgaaatgccccaagagagggaaagaagattcactgaaacagagaaggggatagatgatgagaggaatgtatggtgtgggggagagagcatgaaggatgggtcagagccatgtggcagaaacgcctttttacggggccaccaccacgcatggtcttaataactagcatcacatagtgcttgcaaagggccaggctcttcctctatattcactgatgcggaaacggatgcacagaagccttgcccaaagttgcaaagccagtgagtggcagagctgggaattatatcaggcagtttggctctggagtctgtgtttttgatcaccgcattatcctacttccctaacagttgttccaagacttatttcaggctcccagtgcctcagtgtgtggatggtggcaggtggatgacaaaagggggcgtttgaagtttgcagaattaccaggtagcccagttatgagggtttctcactggcgtcttccaagttgagtcatttctagaatatatacttcccagtattaaattaatctgctataaaccaaggttaaatctagctttttatatatgcatgcttaataaacattgtcatgcataaaaaggcagcagtatttatttgtggtaccgccatttttacttaaatatgttgaattgaattttaagattaacttgcacttgcagtagataatagttactataaaagggcatttttttcttcaaaaaatattttctctatctttatgcattctaaggcagtgctttcaaatgttttaaagctgaacactctacctcatttcttcctccaaagataacatatcttaaataactctgtattctgaataagctgcatttcttaagcgacaatttatttgatttctcatctaaataatcctcaacacatacttgctggtctcaacttttcatcaacgtgagataaccagtgttctgcttcaaggtggtataattttagctgtgaacataagagctttgtttcccttaacctctattttcctaggttagacacatgtaacctttctgattcacctttgaaatatgagtaatagttcgggaatgcccctgtcctcttagcttaggagatttggggtttgggcctgggttaaacacttactggttcaaggtttattgtttaaggttaaaaatttaaatcaacagacttcatacacttttgttttagggacaggcagacatgtgtctatcttccttttatcctgtggtttaaaagtatctgtgcaagtattgctgtgatgtgataaaagcctcagtcttgctgcttgcttattaattaaagcattcggctcaggggaatatggtggactgtgtctggctgtctgtgtggtgcactctgttaaacagaaagtcctgtgtaagcatttgggagagattctgaacactgaaggcctccctctaattttagctgatctgttttgcaattgctgatggagaaagtaagtacagtatcttattaatatgacagattccttagttggatgctattttggtgacttcctgggtctctgtgttataaagttagtggtcaggactagccattgcctcaggtgtctgagagccagctctcaagtgagagtgtgtgttccctgaaggcagggccgactcttggtcaagttgggtctctgcctctcatcttgtgaggtgttgggcccataggggacactcaggtgatgtcactggctcattgctaaatgggaaacatgctttctgtaatctaattctttggttcttattttggatttttggtttcttttagggaactgccttgtccagagcctgacctttttttttttttaaaggaaaaattatttaaatttgcatatatatacaaaagtagagagcaaagtataatgaatctctatgtacttgatgtgcagcttcaataatcatcctgcaaatctggttccaccagtttccctaaactcttcactcttctctttcatttcctttctccttttctcattttttctcttcctctccttttccttcccttcagtattttaacataaaatttaaacatcctccttttcacctatagatgtagttatgcatctgtaactataataccttctttcttcttttaacataaatattgtattaaaagtttaaagtgtccagccaggtgtggtggctcacacgtgtaatcccagcactttgagaagctgaggcaggaagactgcttgaaaccaggactttgagaccaacctgggccacacagtaagacccctgtctctagaaaaaataataataaaataattagctgggcacagtggcgtgtgtctgtagtcccagatacttgggaggctgaggtgggaggatcacttgtgcccaagggtttgaggatgcagtgagctgtgattgcaccattgccatccagcctgggcaacagcaaaacttcatctctttaaaaaaagctgtttgaagtgttaaaagcacagcagcaaaattaacaaccatcccttagtatcacgaatacctagtccatcttctgattttttcctgcattatccaagatatctttctaaagtccccctccttttctttttgcaaactattgatttgttgaaggagctggactatttgctttaagtttgctctaaagattgcttccttgaggtattgtttgacttgtgtttggtataaggtcgctagatctggaggcttcatgagattcaggctcaactttttcagagcctgactttctaataactaggtgtgaagtgagcatattaatagttgaccacgggaattagtaagacgtcccctctgaaagcagagagtaggcatggggatgggtgttagcagatgggaccaggtgatgatcaaggcactaagcttgaagtagatgagtttgagctaagatgctctaacccagctgtgaaccccaggaactggtctgcagcatgatgtgaagaggaggaggtagcatctggttagggagctttttcaaataacttctaaatgatcgacaactctcaagcaataacttgactgttgaatagaagattaagaaaagttggttaaggaaaacgaagaaatgaaatggtcacagaagtgtgggaggggaatggctgagaatgggccacagtccaggtatggggctgaatttctagtgtttcccaccatggtctctattgaaacttctccttctggttgtatggccacatgatggcccagagcagcagctagctcttcagaatttactggcttgttaaacttcccagagcggctgcttgctatggtctgtgttggggactggcagccacacaaaacttgaatcacagattataagaaataacactatcagcagcaggcagtgaatgcatgctgatgtgaatgcctaaacagaaatgcacaaatgccaagggatttattccaagtggtgcctccatactcttcaaagtggagaaataactgttggactggcttgtgatgttggccctagagttgtgtaggcttgaagaagggttatgcagactcttgatgtgttgtcttctctttagcagctagtaggatggactcagggacctcagaaatgagatgttggcacatgtataccaaaaacagcataaggacactagagaaagggagtggagagattttttagctttgtgaccctggacttaataactctgtgcctcagtttccccatctgtcaagtggagaaaatcatcatcaccacctcatggggttgggtgagttaagaaaaatatatatgtaaagtgttaagaactgtgcctggcacgtagtcggtattcatccaagcacctgagattttatagctctcagtaaatatctgcttaatgagtacataaatgttagccattatatgaagctagggcattattattgcatgctcgtgtcagctgatactatgtgatatatatcagcactgtgaatgaagaaagtcacaatttttacataggtttcaggaggtgtatatacaggtagtaaaattaattgtcaggtagtaaaattaattgcgctttggctagcgctggaagcacaactgaagccgtgtatgtgtgtaagctggtcatttatatacaggttgttagtccttagatgcccaaatgctgccactttgaggaattctttgagagctaccagtggtgtttcaggtcctctgtggtgttccctaacatttgttatcgatgcgtgtgtatgtctctcatctcctctgttgtccgtaagctcctagaaggcagaatctccaatagtgctctgcatgaagcaggcagtcactaaatactaaatgcccagaccagattatgttttcagcaagacagggaaattcatcagatttttattagaaaacactgcatagaacatgtgtgttggagggatgttatatatggagctgcctctttgtcgcagggagatagataaaggagttttctcatcagctgttgcatatgactgtgattctgcaaacgtgtcatcgtccccagactataggcatggacctccatgagaattcgaggaggtgtaagacatggcctccaccgcaaaggctgcagagacagaccagaagcaggctgaaagttaaagaaggtagaaggcattttgtgctctggacttcagaggagaggaatatggtctgcaagctaagcaaagggaggttttatggaaaagtgggtgggtagcagctacagcctttgcagagaggacataaattacttctttggctcaaatgacaaggtgaggtttgtatgactgagacctaagtgtgcttacttgtttttgctacagacagcctggaactggagttagagccactctggttaggctttgttagctgcatggcagttgggtgttaagaccactttgagttgaaaggcctatctggcacttctctgccagtctcagcttcccgagtgaagataagactagtgtccgctttctagggttactacaagtattaacgagacagtaggtatcaccattagtagatgggctgaacttggaggaaacatttgggaaacagctttatcaggtgcacatctttattgccaaaggtgatgtggaatcttcctacctgcctcttcagagcatcctgggcagatcccctagattccttgtgattttctgtaggttacccgtattaaagagccagttttagtcttcttcattctacctagctcaagagtttcagaaaacagcagtgctgaagcattagtgtcagcatctaattttgttttgttttgttttgtttttggttgtgggggcggtctttgctccacttatttgcctctttccacccgctgctggcccctccatagtcaagggtcaaggggattggagattagagaagtaggcagagtcttttcacttgccaagtgctggtgggctccctctgggctgccacatgtctcctgtcatggctggcttttttgtgggggaacattggtggttctttagagctgcctccccgcaactgttataccaccctcagggaccttacaaggacctttccctgatgctctgtccagctggcctcggcagccgtcacctcctcctgccctgagccttctccactggcagatagcctgcccacttctgtagggtcctgcatggggcatttggctgccttctgagctgtcctgctggtcccccacgaaatccagcatcctcgtcctgccagagttgccctgctgcctgttcttcccccgcagcctttctagcagctgcagccaggtgaggggcaagccctctacaagctcctggaactccctgtgctctggtccagaaacagtatggggtgggctcgtgagcttgagcagctctgcagtgcttcactgggccgtgcaatgccatttttctttcttgtaagtgctccattcttcaggaggggtcctctcctataccctcatggaagggaaggggagatgctgcagagctctcctctcatttatttattcattcatttatttatttattgagatggagttttgctcttgtcgcccaggctggagtgcaatggtgtgatctcggctcactgcaaccttcacctcccgggttcaagcgattttcctgcctcagtctcctgagtagctgggattacatgcacacgccaccatgcccagctaattttttgtatttttaatagagacagggtttcgccatgttggccgggctggtctcaaactcctgacctcaggtgatccacctgcctcggcctcccaaaatgctaggattacaggcatgagccaacacacctggcctctcttttaacttccatcggaaacctctcctcccaagcttgctttgaaatgggctgtgacatttggtcactgcgtagcaagtcctgtgagaatgagccgagtgcctgactttagaaagtgagtactttctaaagtgtgtgtcacctattgtcctagttttaagtaaacaggaagagtctcatcctgtgttcttcataaggttcatagtgcagggcctggcacatagtaaacacccagcgagtattggccactatcattatttaccttctttgggctgtagttttctcatctggaaagtggagtttatggtgggttctgctctgcttgccgcttagggctgttaatttgcatgaaagtatcataagtccatttcatttttatacattagccacagcagaacgggatctctccgcgcatgtttaaggcctttgtaagcaagagccacccggaattctcctctaacaggcagcaagatgcccaggaattcttcttgcacctggtgaatctagtagaggtgagtagtcagtcttcacggatgctcagcggggttgtaagagggtgccgagccactcagtgcagtctgctgtggcttgatcagaatgcctccccactctctttcttcaatctctcctgttaaagctggttcagaatcagatccctggaaactctctgctcagccaacttgatgtgactgctcttcacactccagtttccagacacttgtggatctctgtgcttcttttaacctgtatgtgttataggagtgcttgccagttattccattcacaatttatttttttctggtctttgtgacaaagttccttaagagccctgcgtggtatttggtgtcctcctgccactgctcaaagatgatgagtctgcttacatcagaatcgaatgccattaaaaactttttttttttttttgagactgagtctagctctgttgcccaggctagagtgcagtggcacaatcttggctcactgcaacctctgcctcctgggttcaagcaattctactgcctcagcctcctgagtagctgggattataggagcctgccaccacgcccggctaatttttgtatttttagtagagatggggtttcaccatgttggtcaggctggttttgaactcctgaccttgtgatccacccgcctcggcctcccaaagtgctgggattacaggtgtgagctggaaagccactgagaattcctgagtaaagccttttttttttttcctggttacaacagtgttctttgtggaaaatatagaaaacacaaaggagaacatcaaaatcccccttaatgccacgccctgcagccagccagtgttttttgtttgtttgtttgtttgtttgtttttgtttgtttgtttttgacagagtcttgctcttgtcgcccaggctggagtgcagtggcacgatcttggcccactgcaacctccgccttgcaggttcaagtgattcttctgttgtttgtttccttgttagaactaggctgcagtggtttctcttgtctgcctcagggttactgattcacatgtctgctcaggtccatgatcttttctaactctgtttatcatttattagtgataactttttttttttagaataaagcctcccgagtagctgggattataggcacccactaccatgcctggctaatttttttgtatttttagtagagacggggtttcaccatgttggccaggctggtctcgaactcctgacctcagatgatccacccgcctccgcctcccaaagtgctgggattacaggcatgagccactgtgcccggccaacagccagtgttcacaggttggcatctgcccctcccatcactttccaggtcttatgttaattctctacatgctcttctgtaagcagtgttttcacttaaatgtttgccacatcatcacatctgttaacagagcataatttctgttttatttgtacctaatttacatgagtgtatttatataatcatattgtacatgtttttatgtttccagggcagccctttatttttttccctttctcttttgattggcttctcctcctcctttcttctcattccatgaatttctctcccatggtttttaatttaataatattgaaatagtaatccatgatgaactatattttattttaccaatccccatttttggactttagataaattccagtgtttttctattaaagtgctttggtgaatgggcatggccagaggaaatgtttaataaagccaagtgtttacaccgggtttagagttcattttctactaagtcttagtggctcaatattcatacatttactaacctgatacaatccatccttcagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaagggtaacaattccaaagcgggaaattggtactgtgtgtcttcatatgggaaaaccctcaaatcagagagaatggtttagtcactgaagtgtgtcaggagtagacccagcccaggtgatgtctgctttgcacatctcttttcatctctttgttagttcccatgtgacttttcctttgagaagaatcaaatgcatcacaggttttatggaggcgttatggttggaacctacgtcactgcctataaatttggccaactactgaatatggagtcagcataattttggggaaaattattggtaatgatgtatgtagaaaattctttaacactgtcatttataagttgtgctataaagtctgagggaaatgatcaggactgcattttttaaagttagacattcgagcagaggtctcttgaaataatccagctttggcacatgagtatttgagccacctcttctgggagataaattgtgtcagggttctttgtagaagcaaagcccattagaagggtctctgggctttggaagagagaaggaggcagagatgtggcactcatgtttggtgccttctccttccatcagtctaagctggttcttcctaggcagaatagacaaatggcatttcttcgaattaacatcgtagaagcaaaaaagacaaaatagctgctggattgtgcatctcctgtgaactagtcatttttgtaaagttcagcaattccactatgcagccatgaaaaggaatgagatcatgtcctttgcacatggatgaagctggaagccctcatcctcagcaaactaacacaggaacagaaaccaaacaccgcatattctcactcataagtgcgagttgaacattgagaacatatggacacagggaggggaacatcacacactgaggcctgttggtgggtggggggaaaggggagagaacttagaggacaggtcagtaggtgcagcaaaccgccacggcacacatatacttatgtaacagacctgcacgttctacacatgtatcctggagtttttttgttttttgtttttttttttgagaataaagaaaaaaaaattcagcggttccctggatggccctttttgctctttcttgtgtgtggggggtggtgggtcagtttatgatgttagttggaaagtgatgattatgatgatttaagatgaaacgattttcattttctatatgctcatgcagtttttgatcagtttcaaaatccttttggtgtagaaacaagggaatgggagtctgctgtttgtttccttgttagaactaggctgcagtggtttctcttgtccgcctcagggttactgactcacgtgtctgctcatgtccatgatctttttttaactctgtttatcatttattagtgataactacttttttttttcagaaaggagatttataatttagtctctggaatttgactgttgggaacacctaatgttagcaacctagatataagtacatcataaactgattggggacaggggaatgaattttaaaccatctaagatgtgtttaggaaaacacatatgtgcgtaagtgtacctacaaactgataaataaggagtttttttttttttttttttgagtaatacaaaagaaatgaccagaaaggccattcaaattgacataaaattttgactacaggctagtttccaggaccagatctgctggtgcttgggaggttcctctttttcccttagtatttaatcatttgagtaggaatagcacagaggccttctgggttggtagccctgatgtctgaggtgttgggtaacctccacaggaagttgtctcggcagtgttggttactgtcatgggttgtttgatggtggctaactgcagtcctgtagttatcctcctccttggcctcacagggacccatgtgggacccatgacctctaatcatagttgctggtggaaccaaatcagaaaatgtgtaacactcgatctggctcttgccaggcgcttagtggtggttctgtttttttttttgttttgttttgtttttttctgcctttggttattttattttaaaacagcttaaagttaacaagaatgtttttgttacttttgtgtatgtgtgtgtgatcattggcaaaaattgatccccttacacaatgtaacatctctttctggccttatctgttgggttgtggagggagtgctgatcagagttttaagtccagctttgccaataattggctggttttgactttgggcctcagttcttcagcaaggcagtgaaggactgggaagacgtgagcccttggaccttttctggctgtgaaatactctgatgcgaaggccttgtgttgggaggatggcatttgaataatcccagtattggcctttggacaaaccaggttcatgggcatttatatcacacacatggtctggccctctcacccacccaggccaggccaagctcacacttccctcctgtcagtcgcaaaggggagcatgcaaaaagatgtaaatggcttgataccacctgttggtgcaactctaaagacagccccagaacagcctttcagcaggggcatctggctctgtaaagggcgacaaataagcaactctggcccagcgcagaagccttcagggaagactgtccaaagagggtgcttttcatttccacagggtaagagcgattgcaaggtctttgatttgctctttcacccagatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaagtaagtgtgtgtatatgtggtggcagtggggtgaggaggggccttgaggggtggggacaggggtaagggaaagggggtgggtgttatttgtgtctgtgtgtgtttgttcatgtgtgatggatgggattatggttcacacaccctaactgtcgtcaaacttcacttgtgtgagacctgtccaataaaacaggcctgtgatttatattacgtgctaaggaggggttttcttttttctttttttaaatgtaaggttgtgatttattctctattaggagccttccttccttccttccttcctttctttcttcctttcttccttccttccttcctccttcccttcctcccaaccttgaccccacccccagcccctctcttaccaagaggatacagccaagaaacaatcccctacccgcaaatggcaagaatgacattattcatgaagaaattacaaaaatgctgaagacaggcctccatatttaaactccattgtgctatattttaactccataattaaagacttagtctagaacttggttggctatgtttctccttggagactaggagtctcaggacatctcaaagtggacaggaagtctcctgagcattgttgaaacgagccgctcagggtttagtcagatgtcttgttttcacattgtgaggctggttgtcagacacataaaagtttttttttctccatctgccaccctagttgatttgatgcagtcgagtccttgccaacacacttcatatcactgcacttaattggaaaaagagtgcttgcagtggcataaaacaaagggaggtctgaaagtttggctccaggagttttgctacgttcagatattctttggccatttttctttgaggctaagattgagattttggctaacataaaggggattaaaggatggaacggctggtgtgggctgtttttaccatggcctcaatagcagttcaacctatatatatatatataaaattttatatataaaatgtatatatataaaattttatatatatacatataatatatataagtattatatatatattttagagggagtctcgctctgtcacccaggctggagtgcagtggcatgatcttggctcactgcaacctctgcctcccaagttcaagcaattctcctgtttcagcctcctgagtagctgggaatgcaggcacatgccaccaagcccggctaatttttgtatatttttttttgtttttttttgagacggagttttgcttttgttgcccaggctggagtgcagtggcacaatctctgcttgccacaacctacgcctcccaggttcaagtgattctcctgcctcagcttcccgagtagctgggattacaggcctgtgccaccatgcccggctagttttgtatttttagtagagatggggtttctccatgttggtcaggctggtctcgaactcccaacctcaggtgatcctccctccttggcctcccaaagtgctggattacaggcatgagccaccgcacccagccaatttttgtttttttagtggagacagggtttcactatttagccaggctgatctggaactcctgacctcaggtgatctgccctcctcagcctcccaaagtgctgggattacaggcatgaaccaccatgtccggcctcaacctatattatttgttctctgtgaaacccctccctcaggcttctgctatgtttcagattgtagagttcatatgttaaaaacaggaaagcaaaaacaatttatttcaaaaaggaaaaacaagccatatttgttaaaattatttttaaaaagctccctatccaagggagattaatagtagttcattcaggtatcagttgcccatcactaagtgagtttttatcctaggactgctcagttgtaggtgtgggtggttgtgtgtgtgtatgttgtgtatgtgtgcacatgtgcatgtgcctgtttgtgtccttgcagataacagttgttgagttctcaagttcagtgtgagagataatttattacaactcagagatatctttgggcagttagacctctacacactctattagtgatggaagcaattttttaaaatcattgacagtaggtttaagactgattcctcgaacatttatccttttctctttgtgcttttgttgtgattccattttggaggtggaaggtgattgtggggtctggaagcttcgaaatccccagcatcaggtgtgagctgccgactggggtattgttcacttgcctggccctcggccacccctttctgctcttcagaaaaggggcctggtgtcttagaagtgcaggatgtgacacactgtctgtgcctgcctctccctagaagtgtcctgctaggaagcagccttttcaacacctggaaatggcccatctttaaaatggggactgagaggcattagctttccacagagaggcagattccctgagcccagggctagtggtcaggagacctggattcttctcctgtgtctaccttccacgttagcttctgtcctggggcaaagtcaccgcccagtgattccatctgtaatggagaaatgatgctctcctgaatttctcctcagatgctacaaaatattcagttgtaggcagtgctagcatatctatctagaatcctggaggaggggtttctgcttcctatagttcttacaaggagcttttaccttttcctttttgtctgcatacacacatgctcttgcatgtgccttttatatacatgagaagaattagtactgggtgtatccagttgttagtaattgaaaactggtccttgtgggaaagaaaaagatgatgttaaaggtaataaagcaactatcatttattgcacatttgttattgccaggtcatgtgttaagcacttcccatcaattatcatatttcatcctcttagtagtctgaggtaggtcccattattttctcattttatgaaggaagaaataaaagaagtaattggccagtaagtggcaggcatgggattcattccagtctgattgagttcaaactctaaatgcctgctatcaagcacccccatattccttgtcatgcttgcttatccttacatttttgtagagccttgctttttctgtattatgctttatcatgtttcaaatattagttttgagaaaaccagttcagtggatttctaagagatgttatttttatttccagcaatgtaggctgtgattcagtctatgttttgttaatttggggccttgggtttttcttttgttacacccagagcctgaagaccaggaagaggcaaaaaatgtcctaaagatcttggcggatcttgcatcagtatgggccaggccttaagacccttctcttaaatgatcatgaacagaccatgtctgggaagaatattagtgcttggaaagtttattcacccagcaaatattattgctcacttagtatattctaggcaatgggttgaacaagacctaattcctgccctcagagagctcacagatgaagagttgagagggagagatttttacttacccattctcatttataaagagaaaagcatagtgtggggttgcagagcacagactctaggtagatgcccaatgtttgaatgcccagtctagaacttattggtatgcaaccttggccaagtgatctcactgccataagcccagcttccctatctgtaaactggggataataatggtactttctttacagggttggggtaaggattaagtgagataagccatgtaaagtgcttcacacagggcaaatataggatggagttgttatttctgttatgtttatcttcgtttttttgtctttgatgatataatttgagtgtggtggattaatggtcatattttcaaccagtagacaggaagattatggttttttttagttgttaggttttcaatactgtagacatcttaatgtcttaatgtcaggaagaggtacagtttatatttctttctcaataaaatctttatcgtatttttgccttaattgtgatttagtgaacaatcaatatattttaaataatgctaacaggttgttaacaacaacacagtattgttgttgggacatattctaagcactttatatgtcttaaatcatttaattcccataacagctctttgaagaaaatttgctgtctatctagatctctttgaatgatttacattctaatgatctttatttaaaacatatcatttttcaagaaatattttaattccagaaattaattttagaaataaaagaataagctgagcataatttataactgtgctagatttaactaacttgatgtccccaaactgcaataaatgaatgcaaagcataacttttgagattgatttgaacagatatatattgaacagttactacatgtgagcgattcaacttgagaccctatagagattacaaagatgaataaagaatgttttacccaatagggcaaatattatgtgaacaccatctaaatctactttctggtacttttagattggcggctacctataacacagtgatgtgttaaattatccctgccccaaccttgagttattccactaccgctattatggtattacagctaacactccgcctagatactgaccacagagcagcttcaagagtctcagggatcctgagtcatattttggaaattattggtttaccaatgtcttttggttgatttcactgttatgtattttccagattttaagctaatatggtaggaagagtaggtaagaaaaagaacatttttacattaaaatatcatggccgggtgccgtggctcacatctgtaatcccagcactttgggaggccaaggtgggtggatcacctgaggttaggagtttgagaccagcctggccaacatggtgaaaccccatctctactaaaaatacaaaaattagctgggcatggtggcaggcacctgtaatcccagcgactcaggaggctgaggcaggagaatcacttgaatccgggaggcagaggttgcagtgacccgagatcacgccattgcactccagcctgtgcaacaagagcaaaactctgtctcaaaataataataataataataaatatatatatgtgtgtgtatatatatatatatatgtgtgtatatatatatatatatatgtatatatataaaatatcagacagagtttgttgtttttttggtgcagttgaggacttggtgacatttaaataagaataatgtgtattactgcttctcagaagatagaaaaacctaattagagataatatataatttctggagagtgagcctggctaatagtagattagttgcttgggatgataaagctcctgttttctgaattgcctttattcttctaccaactttgtaatggagaatttgagatacagggaatttaaataacttgcctggaggtaaaatacagataagtgacagttcaattcagcatccaaggctttatagcttttacctctttcatgacaaaataatcatgctaattccttaggtatatacaatactttctagtgcgccaagcggtttcacatcatttcatgaacattgcacggcctggcaggtagacatgattagtaagtccattttgtagatggatcagggagtgtcagtggtttgcccagatttggagtgaatgaagtggcattttcaagacccacatccacatcgtttgactgttttttgccccgtgttctgtccctgcgctgtgccttttctctgacactagggggaagcaatacatttgcatttgttttctaacagaagatgcattacaaatagaaggcagtgacttagatttgaaaagtggaataggggaggatattctagaattttttattttaaaaggtatctgtgatacctataaacagctcattttcttttttacatatacctaccacacccacattgactacaaatagaaatggttgttaaaaacaaaatgataaatgtggagtgaatgagctggaactagggtatgaatttggtgtacaggttgaacagtctgtgtataaaattgccaaatccatgcccaggaaattgagcctttctgaaagtttgaagaggattcaagatactggtaatgtgtattaattttaaacttcaaggcccagattcagattttttggatacttatcccataatatgtctacccctaggatccatgtggccatggattaagtaccgcagtattttaatgaggccctggcatttccaatagtcaacctcagccaaagttgcagtaagcccttcgtccgccaactctgcgctataagacagtgactctgtgtggaagtggaagtggaggtgggggtgtttcaggatcacctggggagacttttcaaaccccacatacatgtataccaagcatgcatgctgtaaacagttaaaactatgtatactaaactctagcaaggatttcagaaaaaataaatggttgaaaagcacttttcagaaatatagaacaccacagcaaagtaaaagtaacaattttgaaacaggtccaaaagcattctttttttttttgagatggagtctcactctgttgcccaggctggagtccagtggcatgatctcagctcactgcatcctttgcctctggggttcaagtgattctcctgcctcagcctcccgagtggggattacaggcgtgccccaatccccactaatttttgtatttttgtgcctggctaatttttgtatttttagtagagacggggtttcaccatgttggccaggctggtcttgaactcctgacctcaggtgatctgcccacctcggcctcccaaagtgctgggattacaggcgtgagccaccgcacctacccaaaagcattcttaaacgataacattctacattaaacattttcttcttgtgaagaggccaggacaaatgagcaggggagagcgaatgtgtgtccacttacatgtctgtgtttgcatgttcctcctcttcagttcagccattggaatggccaggtgtgcctcagacaaagttgatatgctttttgaactgtattcacaattcttattgccttgtttcattgatatatccccttgtgtttcccagaacatctcgctttgcttcattccctgaatacttggtagtgcagataaagaagttcacttttggtcttgactgggttcccaaaaaatttggtaggtatcttttgcgtgcttttgcttaaaacatcaaatgagccatttaaacaacatggcatgtgaaagagcccatgtagttggctgccacaaacagttccatttcattccatcattctcacctttctgttttgaatcagagtatatgataagaactgacaataaaaattgccatctgcttacccacccctccagttatggtttctggaatgaccaaattctaagagtgtaaacagaatcctcacattgtcaaataaacagtgctttccaaactttaatgtgcatatgaattatctgggatcttggttaaaatgcagatgcagattgggcaggtctggagtgggcctgtgattctgtgtttctaacaagctcccacgtgatgctgatgctgttggtgctgctggcccacaggccacactttgagcagccagtggttgaagatgcagtctcctcataggatctctcctctgcctctgagcaggcaggtgtggctaatgacattcacttaataaagtagaaaaaaagccagttgcattagacagtaaaacaaaaggatgtgattttggcttcatgaggctttcttcgtgctaatttttaaagttcctgaccattgttagaggttaattttccagacgatacataaaagcctttctccagcattaagatctaatacaaagggtgttactaggttgtcctcagtggtgtggaagaatgtacagtttctcaagcaagaaccttggactatttgccagtcttttaaagtttttatgtttttaagtacttaagaaaaaacccaactcaatcttacgctggttaactaagcactcgtctgaaggggataggtaaaaaggatgtagaatcggctggagtgatttcctagagacctccggcactaacagttacgcagcacttgtttgccacgtgaaattgtgctgggctgttactgatcctgcaggagatcctcccttttcctggcagaatagttttgtgagcaggggaaggcagagggcaggatgctgaccactcagcttttcttccatggacctgaaaagcacctgagagaaaaaactttctggctctgaaggctttgaattgccttggaaatagtttgcttattttatttgtccttggaatttctgtaaaggaatacaaaatttgaatcatatttcattgacttgctgaattttaaggaacctcaaaatgttcttgaatgaacctgaatttttctcttaaggagcagttgtattgattttgatggtgagtttttatgtttggttttgctgccccctgaaatttaaatttgcttttttaaactaagctttgttctttgggttgttgttttaaagtaggatttatgtacctggtatcataactgattttggggacagtattttcaggttgtttgctagcccaaaagatgtatcctgtaccaatatttgaacccatttttcattattatcatctgaatatgtgcagcactaaatcttgacagggtattagtctgacaaattttgtatttgaataagtcaacacaataacagagccaagaagttaaaaaaagtactgtaaagataatacacttgagattcaattaatttctttaaaacttcattatttattcaatatcttagttagaatatccacagtacccatcatgatctgagaacgggttgcatcatcaaatggggttgcaaactcaaatgcctaacaaggacagggtaatctaaatgaaagaactgggctgagtataggaggcttgtagctagctatcttggtcttgcttgggtgttcccactttgaataaaaagatgaactagaaaaactgccataagactcagagtagcacaaatatgatgctcagggagcaacaaggagcagtggggtctgtgtcagactaacattgcaccattgtctagggtagaaactgaagatcagctcccgatggttgttaccatatgagaatgtgctacagctttatgcttttcaaaataagctggaaatctggattttaccttaaatcttctgatttaaacattggaatttgttgtccacacttttaaaatatcaaacagattgtgtctgggccacacatggtctatgggctgccaatttgtaacctcaggcttaaatgatttgctcttgtttggggtgaaatcctgccacccactgtatttttccctgggttctccactaatatctggttagtcttcatgaacctgctggtcgagcaacatattctagggaattgaaaaacatcccttagctctgtctagacacatgcatgtagagttatagtgctggtattataataaggtgattatggagagcccagtggatataatctctctcattttgcagatgtttctattgatatgccagacctacttgatatcaaccatctccgagccagggggttacagccaggagaggaagaacttccagacatcagcccccccatagtcattcctgatgactcaaaaggtaccatctcctgccaggagaatatgcgctaccctcccaccctgttctataggaacagtctctttcttccaccactgtgttgctgctaccaccaccacccattggtggtctagctgccttgctgtgatgtaacccaccaccgacacaggagggaggcatggctgcaatggtaaacataaaatagacattgtaagaggcacagacccatcatgtgtggttgaaatggacagtttttttttgtaggctcttagtctagggaagctgtgtcattcttgggagtacctttggacaacctaaaggggaaattgaacagcgtgagttggttttaaaactgtgatggcatctcacctccccagcttttttactgcatcatagaaaggaagagatttgagtttctctttgactctgtgaccccatcactggtcattgttcagaacacataacatttttttttttttgaggtggagccttgctctgttgcccaggctggagtgcagtggcacgatctcggctcactgcaacctccacctcctgggttcaagcaattctcctgcctcagcctcacgagtagctgggactacaggcgcgtgccaccatgcctgcttaattttttttttgtagtattagtagagatggggtttcaccttgtgagcgaggatggtctcgatctcctgacctcgtgatctgcccgcctcagcctcccaaagtgttgggattacaggcgtgagccactgtgcccagcctcataactttttaatggaaaaggatatgccaaaaatagttgtctcacctttgtgagttcaaaaacagtgtcagaaaaatcttggtttaactattagctcagttatcctgatgaaatcagtttcattctggctttgtttgctcacctgtttactgtttatcttcctaatgagtagattaactcataacgacagagcactctgggaccctctgctaaaggttttccatcagttaagcagtgaaggtgaccatggtcaggtataaaggaagggtaagatgagtctagaaggagcaagataggattcagataggcatctgtattatgttgttctctaacgctgggtcaaatgctaaattatagagaaagagcagagaagggacattctaggtcacgtagtacaggtggttcattaaaggggtcaaagaaggatcagcatgggcatcagataaatacaagatggtttattagtactgctccagctctctctgatgttcataatagaatctttggtttgtagttatacagagatcttagaaatacagagagggccaggcgcggtggctcacatgtataatcccagcacttggggaggccaaggcgggcagatcacgaagtcaggagattaagaccatcctggccaacatggtgaaacctcacctctactaaaaatacgaaagttcactgggcgtggccacacttgcctgtaatcccagctactcaggaggctgaggcaagagaatcgcttgaaccagggagtcgagccgagattgcgccactgcattccagcctggcggcagagcgagaccctgtctcaaaaaaacaaacaaacaaacaaacaaacaaacaaacaaaaaatacagagagaggctgggcgcagtggtgcatgcctgtaatcccagccctttgggaggctgaggtgggaggatcacttgagcccaggaatttgaaaccaacctggtcagcatagtgagacactgtctctacaaaaaataaaaaatttaaaagtttgccaggcgtggtgactggtgacatgtgcctgtagttccagctactcagtaggctaagccaggaggatcacctgagcccaggaggtcgaggctgcagtgagccatgattgctgtaccaccctctgggtctgggcaacagagtcagacactgtctccaaaaaaaagttttttttaaagaaaaaataatagagacataatagggaaatagtagtttgttaggataataatcaaagcatcatgttttaactaacctaaacgcctgaaagctattactttctcttattactgaggctggggtggtctgcgtgtggttgagggattgacaacagtgtgtggtccccaggagtggggagggcattggaaatgccctggatcaatgggttttcttttttctaaaactcctcaacatggtttggtctcattttctgtcctctcccttaatttccagatcgcctgatgaaccaattgatagaccgtatgtatctttaaaaatgtttctcaatgtcctactgttgttattaatctgatgaatttgtctgtgaaagttcagtaaagaggcattgttctgtacgtgtgtgtgtgcagcttttcccaggtgggaacggctctgtgtctgctagtcagtgacatgctgatcaggtggcccatggggctcaggagagtgaccattagcatgaagctaactagccctgggtcagaatcttggcctgtggtttatgactgtgtgacctggagtaatttacttaccttctctgagccccagtttcctcatgtgtgaatggggctagccatggctactgagtagacctctttgtgcaatggtggcacagtggtcagtcactttttcctatcctgctgtcagacacataatgaagacacatagctgacaggacacaatagtgttaattaatgctctcaaggatattagtttgattggattgtttgttaattttatagccttttagttcctaatcctgtgggagttgatactcttggttttctacaaagaacataaaaaataaacgatagacaatatttagatattaactaggagaaagagaaagcatttaacactagatactctaaatcttttggtctgtaaagtctttcaagacagtaactaatattaatttaggaatctgaatcttacacattgcgaatgattgatcatgtagcttagacctctatgtctcctttcttgaaacaattatgttttgccgattgttagaggagtaattagagtcagcaagggtcagcctgccatgatcttcacatgcaacctggtaggacaatgggtagcctgggacatactgttcccactgcgaataatctaattgtaatagccactgctaaagtttttgaatgcttaccatggatcatttagcatttattgttccataaattctttcaacggtctacaactctactttttataaaacaaggtcccagatctcactgggacaggtctacaactctactttttataaaaaaggtcccatatcatggtaggaagggcaaagcaggtgacattttatagaggatcaaacttcctagatctaggaagttttggagaccgaagacctgggaccagaactagggctaggagttaccttgcttctcatgccactagactatcctggcatgtgagaggtttgctggttgcgcctgatgctgtggagagctggcctgcaggatctcactccatgggaagtgatgggcatttggaattaactgtgccagaggagcctgcctctgacggtgagagcatgcagccattttttagtgttgctgatttggccatttatttcctcctggatctaagcatgctgtcttaccaacaatcaggagaaaataaaactatctgtcatgaactgacatttgcatcctacctttcttaaattttttttttttttgagacggagtcttgctctatcacccaggctggagtgcagtggcgcgatctcggctcactgcaagctccgcctcccgggttcacgccattctcctgcctcagcctcccgagtagctgggactacaggcgcctgccaccacaaccggctcattttttgtatttttagtagagacggggttttaccgtgttagccaggatggtctccatctcctgacctcgtgatccacccgcctcggcctcccaacgtgctgggattacacacgtgagccaccgcgcccggcccttaaaatttttaaaagaataactttattttctcattacaaaagtaaaaagtcatttagagattatggagtaggcagaagaatcatccatggttccatcacccatctataaccactgttgacatttggagtatatccttctattattgtgcctggctcactttatttttcacaaaaatggaattacacatttctttttttttgagacggagtgtcactctgtcacccaggctggagtacagtggcacagcctcggcccactgcaacctctgcctcccgggttcaagcaattcttctgcctcagcctcccgagtagctgggactacaggtgtgcaccaccacgcctggctaattttttgtatttttagtagagatggggtttcaccatgttagctaggctggtctcgaactcctgacctcgtcatctgcccgccttggcctcccaaagtgctgggattacaggcgtgagccaccgcgcccagccggaattatgtatttctggtctaatattataaacatgtatgtttgagattatatctctatctatatatcttttaagactaaagtcttaaaagttgttgaaaggtgccctgcagagtttcatagtttctttactataggattctttattacagaacttttgagtcttcactgtgctaatgcacatcatgaatttctaaggagaggatagactatgtaggtttaaaaacttatctgatcacagaaactccgtttttgattcaatggttacatctcttagaatactaggatcctgtagaacacaatttgggaatcactgttgtccaacattattgttttctgaacatttgacctggataggatgttctatgtatcttccttgtaagagagcactttggtaaatgcattttttttttgagacggagtctcactctgtcaccaggttggagtgccgtggcgcgatctcagcccactgcaacctctgcctcccgggttcaagcgattctcctgccttagcctcccaggtagctgggactacaggtgcacgccaccacccccagctaacttttgtatttttagtagagatggggtttcaccatgttggccaggatggtctccatctcttgaccttgtgatccacctgcctcggcctcccaaagagctgggattacaggcgtgagccactgcacccacctggtaaatgcattttcaatacaaaatttttgtagaacagctatttctcttctcggttcttttcctgattgacagaaaattgacagaagttttagtagagtcctcaggacatggaaaacccaagggatatattttatattcctgttttttctcctcttttggtgtaatttgagaacagtgtgtatgtgtatgtatctatacatacacacagatttacacatacatctctatcagtatctatatgttattaacacaagaaaacaaaagcctctgtatctgagcccaagttactttgtaaagccgtctcttaatgtttttttttttttttttttgagacggagtctcactctttcgcccaggctggactgcagtggcgctatcccggctcactgcaagctccgcctcctgagttcatgccattctcctgcctcagcctcccgagtagctgggattacaggtgcccaccaccacgcccggctaattttttgtatttttagtagagacggggtttcaccgtgttagccaggatggtctcgatctcctgacctcataatccgcccgcctcggcctcccaaagtgctgggattacaggcgtgagccaccacgcctggcctcttaatgttttaagcttgtataattaaaaaacgaactttttccttctatacttaacatttgcactctccgttttccagagctgcttgcttcctgtgattgccagatgtatctataggcctgcagtaactttctgtgaggtttaaggaacaggcttttaggcctgtagatagagctttctgttcaagtttcagtcataggagaggctgtcatagaggtcttgagaatgctctgaaatcgttctgggaatacactaaatctccccatatgaaattagagaatcgtttttcattgcttgcattgtccaggtaattaacctggttcctatgtgggtcaaagatataaacttagcccaaatagctttaatatttgtgtggcttaaaacaaaactaaacaaagtaaaaccattatctacacccaacagaatagcactttctttgggtagcatgtggataggagagtggagagtagctaagacaagaagcgacagtttcctctttcacactagaatatcctgttgtgctctgtagcatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccaggtaggtggcgagaaaatggaatggctttggagtctgatgtgaccctcagtgatgctgagtcctggtccttccaaggtccctgtggatgtatccctagaaaatgactttatagttcctaatctcctgcagtggaggagaaagccagtctttttcttcttctttttttttttaaaaacagcagctttaggccaggcgtgggggctcatgcctgtaatcccagcactttgggaggccaaggcaggcggatcacgaagtcaagagatgaagaccatcctggccaacatagtgaaaccccatctctactaaagatacaaaaattagctgggcatggtggtgcgtacctgtagtcccagctactcaggaggctgaggcaggagaatcgcttgaacgcaggaggcggaggctgcagtgagccaagattgcaccactgcactctggcctgagtgacagagcgagactctgtctcaaaaaaacaaacaaacaaaaaaacaacaaaaaaaaccccaaacagctttattgagatataattcatccctttaaagtgtataagtcagtggcaaaaagaccaatagaaagatacgggatatacttctaactaagcgatgatgaaaatttgaaatggaaacatgggcatgaagaaatggaggatgtttagttagctttttcttttatctactttattaagctataatgcatatattcatctgtttaaagtgtacatttcaatggtttttcataaattcacagttgtgtaaccattaccactatcaaattttagaacattttgtacccttcaaaagaaatctcatacataatagcagtcactccccattttcctgctcaccccagcccctggcaaccacgaatctgttttctggatcaagggatttgcctgttttggacatttcatataaatggagtcatataataaaaggtcgtttgtgtttggtttctatcacttagcatagtgctttcaagattcatctatgttgtagcatgtgtcagtacttcattcctttttacggtaaaataatagtctgttgggtcgggtttggtggcttacgcctgtaatcccagcactttggaaggccaaggcaggaggatcatttgaggtcaagagttcaagaccagcctggccaacatggtgaaaccccatctctattaaaaatgcaaaaattgtctgggcatggtggcgggcacctggagtctcagctacttgggagactgaggcaggagaattgcttgagcccaggagacggaggttgcagtgagctgagatcacgccactgccctccagcctgggcaacagagtgagactccatctaaaataataataataataacaataataatagtctattttatgggtatactatattttattaatctttatcagttcatggacatttgggttatttacattttttggcttttatgaacaatgctgctataaacattttttacaagtttttgtgtggatggacatttatttttacttctcttgagtggaattgccatgtcatatggtaactctatatttaattttgaggaacgaccaaactgttttacacagtggctgaaccattttacatttccaccagtaatgaatgtgagttccaatttctccatatcatcactaacccttattattatcttttttatcatacccatcccagtgggtatgaagtggtatcttgtggttttggtttgcattttcctaatgactaatgatgttgaacaacttttcgtatgtttattgactgtatatcttatttggagatatgtctattcaaattctttgcccatttctaatgaagttatccttttattattgagttctaagagttctttacaaattccagatacgagtttctatgagatatatgatttgtgttttcccccccattctggtgttttttcactttcttgatggtatcctttgaagcacaaacatttttaattttgatgatgtccaatttatcttttttttcttttatcacttgtgctttttgtgttgtaaataagaaaccattgcctaatccaatggcaaagacttactcctgtgttttcttctaagattattatagttttagctcctatatttaggtcaatgagccattttgagttaattttgtgtatgatgtgaggtgagggtctgactttattcttttgtatgtggatatccagttgtcccagcatcatttgttgaaaataatgtcctttccccactgaatggtcttgttgaaaatcagttaaccacaggtatatggttttatttctggaatctcaattctatttaatcgatccatatgtctgcctatataccagtaccagactgtctttttttttgagacagagccttgctctcttgcccaggctggagtgcagtggtgcaatctcagctcactgcaacctccgcctcttgggttcaagcgattcttgtgcctcagcctcccaagtagctggattacaggtgtgcaccaccatgccctgctaatttttgtatttttagtagagacaggattttgccatgttggccaggctggccacgaactcctgacctcaggcgatccactcgccttggcctcccaaagtgctgggattacaggcatgagccactgcgcctggcccagactgtcttgattattataactttgtagaatcatgtttttccttgttagtgttgtttcaggacaaaaaaaaaaaaaaaaaaaggaaaagacttgggtgtggttatttttctcagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacggtgagcatgagagactgtgtgtgtgtgtgtgtgtgtgtgtgtgtgtgaatttatttctgtagcagttgagactttccaatgtactttgatcattttgattcatgtttgattcatctaactgtgaatctcatcatagcccataaagatttatttgcatattataaatataaagctaaaatgaatgattttcacacagcgaatgagataaataaatctggggtaatatgagcaaactgaaagaaacttgatatcatcttgaatgtttgttaacagggggtcagaaatttgacttggaggctgcttgtggccctagaggaaagagggatgcatgaaattccatgttcagtaagaagtcctttaggagatagaatgcttttctgataccaagaccttgggtaaatgtctcttaaaagtcctcatagaaaactgaatggctccttggaattctctgctgctgtttctctctgcagaaagagaaggttcttctggtagccatgaacttcttgataccaagaaacaagggactctgaaactacagggtagacaattcccttctgcagtgctgatatctgtttaatcttgagggaaggtacttaaaaaacaaaacaaaacccatccttcctggtcacaccataatccatttttgagtagatatctgctctcaattacttcttgcctatcctgatggggtgcctgctaggatccgttgctgaggtcacagtggctcttgattgtctcatgaggatgtggctaggacaacctgtctccctttaagatgattaaaatatctcaaccagagtttgttttacttggggtactttcttgtgctccactcattttatttgcctgactgtttcattagaggttttatatctatacaaattctttaacctgccagaaatatcacaagctgagaaagatggaaatatttttatggtcaattagtttgaagtacatggagttcagtttaaacaattatacttaactaatcagtgttgttgtcattaatcaagatattaatcttgtctttactggaattcaaacattttaccaacattccaggagagaaggctctaacataataccacactggcatccctctattgttcagttatctgcagaaaatacagttggtagagaaggtagtgtgtgcaattaaagtggctttagaaagagctgcacttaaacaaatgccatacccttggttattccacacctattattatcagcatcttcctgcagaaaagctgagctaacattgatataaactttggaatgctgatctgctgcttagaactcttttccagtgaatccaattacagatgtcagctgggagacttgcagaatgccatgccaactgaacgtgcctgtcatgcggagtcagagcttcttactcagtggcacttaggactaattaattcagacctccttccctatctgcctgacatctagttgaaatggtcaggacatagtgaggcctgaggctgcatgcattgtaaaaacatctgtttcttttttgttgttagaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaagtaagttcttgccttagaggctgtctgagcagtcagaactatacgttcagctcatgcccttccctcccaccacaacatagtcaagcctttgccatcattcaaaagttagcacagatcccatcttcttcgttttttttttttttcttttttgagacagagtctcacactgttgccaggctggtgtgctgtggcgcgatctcggctcactgcaacctccgcctcccaggttcaagccattctcctgcttcagcctcccgagtagctgggattacaggcatgtgccaccacacccagctaatttttgtatttttagtagagacggggattcaccatgttggcctggctggtcttgatctcctgacctcgtgatatgcctgtctcggcctcccaaagtgctgggattacaggcatgagccaccatgcctggccagatcccatcttcttagaaatggtgcagtttgccactttgcataggccccggtgatctgataaagtcatgtcagaatcatgttgcttggtcatgtttgtgcccaagtttagggccaactttgattttgtctgttcctttgaggtaaaatttcttcatggaccatgggagcttttgtcaaaaagagaacatttgttttcatggtagtgttttttgagtagtagcaaagtggtctcatccttgatcatatcgttacccgtaccaactactaataatatcctgaaggggtgtctcaggatgacaggaagaggcgccataggccgttgttctgccttttaatagcaaacacttatgtatgtcactatgtgccaggcactgttctaagcactttgcatatcaacactcatgtaattctcactacaactgattttacaggtgagaaaatataagcatagagagcttgggtaccttgccaaaggccacacagctcttaagagatggagccaagattcaaacccagaatccttgttcttaacctttgtgatatcctgtttcttgggctgtcattgcctgtagaataacattcaggctctttagcttggcattcagcacctcctccagtcagatccaggccacctggtctcccagtgtcacttctatactccctatacctgcagctgagatgcctgggactgtagccacactcttagcctactcagctgtcaacaactctcttctcacttaacctgcagactcaggttaacccctatttgtgaaatgagccttctctcccatcactgcacactaaaattctcatcattatttagaacttggccacagattccatttctctggactgccttcctagatccttgtcataatcagctcatgcttacctcatatgctagcaataattataccagtatgaaaaatactcccatttgtgccatctttaatcctcacagtaaccttatgaggtacataccattattatccccattttacaggtgaagaacctgagatagagaaggctaagtaatagcttgtcaaggtctcatagctagtgatggatagaaccacaattccagtgcaggcagtctgcctccagagcctgtgcctgtagccactgtaatgcattgttagttttttttggttttttttttttttgagacagagtctcactccatcacccaggctggagtgcagtggcacgatcttggctcactgcaacctccacctcccaggttcaagcgattctcctgcttcagcctcccgagtagctggaattacaggtttgggccaccacgctcccttgttagttcttctgttgttggaggtatcaagttgatcttgcaataaaattacttctgtaggtatttgtgtctcccatttgactaggagcttgcccagggcagaggccatttggcttttataaaactcatggtgtctagcatggtgctagacacatagaaagtactgagtaaataacagttgtatttaactaaatctacactagcagcatttgttcctataatcatatagtggcagatttactcattaatgttctttccagacctaacatgtacgtattcatatacagatagaaagagacggtgggagggaactgtcttcttcttttttttaatataaaataggaatttcatcactgaaactgtttcaatgccaactggataagaaaggatgagatgtcgttctcccaatttccatactcatttaaagtatctggtattacttttcagaaattactagcttgcctaaaatatttaaagctgtaacagacaggttactcaataatgtatgagcaggatttatcacttattacacatccatcagttcactgcttcattgattttccataatgggcatttccttggagaggatgagtccctgcggaaggaattaaccacaagatggggctgttgtaaagctgccaaggtttggctgcagagggaaggcgggtctgatctttagggtttcctttcttctgatggagctcggaggcagcagccactctctcacagatggtcagtaatgataaagaacagccacatcatctcctcagggcttactctacctcagagtgatctgtagatattcctgccactgctggattttgaggtgcatccttgaataggatgctgccaggtaccctttaaggcactatgggtcaaccaagggattgagggtgagagtagcgaaggagcactatgagatgcacttagaaatcgcatgcaagatatgcaggatataaaggcagtagtagatgaaacatttaattatgaagacagaaaacagaaacctaatttgccaaatgcattttgagtttgattttacagaaccacaaatgttttcaaagtagcttccccagcactgtgcctggcccatggtgagtgatcagcaaataactgattgaatgaagaattaagtgaatgccaggaggtaatagactttgatagcatttttgctgcttccacaaagttctatatagaggggttggcagtatactactatgttacattgcatgaatcaaagggaggggaaaacatgacttcctgtactttactatattagcacacaaactcatattgtgagttgttgctttctttttcctttgtaaaaaaattaacacttatattgaaggatatatattaattttagcaacttaaggaaatatagatatatgaaaagacaaaattaaaaattacaatcttactccccggcaataatgacaaaataatgttttgtttatattctctagacctttttagacaaatgtataaaaatgaatataaatctaaggttgtttaaatataacattctattctatatatacattgctattttgtgacttgcttttcctttaatgtaattaacatgtgattaacatgtgatgaggctatgattagcctgtgagttatgtaggtgtacatgtatatacatctatattgttgaacatatattaacaatattctattataaacatgtaccatagtttatatacctaattctaggttaattaggtatcatttaaataaaagaccacattattacagaaagagtttcaaataatgaagatatttccacattcagaagatgaccactatgatttttaaataatgaggtttttttgagacagagttttgctctgttccccaggctggagtgcagtggcatgatcttggctcattgcagcctttgcctcctgggttcaagtgattctcatgcctcagcctctcgagtaactggcattacaggcatgcaccatcatacctggctaattttttgtatttttagtagagacggaatttcgccatgttgcccaggctggtctccaactcctgagctcaggcagtctgcccacctctgcctctcgaagtgttaggattacaggtgtgagccactgcgcctggccaaataatgagtttcttaaaggatgaattcaattcacagaagtacagcatatgcctaatgtaatccctatccagggaataaaagcttgttcagcattttcctccttccatcccttccttctttccttcttctactaaaaataatattgtgataaacagccttgggccttcatttgattatttgttaagggaagtttctggaagggaagtttgtgagtgaaaaatacatatttttaaggttttaatgcagattaccatcacgtgactctccacaaacacagcagggggccacatcctggtcacactggtgactttccggtttccccaacgttccccagcagtgcttttggttgagtgctttttatattttttgtatctttattgcctagttatttttcttctcgtgttaacagcttatttcctttggccagtttcccacttttattgaggttgtcagctttcttttattgatttttatgagagtttcatgtactgtagattagtttgggaatacctgatcactttacaatattgagtttttctagccagaaacatatgcttctcctttgatttattcgccccttttctaactcttgcaaagctgtatggttttcttcataaatatgctaggcatttctagtttagttatatctcgaaattacattttcactgttacttatgaatacaaattttccccattgtatattaaacattgctgctaaattatataaaggtaccgattttgtaattggccattctctaggggtttgactggcattacattaaatttataggttaacctgggaagatgtgtgttctgtttagctaggttgtttaaattcccaagtcatttctttttactttttctggttggtgaattgactgaggtatatgacttgagaattttttttttttttgagatggagtctcgctctgtcgccaggctggagtgcagtggcgccatctcagcaaactgcaacctccaactccctggttcaagctattctcctgcctcagcctctggagtagctaggattacaggcacgcgccaccacacccagctaatttttatactgtttttagtacagatggggtttcaccatgttggccaggatggtctccatttcccgaccttgtgatctgcctgccttggcctcccaaagtgctgggattacaggtgtgagccactgcacccagctgagaatattgaatacaattaaagagtaggggtaattggtgtttgaggaaccaaaacaaacaaaataaaaacaacttcagttttcagggttttaagtggcaagaagtccaagacaaatctgtctaagcaaaaagggaaatattttctcatgaaagctggcaagtcctgggggcactgggctgcaggcctgccgtgattcaggactcaaatccttttagctggatgggccccttggctctgcttcctctaggttggttccagtcccagacaggctctccctaatggcacaagatggctgcagcgcctcccacaactatatctttccaggttaaaatctagctaagtcttgtcccagagttctcagcaaaggtcctgagagcctgagactctgtgagactccgttatgtgccctgtcctactccaagtcactgaggcaggttgattcaggcctgcattatgggcctcactcctagaacctgagggtggagacatcttccatcctctcacctgagctgagaagggacaggttgatctccttcaagcactggttcaagtgtggttcggactaatagaatcacctgagaacttgttaggactgatgttgccccacttcagacctgctgaattaggaactctgggtgaggcccagtaatctgtgttttaacaggacatccaggtgattctgatgcagcttaaacttgagaattaccaccttaaaagcagtgttaggttactgttgctttaagaaggagggtcgtggctactgggactttgtcacaccaggttaacactgaaataataaggtaggtgttatgaagtggaaaaaagctattattacaagggtagggattaaagaagtacaggtatcaaatttttccttttaggaatatgttaattaaaaatcactgtttccatttttctgaatgtggaagtaatgctactgcatgaaacgattatctaaatggcgtctaatttgtttaaaaaggttagtgctattaacacttgatgaaatagtggctgtcatttcctgaatgcctcctctgtgccaggcacttccttgaccacttttccttcactgcttatagggaggtattctgatgaggaagtggtgacaaagctaagtggtttgctagtggtagaaccaggttagaattcaggcctgtttgattttgaaggctgtgcagtttttcctttatccccgattgagtcatcttatttcacattttgtattggaatggagacgagagtctattttctaccatgttctgcacattttagggctagcacctaactttctgttgagttttttaaaactttaaagctagaaatcaggccgtcactctgacctatcggggcttctgctatgtgcaaaatcatttctgttttcatgtttcacttaatgagcatttaatttttcttaagaaaagaactcactgattgccaatgaaattaacatgtgattaggctgtgattactcagagcctgctctggctccttcagccactttggtgtaatggtttagatgtctccgatgctgctgagattttccaggcagggagcagagaggcgttcatttgcataacgctggggttcctgaggtgctgagctccctgaggaatgccacccagaagaggatctagggggcaaaaggtacagctccccagggaagctaagccccagtggtcgactggaaagtcacatagacacttcatgccactggtgctaattctcctcccacttagcacttgttgcagttcctaattttttcagcggtgctgttgaaagttaagaggcagccactcttgagtaaactgatttacactgaaggataaatgatggagaactattagacttggaaggaagtgtttgcctttcggagcattcggcattgtaaccgagagactggtaatttggagctggctagggttgggggaagcaattcgtagaccctttacaattctgttgctatcagctgccttccgatgttattgatttacctaggtctgtcttctctttttgagaattcagaaatttctgaaagctccaaatactcctccctcccacactgttttttctcagagagggcatgaggggaaatcaagctgttggagagattgaacttgttgtatattgcgcctgatatactttggatgtttgtcccctccaaatctcatgttgatatgcaaactgcagtgttggaggtgggacctggtgggaggtgtttgggtcatgggagtggatccctcatgaataccttgtgggggaaaagcatatcccagataaatacccagatattgggtgcttatgaggcaaatgttagtaagttggcaattttatttcccccgctttgtacagagggagttagagataggcaatgacacaaattaatcaagtaaagagcattggatgagaacccagtttttctcaccagaggactgctgtgcctctggggtcttggtagttattttagggagtgttttgatgtctctgtgttctgagcactctctgtagactaactaaataatgcgtcatgccctgatgagatactgctgctttgtaaatattttagatgctataatggcttataaaattaaattcatttaaagacacttctgaatccagagttgcttttggtcattacacttgttaaagcataattttccaaaaggcaagatcatgactttcaggtaaatgtaaaatgaacacatatcacagattttaaaaaactcattaattaatgagagaatcagtcagatgttactactggtttaaaaacatttgtggaactaggatatttaaagacaatttcaaaaagaaatgttaggatgagattgccaggttaggttaaaaattagtcagtgtctgtcaggaccataaatccttgaaataattatattaccagtttataccccaatttataaatctatacatccttgaggatatgtgttctactggacagaatttttttgtatctttactagataaaaatctacaagttagcaggtaacatcactaaatatgagatctttaatcagtagtgtgttagtagttttatagtcattgctgtaagagaatacctgagagtggctaatttatataaaaaaaggaggtttgtttggctcatagctcttcagagtatacaagaagcacagtgctggatctgcttttgaagaggccttaggaagctttcagtcaatggaaggcagaggaggagcaagcgtgtcacgtggcaagagagagaacaagcgagagagaagaggtgtcatgtttttttaaacaacctcttctcccttgaactaatagagtgagaactcacttattaccaggagagggcaccaaggtattcatgagggatccacctccatgtcccaaatacctcccactatgtccggaattggtgggttcttggtctcactgacttcgagaatgaagccgcggaccctccctgtgagtgttacagttcttaaagatggtgtgtccgcagtttgttccttctgatgttcggacatgttcaaagtttctttcttctgctgggttcctggtctcgctggcttcaggagtgaagctgcagaccttcacggcaagtgctacagctcttaaggcagcacgtctggagttgttcgttcctcctgtccggagttgctcattcctccctgtgggtttgtggtctcgctggcctcaggagtgaagctgcagacctttgcagtgattacagctcataaaggtagtggagacccaaagggtgagcagcagcaagatttattgcaaagagcaaaagaacaaaccttccacagtttggaaggggacccaagcaggttgccactgctggctcgggcagcccgcttttattcccttatctgaccccacccacatcctgctgattggcccattttacagagagctgattggtccattttacagagagctgattggtccattttgacagggtgctgattggtgcatttacaatccctgagctagacacagagtgctgattggtgtatttacaatcctctagctagacataaaagttctccaagttcccactagattaactagacacagagcactgattggtgcgtttacaaaccttgagctagacacagagtgctgattggtgcctttacaaaccttgagctagacacagagtgctgattggtgcatttacaatcctttagctagtcacaaaagttcttcaagtccccactagattagctagatacagtgctgattggtgcgtttacaaaccttgagctagatgcagagtgctgattggtgcatttacaaacctttagctagacacagcatgctgatcggtgcatttacaaacctttagctagacacagagtgctgattggtgcatttacaatcctttagctagatgtaaacgttctcgaagtccccaccagattagctagacacagagtactgatcggtgcatccatgaaccccaagctagacacagagtgctgattggtgcatatacaatcctctggctagacataaaagttctccaagtccccacccgactcaggagcccaactggctttgcctagtggatcctgtgccagggccgtgggtggagctgcccgccagttccgcgccacgcgcctgcactcctcagcccttgggcggtcgatgggactgggcactgcggagcagggggcggtgcccctcggggaggcttgggccatgcaggagcccaccacggtgggggctcaggcatggcaggctgcaggtcccaaggcctgccctgtggggaggcagctgaggcctggcgagaattcgagtgcagtgccagcaggctggcactgctggcggacctggcaccccctccacagatgctggcctgggtgcaaagcccctgactgctgagcccatgctcacccagaactcagtgctggctcgcgagcattgtgcgcagccccggttcctgcctgcgcctctccctccacctgcgcctctccctccacaccttgcaagcagagggagctggctccactctcagccagcccagagaggggctcccacagtgcagcggtgggctgaagggctcctcaagcgtggccagagcagatgtcacggtcgaggaggtgctgagagcgagcaagggctgccagcacgttgtcacctctcaccaccaggtcccacctccaacattgggggtcacatttcaacatgagatttggaggggacaaacatccaaactatatcaagtagtaaatagtgagatgaactaagttcatccccctagatcaggagccagcaacttttttctctaatgaaccagataatacatgtttcaggttttgtgggccatatacatgtctgtctcatattcttctcccctttcttctccttggcagtacaggaacaggttgtgggccagatttggctaatgggtcacttaccaatccctcccctagataatctttgggtggccttacctctatatgacattgaaagggtatgctgcccacctcttttaccttccaagtttcataaactctttttaaacagtcctttctcaaataacaaaatcaaagagtacaattgctgttaggttgggtagggatggtagtgtcaacatttgatgttaaaaaatcttcttcttagcaaggttgggaagattttcctggagttcaaaaaggacaagttttgtggggaggagaaatgttagtttcagacacagtttaattctgcccattaggagggacactgtccactagatgtgagacatagtggttttgtcagttttgtctaattcttccaggtactttgaaggtttttctgttgaaagtttttctaacatttttcaaatgttagaaattcctttttaagtaaataggaaaggcagcttgagataagataaacatttcaaaattttgactttcatcagaaaaacttaaatattttttagtgtgtgttttttggagcgtgttttagagtgctggtttttttttttttttttttttttttgggaggacgtctctgggaacttagagaagaatcaacagtagcttctctctctggtgaattcaccttgactttctctttggagacaaatataaattgagatttattacctgtttagtttttgaaaatgggttgagagagattctcttttgttgttgtttcctagcaggaggtcgtgaataatgcatggagcagttgcttatattgataaacatggttaatttaaataataggactaagatttatgctaaccttttaaattttatttttgtggttctgagtatgtacatgagttgtttttaaacaaagagaggaaaatgcttttgggggggctttagtgacatgtttggatatagtgggatgtatggatttgtcctttctctgtgtctgttttgtcaacccattggctgtgttggtatctgtgctttgtttcactgatgtgaccctgtcttatggtgggaagtgctcagtaaacactctgttgaattgctgaagccattgttttgcaggacatccttgtggggaaaagccttgattggggtattgtatcctctctctctctcttttttttttttttttttttcttttttgagacagagtctcattctgtcgcccaggctggagtacagtggtgcgatctcggctcactgcagcctcaatcccctgggctccagcaattctcccacctccgtctcccgagtagctgcgactacaggtgcacgccaccatgcctggctaatttttttgtatttgtagagacagggttttgccatgttgcccaggctggtctcaaactcctgagcacaagcaatccatccaccttgcctcccaaagtgctgagattacaggcgtttgccaccatgcctggcctgtatcctctcttcatttcatgaaaattcttagagagcagccacatttttgggagagcagtactgtctcttaaatttaagattaggaatttgatatagaattaatccaaaagggcttaaaaagccaacaggggccaagaaacacaaggatctcagctcactccctttcttgcttacatagggaggtaaaggtgggttcttagtgtgggagacagaactggagggcagacaagggtaaggtgcctggatcactgtttcaaaaataaataccaggcaaaatgattatcatttacaactttttttgcctggcttctgatttcaaacctgggatttttttcttttctttttttttcagttgatgtgatagctagcaacagaaatttagttaattatgggaaaggcaatcttctcggattcatttctgattaaataattatttcaccagtttataccccaatatatgctttggtaggaggtttacaaaaatatatacactataagaagatacaaaacaagtgaggaaatgaagcgaaaggagtcattccttcattcattcatttatttatacatttaacagatacttattaagtacctacagtgtgcaaagcactgttctctgtgcctgaatactcagtaaacaaaacaaactccctgtccttatggagcctattctagcctggggtaaaagctgatagacaataaatacgtgcacaagtaagaatgtgacatggtggctgggcatggtggctcatacctgtaatcccagcactttgggaggccgaagtgggtggattacctgaggtcaggcgttcgagaccggcctggccagcatggcgaaaccccgtctctactaaaaatgcaaaaaaattagccgggcatagtggcgtgtgcctgtagtcccagctacttgggaggttgaggcaggagaattgcttgaatcccggaggcggaggttgcagtgagccgagatcacgccattgcattccagcctgggtaacaagggcaaaactccgtctcaaagaaaaaaaaaaaaacgaatgcgacatggcaggtgttactttctgctgtatggacaggaaagcaggataagggaaacgggagcaacaggagtgagggcgggtgtggaaggagggttactatttataaggaaggttcaggaaggcctctctgatgaggtgacatttggacctgagatctcaatgaagtgatgagtgagtcacatgacatctgaaaaaagagagtttcagaaagaaagagcagtaggtataaaggcttgaaggtataacagcttgaaggtcagggcttgccaagcatgtttgaggaggagcccggaggccaaggtagctggaccagagtaagggggatgaggagaggaggtaagaggatttcataggccactgcaagagtgagattttactcagtgatacagagagccactggagggttttgggggccgagtaatgaccacaatttgacttccattaaaaaaaaaaagactaatgggcctggcgcggtggctcatgcctgtaattccagcactttgggaggccgagatgggtggatcatgaggtcaggagatcgagaccatcctggctaacatggtgaaaccctgtctctactaaacatacaaaaacattagccaggcatggtggcacgcgcctgtaacaccacttgggaggctgaggtaggagaatcacttgaagccagggggtggaggttgcagtgagccgagattgcgccactgcactccagactgggtgacagagcgagactccatgtcaaacaacaacaacaaaaaaagagaacaacagagtgcagccagaaaggcagctgcgccctcacacgttcatgggcaacctggcactaaaccgttggtagatgacctgcttctgggtcggggttttgtacgtagcagagcagctcccttgctgcaatctgttgaaagtcagcctttgacgcaagggtttgttaaaaaaaaaaaaaaaaaagaaaaagaaaaaagaaagaaaaaaaaccactctggcagctatggtgagaatagttggtgggggaaagggaggaagcaaggagtccaattaagaggccattgtagtaattcagacaagatattatggtgacttggatgaggggctacaagtggagattgtatgaagcatttggattctagatacaggatttgctgatggattggactttgtcttgctgataaagggtgtgagagagaaggcaagattttgtcctgagttattggaagaatggaattgccattgactgagatagataaggctgagtggagaatgatcagcaaactaggaatggaagagatcttcctcaacgtgataaaatgtatctacaaaaaccccacagttcaccttacacttaatgtgaaagactcaatgctttcctcctaagatcaggaagaagataaggatgcccgcttttgacacttctgtttaacattgtacaggaggttctagccattgcagttaggcaagaaaaagaagtaaaagttatttggattatcaaggaagaagtaaaactgtctctatttgcagatgacataatctcatatatagaaagtccagaggaatcgactaaaaaatgattagaactaacaaatgagttcagcaaggttgcaggaaacaagatcaatatacaaaattaaattatatttctatacactaacaatgaacattccagaaatgaaattaagaaaacaatatcatttactgccatagactaacatgatatcagccagagagagaaagaaagagagtctggatagggggggaagaagaaggtttgaaccccagatcaccaaaattcaaaggtcggggagatgaagggaagcagtaaggcagtaaggcagctgtacaaccaagagagtcatgtcctggaggcaagtatttgagaacggaggtcatcaacagaatgtgatgctgctgaagagtgagtaagatgaggactagggattgacagctgagtaagttgaatgagcctgagtgaaaagcaggagagaaagaatgagagacagaggggtaagagaaaaactctgtccagaaccaatacttcttttggaaaatgtagtaaaagtggagcactagcaaaatcaatatgcaagcccatttttttccttattaaattcaacagacatacattttactctcatttactctaaagtcttgtaaatgtgttctctcagtttccatactacctcattgtagtctgtaacggtttgctgagtggactggtacttgtccatggaagccactttggcaacatgaactaaaatggattcaacatggatatcatagagtactgggtatgatgcaagaggtacctgttagagaataaacattggtctcatcctctcagaggccatatatctctttgttcagaaaacatgaagcctgaagtttggtcccacctacgttataatcatgagcaagtgaaaaatcttgcacaaagcattatccttttctacaaatgataacagttatctgctctcttccttataattttgacatttgtttggtatttcagtctgaattgctcatttaagttttatacaaccctgcgaagtgggtggatttttttttttaatccccacaaagaaacaggctcagaaagaggaaacaacttgtccaccctcgtgctatttggaagtgatagagccaggactacccttttagatccataagcttgccaccagaccgggctgtgggattttttaaatccctttccacatttgaatttaacatcagctgtgctttgataatttatgtcctattttttgatcacaaatttgcaggttgagtttagtgtccctctgagtatgtgtgtgttgtcaacatagcaaggtaaatagaccttgtctttcaaatctaaacagttgctggattatactatggttggttttaaattctaaccagaagtgctcttcattctggaaatgctgccttgtaactgagttgtttcctctttcacagcatatgagctatttgcattcatcagtcacatgggaacatccacaatgagtggtcattacatttgccatatcaaaaaggaaggaaggtgagtcatttttagaaggtaaatgttagctgtgatttattgagtacctactatatgccaggcactctcctaggtacattgtatgttatcttatttggttctcacattggtcttgtaaagggtatactgttaacgcccttttgcacatcaagacaccgagactcagggaggctgaatagcttgaccttagctagtaagtagctgtgtgagagctgatattcaaagccactttcaactatcataccaaggtgacctcccaaaataaagatgcatcctgcagcagaatgtatgctgtaattggaacctccctaggattgccatatttagccaacaaaaggaaacaagacaggaaaaaccaggatgccctattaaatttgaatttcagataaataatgaataattttttagtataaataaatttcaaatattctatgtcccaaatattatatggggcatgcttctactgaaatttcttattgcttacctgatactcagatgtaactgggtaacctgtgttttatctggcagctctaaaccttcagtgctttgccttactacagccttgcagttggcttctcagccttcttaagtagaattgttaagtgtgtagtgaaccggaaatgagacagttgtggaatgaaaggctgctgctttcttcagaaccttctccctgggctggatccctacaggacctactggtgcccttcctgcaactccaaactgagtagcctgtgggttggcacttctgcttgagggcagtgctcaggccatgtggatgctggagaaatgcctgagggtggcctcttgctccatggctcccactgcaggagtggccatttcccacctggactccattgtgttcttctgtggtgtgtctttttagttttgtcttcttaacttggtaaaatagttgagcacaggaatttatctcttttttttgagatggagtttcactcttattgcccaggctggagtgcaatggcacaatctcagctcattacaacctccgcctcccaaattcaagcaattctcctgcctcagtctcccaagtagctgggattacaggcatgtgctatcatgactggctagttttgtatttttagtagagatggggtttcactatgttggtcaggctggtcccaaactcctgacctcaagtgatccacccgccttggcctcccaaagtgctgagattacaggtgtgagtcaccgcacccggctgggacttaatctttgtggtgaattgtttttattacaaacacgatagcgctttaaaaaacactttatggaatgaagtcaaagaaaataaaataaaaatgctttttaaaagaaaaatagcttaattataattttaaaagcaataaaattcatagtaaataatttataaatataaaaatatacaaagaatatgtaccctggaagcctaacaataaccattgtctacattttgatatacttttctttgttttattgtctcactggaagaaagtatatatatgtctatatgcacacatactacatataaataaacacacgtatttacaacttaactaaaagcttaaagtatgtgcagagtgcatacaattttttaaccagtaatttcccatttcatattatatcatggttattttctcactttgccaaatattctttgaagaaattttaatagttctataatagttcactgcatggatttttttaaaattctggttttaagctagttttatactaagactgaaataagcattgttgtacataattctttgactcaatttctcaggctatctatggatttctataaagggagttatgggatcaaaggttaaaatgtttggaggttcctgatacattttagtaactactttttgatggagcttaagaatcaaaaagcagttgtagctgggtatgatggcatgtgcctgtgttcccagctactccagaggctgaagcgagaggatcccttgagcccaggagttcgaagcttcagattgtgctaccttactccagcctggggaatagaatgaggccttgtctcttaaaaaaaaaaaaaaaaagcagttgtgattccctaccagcattctgtccctttttatacaacgaacttgagtatagtaccttaaaacatcatggttaagtgttgtgcgccatatgatttagtgacttctttgtgtaaagtttcctggaactgacttaaatccatcaaatgcttctgtcttattttcagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcatattgctggtggaggatctgccatcagcacatcaaaaatggggatgtgcccccagccctctattttgctttgggggtcagtgatagtggcctctggagaaaccaaataatgtggccagtggtgtggccttacccacaacaaatgaaaagcccacttgtgtttcatatagaaaatcagcagttgggtggggctttatttgtgacataatttttttcatgacatacaataatttctgatgtatccatgtagatattatgctctgtccataatagagcctctgcaatgaaagatatttttaatttgtcacattaaaattcataatacgattgtgtgaatgtgtgtgagactgactgagagtgtgagacttttactagaaaagtgagtccactagaaaatctgtgacaagttggtttttaaagtctgaacagttgatattaagcatatctgaaaaaagcaagtaaatattttaacaaaactatgactcaggaaccttcgagaagattagttccccacttagatttttaaggagtaaaaagggctgagttatgcctttaagtgctgtcaagaattcacttgggtttgggacatttgctggtgtaatgctagatgcccacagcagcataatattgtactttgtcaaaggtaggtaaattctctgtttctcagcagccctttccccaaaaggtatggtgtttatttttagtaaaaatagctaatctctttttaccatctcacatgataactctttggagtcatgtcaagtgccccaaatttgtctgtgattttcccatctctgagctctttatctgcctccgtttccttgtttttctggggccagagtctcatctctgcctttttttggtgtatcaccttctgacttgccttcattgcttgtctgatgtgaccaacagtgtgatcttggacacactaaggattttagatgcaaagaaactttatacaacattatgaaagactatcctttccattttggttatttcagcattttagttgcaacctgggattagattagagtttccaacgtgatgaaaagtggaatgatagcattctataatttccataattttcctactggtccgtaccaaattctagagtctctggagttgctatttcagagtatttggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctg

SEQ ID NO: 17235 - DNA, 95122 bp, Human
ccttagaaataaatgattttgtgtttggggctctttcagggaaaccgaggcaggataggagttgtcatcgcggcttacatgcactacagcaacatttctgccaggtaagaggggcctggagcctcccatcctctgaacatcgacagtgtgacccccctcctctcatccacccacagcctctctgctccctggagtgaggggatacgcacagagggaatgagaagcgatgaggacgggggaaggggcccctggctctgaggcaggagcctgtggacagagggcgggagggaggagagtccacttctctatcaggggttctggtggggcagccttgggaggcaggccctgtcctgagcaacccatgcggccagctcctcggagccacttttccttgccaaactgccttctttttccctgggccagcaggaagggagtcagaaagaaatgtcggatcagatctgggtctggcaaaacagtctagaagttgtctcatctattcctctgcctctggacaacagggccctcttcctacctaggtgtttggaacaagaataaagaacatccagtcactgactccctttccaatcccactctgcagagaggcagagggattcacccattcgttttgttattcactcaacaaggaatatggctgggcgcagtggctcacgcctgtaatcccagcactttgggaggtcaaggcaggtggatcacttgaggtcagaagttcgagaccagcctggccaacatggtgaaactccgtctctactaaaaatacaaaaattagccaggcatggtggggcaggtgcctgtaatcccagctactcaggaggctgaggcaggagaatcccttgaatctgggaggcagggaggttgcagtaagccaagatggtgccactgcactccagcctgggagacagggagactctgtctcaaaaagaaaaaaacaataaatattgaacagacaatgtgccaggctctgttctaggtcctgggaatgcagcagagggcaaagccaggccactgccctcatgggcattaaacacataaacaaatacattagtaatagcaggtgataattatcgtgaaagagtaaagggactcaagaagggcagtggcgaggcaggtccatggttggagaaggcctcttgatgaggtgacactggaacagagacctgagtgaccaggatggaaagggctgagccttatcaagcctgtgggatgcgccctgcacactgagagaagaggaaggatgggaatgcgaggggctgaggtgtttgaagctgagcaagtgagggaagaggaagaggaggggaagctgggaggtggcagagccatggggcctcgcggcctcactgaggactttggggtttgctctaagagtgatgggaagtcactggagcttcgtgatcttttcatttcaaagtgacttctctgagtgctctgtgaggatggtagaatcttctgtggagggcctgccaggaggctgtagttttaggacttcgagcaacccaagtcagtctcacctttgcttaatgataagcaaagatgaggctgcacctttactgcactcctgtacccctactgtgtgccatgagtgccaagctctttatggatattccctcacttcatctccatagtcacctttgaggaaggggcaattatcaccctcatttgatgggtgaggagaatgaagttcagagagattcaggaacttgtaccaggacacggggctcataagtggtagacctgagctgggctcccaggctgctgaactttaaagcctgggctgagtgcggccctgcacagttggagagatgctgaaacactcttttcctgaaagcttctcggcacaggatggcagggggaagaggcttgtcttccctccaggacaaaggtgctctttggccagagtgctctgcaggtctgagggagcaggggtggggaaaacaagcggctcttggatgcaggagttgcctcttttgaccacctgtctctccctgcagtgcggaccaggctctggaccggtttgcaatgaagcggttctatgaggataagattgtgcccattggccagccatcccaaagaaggtgggtctctggggctcacagccccttgcatgtatgtgtgcactcactctatgtggggactagacttgtgtactcacagggatgggatagctgtgcctaggtgggggtgtaccaggcgcaagttttcagatgccagcctgcagtggtgtgagctcaggcacacaggagagcccgggagccagcctgtggtgtgtgcccgcagattggcacagcacttgactctgaggcctgtgctagagagcagtgcaaccttcatggggaagcatgagtctggggataagaaggcgctggtctaggaaggcatgtgctgttcttggccctggaagcaggattgcttcagtgcttggatgagtctacgggagactgcatcactgccccctgctgtgggaggtcagacactcatgataagggtcaccttctgttgggagagtttagacagttttactgagagctttcaaccacatggtctcattggagtctcacaatagcccaggcaggaaacagggcagggatggatttattcattcagcaaaatttaaatcatctactatggctccaagcactgagatatctgggtgaacaggaaaaagtcctttcccttggtgagctgatacctaatgagagagatggacatgaaacaaataaccatacaaacaagacagtgtcagacagcaatgaggctaggaaggaaagagggcactgcagacacgagaactgataggggaacggggctcttttaatagggatggtcagggaatacctcttagagggggtgaatttgagcctaaactggaatcacggtgagctatcgtgtgatgatctaggcatcccattttgcagattagaagctgagccgagggagggggcgtggccatggtctatagtgagtagtggcagaactggaaagtacgtgaaggcctagtaatgcctgggctagggcagtgcctcctggttgtgtgacccactgtcctgagggatcctgctccgtgggtgacatgttgctcaaagacatctcatgcacaggaaggcacaggcagcatcaggggcaggaggtctttgggggaggctgcagccaggatggtgggaaacccaagcccaaactggagacctggatggtgggacgcaggcccagctctgtttgctgctgggagttgtgggcctgccacctgccgtgatgtcagcaccattctgcacactggtgacatggtgctgaatccgccaggcaagggcttatggagctcagcttctagtggatgttacacatataaggaaacaattcagatagtcatgagagctgcaaagaaaaggcaaactatgatggctagagagtgatggggctggaaagagggctgattcaaatggaagggccttctgagaaggtgacgtgtaacatgagatctgggtggggagaaggaagcctccaagtgaacgcacgggataaaggatccagaatgagggaatagcactgactacaagggcctggaggccaaagcatcctatttgcctttttagcccctgagcacactgactgggccaacaagggcctggagctgtgagtcctggagctctccagcctcatcatgctgagggtcccaacacgtgccccatcatcccaccttgcttggctggctagaactgtgctgtcccagctgggggctattcccgccattgtaattggaagcccaagaagtgagtgagtcctcaggtaacccagcaccttatagttgcacaaaacagttgatagccagcctcagagtcagcaaccagaaatgggatgtctttatgtgcagaaaattctggttagggccctggagacagcagctgtggatcaacgagagtcttctcagggaagaaagaatgattggtcaagcactgccttgtcagcctctggcttgccatgtgtgtctgctgactgtaatcacggtgtggcctttgaccttgaaggataaggatactaagagagaagcatgctgttccaatggcacagtgtggcttggagagaatgggtagagagtaacatctctgagtctgagtagtgaaggcctgaagaccagggatcagtgtcacctctcaggaataggattatttagggattccctggtgtattagtccattttcatgctgctgataaagacatacccaagactgggcaatttacaaaagaaagaggtttaatggactcacagttccacgtggctggggaggtctcacaatcatggcggaaggtgaaaggcaaatctcacatggtgacagacaagagaagagagagggtcaagggaaaggggtttccccttacaaaaccatcggatcttgtgagaattattcactaccacgagaatagaatgggggaaaccactcccatgattcaattatctctcactgggtccctcccacaacacgagggaattatgggagctacaactcaagatgagatttgggtgaggatgcagccaaaccatatcatctcgtgttcaacatatgcttgcatagcaggcagttggggcgtgtctgcctggctcctgtctgacactgcctctgcttgtggatgggtcacctctctgagcccagatgtggaagtgcaactgtgggtttactatgcatttattgccaccctcctgccttcttgtcagtgtcacttgcagggaatggagcagatggaggagaggagggcagggaaagagagagggaggggctttgcctgtagctctctcattcattgtcacccgcctccggactcattgtccctcgaacacagacacatcctgttggcacgatccagagatctgataggaaccgctattccaggtttccggcttgagtaatggggcaggggcctgaataggatcgggtgctgcccatcagattatcttacttgagtagtccgaggaggccccacccaaacccagggacagaggcccacaggcttggaggtgggccaaggagccaagagacaggaggggatcttatcatggtcatgtgggctctagttccaccctcttcagagagctactattggctcctgcagagcctcagaatacattctgattggtctagctgactcagcttgtcattccatggccaatcagaaaagggaaaatgccgaccaatcgacgcagaaggactgatctctattgggcagatgaccgatctctagtttattgggcagatgcgttggagcccagacttctttcctgctctccccatccacttccagctttgtgtgttcttgctgtgtgtctctggagtccagtgacccctcctggaccttatttatcctctctgtctagaaggagagggtgtgggttagttcttccattcttccaacagatctttgttaaagaactaggggatgttggctgggtgcggtggctcacacctgtaatcccagcactttgggaggccgaggcgggctgatcacctgaggttgggagtttgagaccagcctgaccaacatggagaaaccctgtctctactaaaaatacaaaattagccgggcatggtggcgcatgcctgtaatcccagctactcaggaggctgaggcaggagaatcacttgaacccgggaggcagaggttgcggtgagccgagattgcgccattgcactccagcctgggcaacaagagtgaaactccatctcaaaaacaaaaacaaaacaaaaaaattgggggaagttgaccctagagatagatacttattagaagctagttacctcgaataccaagtaaactcaaggatacagagagagggacttaatgcactttggtatgatgtagagaaagtgaagaactacattcattaaagtcttgctcactatttgctagactatcacttgtggctactggatctgtgggcagaactggggctgtgagtatgagcgcaagcttgatttgagctttgtgtgggggtgtgagggcgtcagagctgtttggtggttgggcctgccttgtgcagctaaatgatgcctgtcagggatgtggggtggaaattttggtccagcaggagattctcgggctgggagtgaagcaggaaagagatattcatgttgaccaccagagggcggtggcgaactccaagtgggatgcttgacttgacccagctctaggtctggtatacctgctcactcttcctacctagggctcccagcagcaggcaagcatgtctgggagggaggcctggttggggagggggaccatgttggttggggagagggtagagtaggtgagtggtctagggcaatgttcttggaaaagagagaacagggattactgcaccagtacccacctcactccctgaagctgcttctcccaccactacaggtacgtgcattacttcagtggcctgctctccggctccatcaaaatgaacaacaagcccttgtttctgcaccacgtgatcatgcacggcatccccaactttgagtctaaaggaggtacctgccttgagccctctgacctccacccttgccaactcctccctttcatcttccatcttctctaagaggcaaccttgggtagtaacagacagcccgagagctgcagagtcataaggcctccattggactctcaagtgtattgcttcctaaacttttctaagcaccaatctatttgcagtgcctgctggccaatgatgttggatgggcaatgtttttattaatttaatttgccttacaagtgaaaagttggtatttcttcccctttctgcttcctcttttactctttcctcttttcctccttccccttcctaccccgtcttcccccatttcttccttcctttctctctttctcccttcactgtctcctctgcccctcctgcctgccagtttctgctgtcttagctaacacccaccccacttttacaggatgtcggccatttctccgcatctaccaggccatgcaacctgtgtacacatctggcatctagtaagtattacatgggcgtgagaggccagagaagcccaaggcccagggctaaggaccaggtcagaaggttggggagaggagagaatattctcaagagggctgaaaggacagagtcagagaggtttcccactaaccctgtggcgtaggggcagcagggagaaaatgcccctccctcatctcccctccagcagcccactctttttctgcccacctctctcccttagcaacatcccaggagacagccagactagcgtctgcatcaccatcgagccaggactgctcttgaagggagacatcttggtgagtgctgtccctctgtgtcaagccccatccttgtttattttctctcccttcttttcttactcctttcctgcctcttgggacaagacaggtactcctcctgggctgccaggcttggaaccataggctctcagggctcttggaagaccttccagtctcacacagtctgtgtctctcaccctgggcttagctgttgttctggagcatctccagggaaatatcactcagcgtgagctgttacctcctggcttcttattggtgacaaggactctctgaattctagcttcagttcttcctgctgccatttaaatccatcttactttttgcactctgacttgtatgtagaaacttcttgggaggacatttttgtccccagaggccaagactggcctccaattctctgctgttctagaagtttccccacagaactctgagatcctgtttggtgttgatgagctctccctcaccgggtttggggtgagccttgggggctcagtcagcggagctgataaggaggctccctgggacctgacctcccagcctcaggcccctgactggttctgcccgtcttcccacccagctgaagtgctaccacaagaagttccgaagcccagcccgagacgtcatcttccgtgtgcagttccacacctgtgccatccatgacctgggggttgtctttgggaaggaggaccttgatgatgctttcaaaggtgcgctccttgagtggagctgggggtgggcacccctgtggcagggagaggagctcagtttgagacgatatggtgggtatggggaccatcttttctggaccatgtggtctgtctagtctcagggtgatggtaggagagagttgagagagacttgggagagagttgagattggatggtctgggaattccagttgttagtagaagtggagataaactcctcccagtccttgggctgttttatatcttgcagccttctatgactttccctgtctctccttcatcttgtcctcccagtttgtcacatgtgtcctactgacaatcattttttttttcaacattcactgggcatctgctttgggctaggatctgtaccaagtgccggggatacaaagtaaaacatggcatggtctctgccttggtggagctcaaaaatcttgttgagttgggaggcagactagcaggggataattaccctgcagggcagaagagcagtagtggaggggtgtggcagcagcaagggggaaccattttctgagaggagaagaggtggttgggaaaggtttggtgtttgcttttgcttctttcttttatccattggaagttttatctatatcacattaatgcctgggacatataaatacacatttatttacccatctctctctccatccaccaatccatccttacacacatccatccatccatccatccattcatccatctgtctgtccatccatctgtccatccatccacccacccatccatctatgcacccacccattcatccatccattaatccatcccttcattaatctgtccatccatccacatattcattcatctgcccacccatccatctatccatccatccatccatccatccatccatccacccacccacccacccacccaccaagcatcacttgtgtgtctgtatgtgtcgggcatgtgctagaccctatagatatgaacagaaagaagtcaggccctaccctcagggagttcacagtttcctcagtgagagacacacaaacatgatactatgaagtgttgcctgaagtgatggagacacgcacaagcatgataggtgtcccatggagcagatgccatccttgctgtaacttcttttcctacatgcagtgggcagtgatctgtgtccagagtgggctcaggcggagaaagactggacctggggcttggaggagggtccagatctccttagtgtggtctggctcatgtagaagggtgtttctttaatgagctctccttgcactggagccagaagatgccatcataattacagtacagaatgtaaatgataacagtcttaacaaggaaaaataaaggcatagctgatcaaataaataagggattgggcagaagttgagagaaggaagggtcacagatttcctcctcttacgtagtgggagtcaggagataccatcgaaaattgacatatcaataaatagaggcatggccaggcacggtggctcatgcctgtaatcccagcactttgggaggccaaggcgggaggattgcttgaggccaggagtttaagactagcctggtaaatatagtgagaccccatctctacaaaaaataaaaaaattagccgggcatggtggcatgtgcctgttagcacagctattccaggggctgaggcaggaggatcacttgagcccaggagttcaaggctgcagtgagctatgattgcaccgctgcactttggcctgggcaacagagtgagacctggtctctaaaaagagaaaaagaaatagaggcttaactatcttatttaaagtttcaaagataatcaatagcataaataaaaacaataatctaatcagatttaagaagacaggaagtaggggtagtagtataagtgaaccaaattattcatattaatagtggtcaatccatagaggttatttaaaattcatgtctggctgggtatggtggctcacgcctgtagacccagcactttgggatgctgaggccggtggattgcttgagcccaggagtttgagaccagcctcagcaacacagcaaaactccgtcgctataaaaaatacaaaaatgagccgggcgtggtggcttgcacctgtagtcccagttactctggaggcagaggtaggaggaccactttggcttgggagattgaggttgcagtgagctgtgatcgcaccactgtactccatctagggtgacagagcaagattctgtctcaaaaatataaatatgcactccaggctgggcgacagagcgagactccatctcaaaataaataaaataaaataaaataaaattgggatctagaaatagtggcataaaaatagtggctattatttagagtcttagaggtaaattgctagtagaaaagcaatagaaatagttagaatcagtgacctcattacctcaggcaagtaggacaggggctagagtgggcaggaaatttaatttcattgtatagatataatttcatgtatatatgtataaatatacattgattattattatattattaaccatgtacatatatggtattttaattttttctagaagaaaactttttatggaatcctttttgggactttttgcctatttttatttttccttctctttttccagatgatcgatttccagagtatggcaaagtggagtttgtattttcttatgggccagagaaaattcaaggtataagccgagttagaattcattctctcactccttccttttatcctgaccctatccccagcacccttccacccctggtctgttccacagtgatcaagttatttttgagaggcaggccatcagtaaaggatctgggtttcagagtggacccctagctaaacatgaaccagtgacttaatctctggataataaaaataaaaaagcagacagagaggcactgggttggataaactgttctggtcccattaggtcatcagcctgttatattcagagactgaggtccttggtagatggagggagtggctggcgggcagggggcacacaaaggtgctggatagaagatgtgtatttatgagaactgaggtgattcaacctgaaggctggtttaataataaccttgaagcctctatactggttataagtggagaccagttgttcaccatcttattcgagaatggaatgaaaggagatgaagttaggttatgggcagagggactctggatagactaaagaaaggactgccaagccaggaaggtaactcaccctgacagacttgactaggagctatgctgtctttgagccaggtttttaaaaatttacttatttatttttattttaccttaagttctgggatacacgtgctgaatgtgcagatttgttacataggcatatatgtgccatggtggtttgctgcacctgtcaacccatcgtctacttttaagctctgcatgcattaggtatttgtcccaatgctgagctgggttttctgtggatggctgggagattctgccgtgccccctaggtttctgtctggagcggagagcgttttaagagggggcagggccatgcctgggatgaccctttggaggctttatgtcctttcaatgtcggggctgtgatttccctgctgtccctgatcccacgtagctcataagcagcctgccccccacccccagggtctgaccccaggggcagactttctagtctcttggcactgcctcaggagccccagggacacagaagaaaaagaggcaggtacccagccaggggtcctccccgctttcttccagggggtcttcattcttcagtgcctgtcctgatttacccctatgacccggcatgagccttttcaagaatgtgagaaactagactcccagttctcagtccagcttaagccactggtcccgcccaccacgctcaagaaaatgagaagtccctcagggagcctcttttggggagcttgtgggctttctctgtttttccagctgctgatctcttttccctctctgcactgtctccccgactgccgctgcctttcccatcccacttaggcatggagcacctggagaacgggccgagcgtgtctgtggactataacacctctgaccccctcatccgctgggactcctacgacaacttcagtgggcatcgagatgacggcatggagggtaggtgggacctagtggctcccagcccctatccaaactgcacagcctctgctcacatgaccttgcttctcttggcctgctttcaagagatctgggttcgagaggaggcagaggggaagtgtgaggtacctccgagagctcaccgttaactgggggaagataaggcacatatatgaatgtattaaataaaagtgaggacagagccaaagaaggcagcaaaatggccacaagggggttatcgtggaagtgtgttgctacagccaagtaagttccgtggacagtgagttctctgggattggcagggagggattttgagagctggagtgatctgggaaggctccttggaggatgtggccttgagtggagcttgagataccccccactgtgctgcaaaaacagcatttgtcacatgtgtattaaacccactgttgggtttcttcaggcttgctgcctgagttctctggggtcagagtactaggaacagaggcacaggatctagggcctacaagctttcatcaacagccaacaaaaatgtttgagagctgggaacaaactgataggctctgaaatttgaaaagaaagcagcagaattgaaattaatacatgtttaatttagctacaaacctaacattatgtcaaatggtccactgcaactcaggtcgtctcttgagagttctacatgcattctatttatttatgtggtctatctgcatatgtgtaaggagacgtggggcaggctccgaaagtgagcatgcccagagcccaggaactcttgagatgccctgcctggggtttggccacaagcttcttttcttgagttggtcgtaggactgcagaatgttggagctgggaggaccttcaggatggtccagcccatcacccatctgtgttcagttggggtgactgagacccttcccagaggcagaacctcctgatttacccccatgacccaggatggccctttcaaggatgccagcacccagcgtctggcttctcctcccagctgaagccagtcctgggtggggctgtgccatcctggggcccctgggtcccatggcagagctaggttagagataggtaggcctgggggcctccctgtgccctctttcctctacacggcgctgtcttctgtctccctccccaaggttttggatttgatgactcctctctgaaaatctttgggcctttccttgaataaagatttctcctctgaccttggggtcaccagaatgagcacaaggtttcagagagaagtgggatgagggagggtggttggactagaatttggggactcactgagagcacatttttttacgtgcaacattgaaaagtggatggcctgtcctcacacctgcctcagttcccaaccccttttcctcccccaggggcccagcaccctcagattggccaagacaccccaccaggcccctccgaccccccaggctgcttgtgaaaagcactcctccatccccgggcgctgagcggccaagcagaaagcagaggctggagcgaatttgttctgaggtttcagtggctgccagcctaattggtcgttgtgctggggatgtttgcatttttaacaagaacatttggcaattggaaagaatttttactgtctctccatctcttcttggtgcatggtcaatgcgatgataaatgtaaaaacatttagtaaactataaagtgccaggcaaataaaaggtaaaataattaacggtgaggaggagatgtgggaaagacggggcttaggatgtatttggctgtgggggaaggaagaagagcagacggtcagagtgggaggcagcccagggacagcagagccgagagcggctccccctctcggcagagggccagcttctcagcctccagacagggcccctctgtccttgcaggatgagctgacctttaactgaccaaaaggtcctgctggttccatccctctgtctgagggaatggattagaagggaaaaaaggaagggcgagggggcagaagaagcggccagggccttccctcaccaaccctctgtcccctctacctgcctatagcggccttcatgagaggcagttagtatgtggttaagaatgcagcctctgcagccaaactacctggcttcaaatcctttgacaaggtactgtccttggggcctcggtttgacctgctgtaaaatgggaattcagtcaacaaatcattttgagccccttgtgggcagcacggcctgaggaaggactgcatgtggtgttttcttgggggtccgtgacacatttgtgtcagctgtggccagtgtgtcaggcgcctgcaagacatggctaagggagaaggcctggatttaccatgcaccagccatggcaccaagaacttggtagttgccatttcatttgatgctcccagccattctatgactcttattatgtccaaatggggaaactggagcacagaggggttaagtaacctgccccagcttgccaagccagtcaagagcagatctgggtttcaagccaccgcgttgccccctgtgctgtcctgggttggctgacgtccctaggggcctgctttgggcatctggttttgtggcagtacctgggtcccactaagcctagtacctctctggctgctacctctcacccatggacagagaaagtcaacccatcctgactgttaggaagagggagggttaggcgaggggggtgtgctggagcgtggcaccccggaggccactgggcttgccctgaggcaggcgttcagcaagacttcagtgcaggcaacagctgagcccctggcccgacccacagagaagagtgtgggccgctcactcaggaatgcttctgatgagtggcaggcctctcgaaataggtagagggaagggtgtccaaggtgacctggggccatttctgaaagtggccccctgcctacctcttctatttcaggcccactgcgggagggtgatagtagaggccagaccattccctctggagcccaccaggagacttggaggaggggggcagggagcacccagccaggcagtcagcagcagatgtcatctctggcctgcatcctctcgtgtggcctgtgtccccaccttgccctctcctggcagtgaggcatggccagcaccaggctcagagctcctggtcccccaggaggccctcctgctgcccctgacttaaccatcatctcaggaactgctctgcatttaaccctttcctcactgcctgcagccccccaacccagctccaagttcaagtttacagcttgcagcactgtgacacttagagccctctcccgaattctgttgaatttctgttctctgaaggctgacttctcaggctcaggtggctgggctagtcataaaacccgagagggagggggcctgccaaaggggcaggaaaccccgaagtatgggccctccttggcattagctcagctcagcctgtaccaaccccatttcctggatgaagaccccagaagtaggcagaggttagcaatcttgtccagggtcatgagacaagatgtggagttgatattggaatccaaatccctttctacctcccttggagctcagcttaacagcaccccggaacccatacccataatccttcaggtggctccttcaggatggtcgtcccatttctgaagccctaatgatgacaggggctcactaccacaaagggaagcccgtttatggtgggacgggtccagctgtgtctctgtgtagcaaagtgtggctgtggtggagactttgggctcacctgctcctgggccaggaggaggggggcgtgatgagggtgaagaatcaaagggaagctcaataataaggaccctcggactggacgaagttctctgttgtgggacagtggctgggaggacagtgcctgccatcttggggaccctttactcccagagcagtgccttctggtgaatcccatgcctgaagtattattaatctgctctggcagccacagcaaagcaccacagacccaggggcttgttcaacagaaatgaattttctcatagttctggaggctacaagtctgagatccagatttcagcagggttggtttctcctgagacctctctccttggcttggagatgctgttttctccctgtatcttcacatcatcttccccctgcttgtattcttaccctcatctcttcttataaagacaccagacgtattggagtagtgctcaccctaatgatctcttttcaccttaattgcctctttaaaggctgtatctccaaatacagtggcatactgagctgctgggggttagggttgcaaaacaggaatctgaatgggggaacagttcagctcgtcacacctgagaaggagttttctgggtcacatgtatttggatgccccaggcctttgatcctgagtgggaggaaggaaaggtcaaggacaggtggtggggagaggtctggttccctccttgcgggcacctctgcctctctccagttagatctggagcctgccggctcagtgctctggctaacaccagttttgcagcctccagaaaccccattagcaacttggcctgagttctgatgccccgtgcccagattccaggtccccatgggtaggggtggcgctgtgtttttgcctctgctgtataaagcaggctccaaattcctccatagtgttccggggcaagccttctcggaagcaagccttgaaccaagggatatggactgccctctgcctctgagaagcctgcaggctgaccaggcctgggttcctgcctgccttctcatccaccccccacctttctgtgacttccttggacatcagttgtttagagtttctcttgactcaacagagaggatgggaacaggggttgggcaagtgaggggtgctctcagaaagtagatttctcagggataaaggacagggtgactcaggggaatgacaaacctcccagcctggctgacaagggtgaggggctggtgtccaccccacttctgcatctctcctggttggcgcccatcagtctttcccttgtttccatggacaatcccaccagaaccgggggctggtgacagggggccttggttttgtgcccaagcttctcagccctcaggggagatcttctagttctaaagggtgcccatccactccccaagtgcttttgtctgggtaggggaggagcctctgcctggagccaggaatccctgttctgtgatgacttcttatgagctgggcttatccaaggactctgtgatactttttttttgaaagaggaaagagggagggaaagagatacagcaaacaggcagagaccaagaaggagaaagaaataaatagatgagagacatggagagatagacaggcatggatagatattggcctgggaggcagaagatttgggttctgggtgtctctggtaactctttttccataggtcctttttatttcttatgaaatgtgagggctggagtagatagtatttctttccatttctttgagctcaagcattgtgtcttttcatgacttgtgaagacctaaaaggggcctgccaggcttccctctcagactttcgcaacccatgggcttagagcaggaaggagcatggcttagtggttctatcagtcaggagaggctcaattatgccacagtgacaaatgatcccaccttctcagtgggcctgacccaacaaaagcatatttctgctcatactacatatccactgggggtcagaaaggtctctgttcatcacagatactctaggctgagggcagcttcatcttgtaggtgcttccttcactgctgcagctgtgggaagaagacaccatggcttgcacactgctcctgcctagaactcacatgttttccttccgctcatgtttaattggccaaaacaagccaaacacccatgcctagcttcaaagggggcaaggaagttgtgcatagaggatgagaagctggaaataaggttgaacagaccaatctctaggaattaaggctatgggacctagaaccagaagatctggttctaagctctattgtttataggtgtgtttcttggccaagtaactttgcctttctgagatccaaatgtcttaattgtaaaatgggttcaataacagtactttcattatagcattattgtctgatatacaatgaggtaatatacatgaaatgtgaaaagcagagtggcgcatgccatgctggcagtgatttgtgtctgttattattattattgaagtgctggaggagagaagatacagacatgattttagccctctcttctttagaaaaagccgcgttccccttgcccctctactctctgggaaccatctatagctggctctgttctgggaaccccactcttgggagtcaggagacatgcctctgacatcaacttgctatgtgaccttggaaaaattacttcccctctctggttctcagtttcattatcagcaaattgaggataatggatttcaaaaagggcttccagctccaaagccctaacaatgttgaggatgctgatgctgatgatgaccttgagatgagagcactgtgtactttctgggtgccaggcaccactgactgtatgttctcttggttaatcctccccaaacacctgtaggtgggtgctgttttgtacttactgggctgaacaagcagaatttgtaggatgtgattaaaaagctacttgttttgtatactactgccctttaagtctaccctgtttccccttcccccaaatgacactggggcaagttccatcccttttctagccactctcaggtaatacaaggtcttttggtgggtaataaataaatacgcccagtgctggtgaacttgctcctcccccttgtcagctcctacctggctgctagctgtgtgtgtgtgtgtgtgtgtgtgtgtgtgttggttggggggcgggggtggtggtggtggtggggaggctcagtaagtcttctttctgttttcctgacttacatatttagggttaggaagggaagaaagggggaacattccagaacattctttcttgcctggtggggttgcacaggcattctctgtgtggagacagagacacaaatgatatctcttgggttctttgccagtggaagattctggaggcattgaatgccctctggcttctctcctgaggcacttctgtaggtatttgggagaccctgtccaactgcccaaaagtctttcattcgctgttccctttgggtggcgaacatggttctgttcagatgctcaggacccccttcctcagcccagtcatccttcgctccctccagcctcctcctgctgaaatctctcacccctgcaggtggccctcatggacagcatttgaggcagcccaggggctggctctctctcaccttggtccaaagtaaaaagtcagcactcctggcccccgcaaagacccgggttgaggtggccagtgcgcccccacccctgttcccacagcacagttaggcccctgtctttcacatcctccatgcgcccgcaggtacctgctgagtctctgagcagactcactgagatgagggagaagcctctagaaaggtgggacctgccaccaaacaccgtgctctccacaattcctcttacaatcttccactttctaatctttttacacctttgatatgtatgtgtgtgcatggtgtgtatggcggtatagtttggagccacaaagcagttttcagccatcactctctttttaaaaacttaatagctgtatagatataatttaataccacaacttcacctctttaaagtatacaattcaatgggttttagtatatttaggcttgtacaaccatcaccgtaatctcattttagaacagttttatcacccccacccaaagaaatcttataactagcagcagccactcccacttctgccaccaactcccaaccctaatctactttctgtctctgtagatttgtctattctggacactttacgtaaatggagtgatacaatatgtggtcttttgtgtctggtttcttttacttgacccaatgtttcattcacgttgtaacatgtatcagtattttattcatttttgttgctgaatgatattctattgtaggccataccatattttgtttatccatacatcaccatcaattgatgaacatttgcattgtttcaactttttggcttgtgtgaagaatgctgctgtcaacatgtatgtgcaagtttttgtgtggacttaggttgtcattgctcttgggtagatagccaggagtggaactgctggatcacctgtgtcatcatttgaggaacagccagagtgtttcccaaagtggctacaccatttggcgttcctaccagcaatgtatgagacttcctccgcatcctcacccacatttattttctatcttttggatgctagccatcctagtgggtgtgaaagggtattgcattgtggtttcaatttgcattttcctaagaattgatgatgttgaacatcttttcatgtgttaattggccattatggatcttctttagaaaactgcccatccacatcctctgtttcctttttaaatttttgttttgtcttttcattattgagttgtaagcattcattttatattctggcaacaggtcccttagcagatatataatttgccgatatattctcccattctgtgagtggtcttttcacttcttgatgtcagtcatctcttctgcaaggcctgcatggtggtcttctgccttacttttgaaatgtgtcattccttgtcctcaggcctcttttacaactgagacccaagtactttcacgttaacatctggtcacaaatagtgttcccatttgatagatgaggaaactgaggcaagtaacagagaagttaaggacttcgtccaacgaagtcttctggataaatggtgaaggcaggattccaacgtggtgggtctgcaaccagtcagggatttgcactgctacttaacattttatgatcttcatctgtagcccaaaatgctttaggctgtatggcctgatctctttccagctttagaagaggtgcctggattagcctggaaaggttgctcacagagagggaggccgagtttcagatccctggatggtagaacaggaaaaagcccatgagttctgccttccagccagccccgggcctgtgtagccctgtctcccttcatctcctggggcccaggccggatgggagagtggtgagaaggtgtcctccaggtttgagagtgagagatttcagcagtggggagcagagtcccagtgctcactctgggtggggctgtgggagagaactcgtgtgcaccacgctgtttgcccttgatgtattttctcaggttctgacattcttgccttctgaacttttgagtaagacgtgggagaaaccagcaagagaggggagtacaggattgcaggtggtcccagataactcagggaaatagtccaaggttcctggggagtgatacatgtgccccttgtatctaagcagagggcttcaggggtgagtttctacatgtgggtgctgagagcctgagattcgaccctgaactgatttttgttgggaaatggtcacctggcctccagaggggatagcccttctggcctgtgacttcaaggtggtgggggcagtagcaggggagggaggaattcaaagctgctactgaaagcttctgaccttgatctatcacatcatataggacaaagggctgagatactagcaggagaggtttgggttagcctcctggtagaacttcccaactgtgagagggtgaatcagctgtgacaggcagattggtcctcttgtcctcttggcccccttgggcagtgatgttgagggacaagaggggtggatcttagtgtgtgctggtctgcatagaggccaagatagaggcctggatgagacagctccttaaggaggattctcggttcttttgcctcccccaagaggggagtcctctcctgactcactggcacaattagtcttgagaattcaaatacaaggcaagcctgaccttgcgggtaaaaagatgacaccactgacccagtatctgccagccacctgcttgcactgttctctgtcgagcagcgctgggtttgtctcaatgccctcggacccttagctggccctgctctgcgaggcagctggcatgcttgggcagcagcctctgcccatggaacacacggtaaaccaataccctcccgagtgaatgtgcctttggtgctctgtaatctctgccatcgggtgcaggctggaaggccggagccacgctcagagccagccggagctctgggcacagtctgctctcttgtgctcaaatatccagatcgaggcaggggtcaggggagtgtgtactctttccccctcagcctccctccctgtttcctctcctgccagacctgtagacaagtgcaagctatccggacccatcaagaccccaagataccgactctaattatatccaataaaaggaatttaagcttctatcaatcaaatactttttcttactcacctaaagctgctttgcacccatcattaccttcctctcttcttcctttccttccttcctttctgtttccagttacttaactgatcccctgctaggtggtgggcactgtgtaagccctggggatatagaaagctgtgccctggggttgtctggagacggggtaggggtgtcagcccagtgctgtatccactctgccctgcagcccgtgggtaaggggctcgggcaagtgccctgtcttctggggatgattatgatcagaggggctggctttgcagagggtctgcatttgaagggcccctgggaggataaatggcattgaaggcagaattgtttttcagattaaaaagtggcataacaacgttgttcaaagtctggaaagtaaaaggaacgagaaacaatcaaatctgactggcttcctcacacaattgctctggtcactgcggtggggtgggtgggaccttagcgggatgttggaggtggtggaggtgagctgagggccagggcacccttgcaggaggccagggaggtgagaacagttgcagtgtggggccaagggaggggctggtgttccccgggggtccctgctgctcccaggagctgagctgagctggcccagaagccctcaccagagtcctggggctccattcccccgtctgctattgaaggggttcaggggcctcttttctcctttgttttgctttcagtttttcaaagcaacctttacaaaataaagcacaccaaacccgcagtagatgcgtccacagagcctgcatttcttgccctggtggacttggctggctgagggctgcctttcctcacctcctccccatgtggccgcctggggagactccatcaggccactcagagtcccacgcaggtgggggtgggttgatgccacccctggctctgatgggtgtgtggctcctacagtgggccttcttgccttcaggctccagccctccagcttccccattcagctcacagcagcatctaaccctccgtggtgaaggtcctctttctggactattccaaatgattccttgctggatctattgaggccttgggcgctcctccctgccttttcagaggctgatttgctttggcaaagttgagcttcttcactcattgtcctcgcctggctttggggccaatctctccatcagcctcggagaggcggcatcctccctggagcctgcctgcatctacccactccctcccctgcctgctacctggcaccctgtcttcctgcagcagaggccctccctcttggtccactctctgagtccctgctttctgtctgatggacagttctgaggctgtttatgggaaaaggcttcaagggatctggggtctggcaaatgatcagtcccttttcctttgataaccctccctctacttcctcagctgctcatggatgattcatcccctataaatctcctttcttctctatgtccctctccctgacacaagaccttctaaaatcctaccagagtcactgagctcacatagcttcagtaatcggctgcctccattaaaattaaggacagtgtcttagagtaggctgggaaggggtggaacccacgtccttgggaggtgatagtctttagatgggaagatccttgggaggccccgtgctgattgggagcatggccttgggactcaggctgtctgggcttgagccctagctttgcctcttgccttttgttgaccttggacaaatcatttagcttttctgggcctcagtgttctcacctgtaaagtggggagaaggctagtacctgtcttatagcattgagaattaaaagtaatcatctatgggcacctagctcagcgactgttatacaggaagtcattactaagcattaacttttgctaataccactacctgaccttgggtagcactttataaaatgcttccccgagttcaccttcaaccatcccagttcttgagctggactttgaaccaaggcctctggctgcaagtccagtgttcttcccactatgcagaactaggtgtctgtgaaccttttccccatcatcatctaaatgccaggctccatccccaggtgtgacccacttcctctgctcaggggtcctgcctccttggcactggtcgtcagtaaccaccaggctgcaggctatggcctcctccctttgagaaaacacatcagcatgcaagagggtgggaatgacataaggataggcctaaccttaagtccatgcaattgaagaagatgaagagaaggaaaaaccccacatcatctacattctttagtacataagctgtcctcagtcacattcgcttcttcattcaataggtctttactgagtgcttactctgtaccggccactcactgttctagatgctggggacagaacaatgaatgaaacaaagatccctgccatgcggcggttccattctagtggaggcagacaataacacatttaaaaacaaccataataaataactgacagagcctgttagaacttgagaaataccctggcaaaaaatggagcagagtaagggtgattgggaatgggggcattgaagagttgacatttttaaaaaggggagttggtcagtcccggccctctgaggaggaacacttgagccaagacttgaaagaggcacagaagctggccagacaaatatctggagaagagcattccaggcagaggtaacagcaggtgcaaaggccctgaggcaggggcccacctgagatgtttgggaagccgggaagaggacagtgtgactgaatggaggttgtgttgggagataaggtaacagggagtagatcacctggggtctggtagccatagtaaggatttggctttggcctcagcctctttatagaatgatacattgtaaagatctttctgtaatggcaggtaaagagtcttctcattttgttcagctgcatactattccactgtatgtgtgcactatgttttaataactaggtttttaaaaactgcctttaaatcatagaaacatttaagctgtttccaatcttttgctgtttccaaaaaaatgctgcagtgaatggcgttgcacatataccattttcatttgggtaagtctatctataggacaaatttctggaagtggaattgctgggtagaagaatatatgaagagataatttttatagacagggccagattggccttcataaggactgtattaattgatgctcccagacagtgatttggctagggatgaggaggagaatctatccgcccacctcctttaatatgcaccccccaatatgtgagatactgttaggtacccataatttcttgtactcctcatgactctcctgtgacctgagttctcttgttcctatttcacagatgaagaaacaagcacagagaggttaagtaacttactgatgcttacacagccaggtaggggtagagcttggattctgacacccaccatttctcagcataacatttctcaccatttctgacaagggtaggagtcctgaggagccctgccctgctgccccatgcagttggggtttgagaacctagggaataggaactgagttaaagtgggaagcctgcctgtccagctctgcccaatgctgtgcctgtgtcctggagacccttgcaggccagtgatgggggaggggagaggccagcccaagggatctggagccacagtggctgaactggccagccccagccttctccctgtcccctccctctgccagccccagtggagaggcctgagaggctgcggactagctaattctgctctggttgaggagctgcctgccgctgtctgccgggtcagcttgctccagggattaagtttcagcatttcactgatgaaaataaatcagcctcttgattgccctgcatggccctgggaacctctgcagcctggtgtgtgtttacagacttcctgtaagtccccttttctgtcctagcctcagggactccatggctgctgcagaaatagcctcagacaagtttggagcctgaagccacccgggcaggtccaagcaggagaggagatacaggcctgccaagtccaggggctctgggatccaaacagtgcctggtagagcatcttctctgagttgtatccttgaggatccagatccaaacaggactttagggatcacctatacttgccctctgccattgcacagtggagtaaactgaggcctgtccaaaatcaccccttagaattctggctctttggctcctagtctgctgctgcagccaggcagcattttctttaggtctgtttgttacaccgtggctggttagagatctaggggcagagttggagaggtgagttttagctgctgctggaaggatggaggtctgacattcaggagaaccctcttgcctttgggggatctgagtaacaggaacaggtgccaggactagattttctagattttctgaaagttgaggagaagaacctttccactccacgcatctgtctaggtaggatgagtgaccatggcttgtggacatgggaaaacaaggcaacttctagagggttctgacaaggtcctagctcattcttgtgcaaaggggactcaggagtctcaccccaaagtcccttttctcctgcccctctttctttgctcaagcattatttacactcacaagactatccctcagggacctggggtgtcctgcctcagacactcctggctccagaatactggacctcagttgttcaatccctgggccatttatctccctgtgccctgggaagcagcaacagagctgttgatggatgtggggagcttcagactgcccaatctttacatctttacagccagtcgatgccctggctgcttatctgggacttatgcctttgattgcttaaaaaaattgttagcagcaaagtgttctttgatgtgtgttcttctccttctccaggggcagtgagatcagattttgatatgaaagctcaaagcttctcagctctctccttcttccctgccttcctctctctgtctgcacattgcttgagaaccttcgagaagcagatgggcgctcctcatgtgatgcaaaggcagaaaggcccaagggtggtgccctggcttctgtctgccatgcaggcctgtgcttcatggtttggtggcctctgcataagtgagtcactttcagcctagccctagatgggcttatttggggaaggaagcagatacccacccagatcctccacccacctctgcacctactcatgcatgtaaccacatggactcctgtactcatagccacctctcatgcatggagccacagggaccccttgactcatagtcacctctcacacatggaaccacatggacccctctgctcacaaccacctctcatgcatggaaccacatggatccctctagtcatagccacctctcatgcatggaagcacatggacccctgtagtcatagccacctctcatgcatggaaccacatgggctcctctgcacacacccacctctctgcatggaaccacatggatctctgccccactgcgtaccccaactctgccccactgcgtacagtattgggagctgtaattataaaactgcccagccagtttgataacccaacttatatgtggatgctgagagaatgggcctgtttgggatcaggaatagtgattgacctcacttgcagagatggtttcattcgtgtgaattataaaccagccctgaggcagtgttctacttgtttccagaaatgctttgagctctggtagcattgtgaggataaatgcataaaattcccagggaaccagtttgatggggacagtgctcacttgcctgctggagtttgttataaaccagcattgtgactttattgtcactctccactccttttttcttgttggatcttctaagatctaaacctttgcctcctccatctcctttcttgtttctccttcctttctgggaagcagaaagagcatgaatgtcagagtcagactggcaatgtaatcctgagcaagctccaacccctgagccttagtttctttatcaggaagatggcataacaatatccactttgaaaggcagttgtggaaccaagcaagggaacttccattaacgtgcaggcacatactcaataacatgcctgcctcattccattctaccctctccttcgcccttgctcccaaagccccatataccctctccccattcagtgaggactgccactgacatggtgtccacgtcctgggagcagtaagggtggggagaagcagaagcgcggtgagtggatatgtcccgaccctcatccaacacaaacatctgcctgggagttgacaattcccttcctgagtaatcctctggcactagggctcctgtcctgttcttagggaacatgctcctgggcctggccctgcccactgccttcctgggatgggaagtgtgaagaccctggaaggctgaggccctgccaggggtgcctgaagcttgtcctgctccgatggccctgtcttccctgtccactgggctgggaggcagggaggaggtcctggggaggtctaaggacatgttttcatcacatatgcagctgctgtgcccaccccaggcagcgggcccttcctccctctatccccagacgtttgaaccttgacaccatgcctatcttgggagaccccttccttctcctgtcctgactgctccctccagccatgtctttctcttccttgatggctgtccatagaaccagaagttttagagttcaaagcttatctcctcccactcattttaccacgttggaaactgagtcccaggaaaaggaaatcacttgcccaagtttaagcagtgaagtagtggcccagatggggttgaaacccaagactcttgagtcttagttcggagatcggtctattacaccccaggctccttcatccctcagtctagctcagggcctctcacctgtggtactattggcatttgggaccaatacaattgcttgggaccaccacaacaattgcttgttgtgggggtctgtcctgtgtattgtaggatgtttagcagcatctttggcctgtacccactagacaccagtagtatttcctccaggtgtgataaccccaaatatctgcagtattgtcacacattccctggggggccctggctacctgggggtgctcctctttcctctaacctctcatctttgtgatctcacctgtcccacctgcagggtgtgaagtagtctttcactggagacactctgttctgtttcctccttctgttctgggacccggctgcttggaaaccaaagcactcagccattctgttctttacgaggaagaacaaagagccaggccaggaatgttgctttatacctacgaatgaaaagaaagaacttgacaggaagggactaagccttggagggggtgaccagggaggctgggcccccttcctccctggagagacccctcagtgtgggtgaggggccctggccacctggctccagctgtaggtctgctggctggaaggatggtctggagggaatgggggcatttgcttgacctacagttgggaagtgtgtcttcattgtagaattgtccaccaatatcctactttcctcgcacagctagacctgcagacatttgtggttcttctgtaatgagagttcacagtctctgagcacccatctcatggcatctgactgagatctggcagtggggaggactccctctgagagccaggggccctggtggcaatctcactccagcactgaccatgtgtgacagtgggaaactcttcccttcgctgacttggacagatgaaatcgggtgggtgggttgggcccaatgaactcacaacatcctctggcttgaccatgcggggattctaggaaattgcctgggctgactgcccacagtgcggtgccatgtggcaaatctggggtcttgaagaatccttggcacctgagaagtttccagaaggtatccagacccaccctcctacctctagaacttgtgttttatgaaactgccctgctcagggccacctcagggggtacaggggatactgggctgcctctgaagacagagtaataccatcatctttcaagcttagtttaacccacccactattgggaaagacttttctcctgctatttcctgtagtttgttttaagaaaaaaaattgtctttttttttcccccaaatagaaacatggtaagacgaagtgtattcttttttgaaccagatttgccatgccctgccctctgcccaagcccccaggaagtcctttcctatttatgcatgcagctgaggttgtgcccgtccttctctccttgtggtccttgaggctgaattcatctctgcaggtggaagtggcaatgcattttcaggcacaccattggcagtaatcagtgttgggataggctcagtatttgttaatggaatggcatcacatccttgtagtctgcaccattttggaagcctcttctctatgctggccattccaggccatgatttttgagcagagatcgggtgggccaaattgtatgtcctgaagcttaagcactgggtgtgatacatatgggctggtgagatagggtcacagaggtactgctcagggggcacagggctagggaagggagacggggaagcccacgctgcactactcgtgttctgtcctttggagcacttctgtgttctgtacactgtgctgagagcttttcatgtgttatatcagtctttgcactacttactgagatacaatgactagtatacccattttacagataaggaaactgaagctcagccaagtaattggctcagggttgccttaagctagtagttggtagtatctgtattcaaaccaatgtctgacttccaagtccatgttcttaacctggcagatgctgaagtgatgagaatgagaagggccaggcataatcttaggctgcattaacaaaagcatggtttccagaaaatgggaggtgacaggcctgttgtgcctcttttaagtcagagcgcccacatgggctgtttgtgggtcccttgcttcaaagtgataaagaacgactggaagcaagtgcagagaagcaaccagaaagtatgtcaggctcagggacttgcagggagaggggttgcctgtcaaaggggagattcaggagggcaggcacgtctcattcagtatctgaagggctctagcgagggggcgattggcttgttctgacccactccatcgggcactgtaaggccagttagtggaaaagagggctccagggtgttttttcctatgttgagctaaaatccactgttacggccccctaaagatgagctgggcttttggaggaagacagtaaaatccctgtacctggaagaatttgagtacagctaggaacagtttttgccaaacctgactctcttattatttgcagctggggagcattttcaaattcaaagtcccaggccccattccagacagttttgcctctgtgtggagccaggggatcggggttcttataaaactccctgggggctttctagtatagctagtccccctggatgatagtggagaaccatcagatggggttgccactggcaggaactattgtgtggtagtgttttccaaagtaaggttcaggttccaaagtatggtcagactgctaattatatatgaactgatattaggtatatttattttgatgtgtattggaaaaaaaggtatgtattttgcacattcaatctgggacatcatggatattgtgcttagaactagtttaagttaaatgaagtttatttttataacttacaaaataataatgtagatgatattcagatggacaaataaacatgaaggttgcgtgcaaacaaaatctctgctaatactgttgtgggttggttggggtggggacaagtgggtgaactggggtgccttaaacctttcaagagcccgaggtttgttggttagttctagaagactctatggaggtaggaggataattgcaatagtttgtccaaactgtggtcttccccaggtggagcctgaggcatagaacccctctgcttcccctcccctggtctccttatttttagtggtctctttgaagtctgtgacaccgagctgtcccattttatctcatcagtgaagataggtcagtggccagggtacagggcactgggtaccatttttgttcttccccttattttctttctttaccctcaaagaacagcagccagagaggggtgctgaaaatggcgaggggctgagggctcaggtgtctgaggggaaacacagggagtagttgggctgtgcctggcagggctttccctcccaatctcgctgtaccaaacttagctgggaaggtctgggcacgaggatggggtagccatagctcagggcaagcctgtgtctgtggaagcattttggggttgcaaactaactggggccctctgcatggagacaccagtcgctgaagctcccactggcctggccgcaaagcccagatcacctcctgtccactctgagaattgggttgggagattcaattgatatgcaaataagtcacaaacaacatgttaataagagtggggatttggtgtcttattatcagttagggactcctggcactttccagggcacatcaggataatggtgggaacttgagggccgttcacctgcctttcagctgcatggctctcggatctgggtggttgggaacgagggtgaggcattgcgaactctgaaaagtgatactctgctattcatgatttccacagatgggaacaaacagaataccaatagccagtcaattggaagcatctcaggtggcctggaggatcaatatacctggccagacacacactggccttcccaaagttaggccctccaaaatgtcaagttgccaagccagaatccaaagctttgcactgagaacttcatgttggggctcctgtcccctcctggagccctgcctgggtgacaccccagtccttctattcaggtcctgtgttcacctctgggaagtgcaggaccctgtggggttttttctttttccttttccaagccaaggaagtgttctggctcctggactctgccctgtggaggggaaagggggagagagagggaaaaaaagatttccaccttattgttcagcagctggaaaattgttgtcatctgttctgccttccatttgctgagaatggaaaaaaaatgtggaaaatttggggaaataaatctcaataccctcataggacctctctcccctccctctctggcccttgcatccctgcctttccgcttggggctcagtttcactttgctcccagattctctccctgcttctcttcagggcactggggctgccatgggtttgggactggggctgggctgggctacactgggactgggctgggctggactgggacccggtggggctgggctgggctgtgctgggaccaggctgggctagactgtgctgggtgagagttgagcaggggctggggctggggctggggctgggctggggttggggctggagttggactgggctggccacttttcctgactcccggccggtgggagtgaagggcttgggaagccaccgtgatgtcattcaagaacggcatagctgcaggatgataagtgaagccctggggacccagctggctgaaattacagacagttttatcccactggcttcctacaagccagagtgaggcagagcaagctgagctggggagagagcgtgcaggagagtggagggagggagggagtggggtgtgtgtgtgtgtgtgtgtgtgtgtgtgtacatgggcaggcaggcggcactggctcctcccacccctgacagtcggagggagcttgagtaggacacagacagcacttggagctgcagccatgtaggaattattgggaacttggggcaccaggatcaaatcagagcgggcttccctccgcttcctccctctccctccctccctccagagggtaagtgtctgctgggcagttgttttgcctgtgagtgttcttgtgtggctttctgctggatctgggctggggtgctcgtgcttctgtgctgggagggtgtggaggggcaggctctgtcacgaccccaccttggaagggcttgtggctgagtggggctgtggcccgctgtgctgctgtctgatgtggatgtgacgggcctggtggtccccttcctggacttgcttctgggacacgtaagagccatagctttcagggcgagggtatctgggttggtgggggggccgtgtgtctgagttgtcctaagtcttgtgggggtaacggttcgtcttgtgcgcgaatggggttggcagagggaatgaggtggatgcatggatagctctggtgagatgttattcaggacgccccctccctgcatctttggcctgagctttggggcacctccagtgctcaccattccccaccggcctcctgtgggctcccattcacggctttctcctgactttggcagagattttggcagcttgactctcctctagccagggatctctgagtgcccaggctggcaccctggcctggcagagaaggacttcagcttgttgtgggctctggagctatttttaccatcctgagtgtgcctgtgatatctgctgcccgtataggctgagggtaggggtgggagtgccaggctcgggttatagcttcaggctggggggaacacaggccaggccggagtcaggaggctgggtctgagaattcacatttgccctgcaggcgtgggccatccagggcagggcagatcacttgccctccaggcccctggtctctcgggactgaagtcaaggtcacgatcaggttttctgctcctactccctttttatggagggcatggtatgaattcaagtaagaagatacctgggacaattgccacgggtccttcctaaggagggtccggggacacatttatcatcatcgcttgacagaagcaccatatattatgttgtcctgtggttctgggtccacagacatagttggagagtccaccttccaatgcctccagccccagccatcttcaccttgaagcagcattagggacaagagcactgaatagggagccaggagttggttttgtacttccttgccgggtgaccttgggtggtcctgagcctgctgagcttcattgtcagcctataaagtgaggggtgggcagggggattaactactcccctaaggcccttcagctctaaaagccccagggcttttaaaaagctctcttggctgagccaacctcccgggccctggagatcccagttctgctgtcccccagagggcctggagcagcagaggcagccgtgggtgggaggggctctattttttatttcattctgaagctgactttctccatcttcaaggccacaggctgacattgagatttgggctccgtgtgggtcttggaccttgagcctccctctttttttcttggactcagcagaatgggaaggtggccaggagaagcccagctggtccaccctccctgggtccagaggcaagcttgtaggtgacactggtgaggtcacttgcttagaggacaaagccacctgcgacaagactgacagcacagccctgagaaaaatcttgttctctcctgttcactttctgaaggtgtgtgctattaaatggaaagaaaaacaggtgtctatttgtcactcatggactggtctgtccctgcccacagggttccaaggccctgtgcttgttgtgggctctggagctatttttaccaaaaaatctttggtaattttttttaccaaaaaatctttttacgtgttcccaacgtgcacctaagtctcctgggctgcacttggcacctgccctctttgctgtttcagaggctgtgtctcctctgtgtggctctccttcagaggttccgggatttctcttcaacctctaattctgcagatcttcagagcccctgcagaagcccattccccttgagaaagttccagagctcgctgcaggctgtggggaacaaagggctgcctcaatccccagctgtctgtgggaagggaagctggcatgggtggaggccaagactgtcacagactgagccccaggaagtccctgccaccaatgccaggatgtttcaggaggtcggggtcttcctggagccacatgctggggttctccacggggccctctgtaccctcatgccttcctcacatcacttcccctggcaggttaaaacccagtggagcaccctgagccacttcttaggctcccgcagccgcaaagcttccactcagtgtgccgccccatttcccctggatggagcctggcattctccatgcaagtcatgggtgacagagaggatccccagagacagcaccctaacttttcgatgcatatgttgtatcttgggatccacagatggtttttggggtgttcatcaactcccttatttcaccagatctcccaggggtcctgggtctagggaagttaatgtccactgggctggagtgtagctggagaggtctgtaggggatgccatggggtaggctctggctcagggacctccaccatgctcagcctttgctgcagaatatgaggaatacatgtcttcatgtttcggctgcactgactctcttccctcacctttggggagaaactcggggtccacctagaacccctgatttttcactgggtggtggtgaaagaagagtatctcaatggctgacagaactacataaagctttctcggctactcggtgtaaggcaagaagcatttatggaacaagcactcttctctagggccattctgtacagccatgcaggttacatattgaacttcaagaggcatcattcacacagaccacattgtggatggcaccgtctgggaaccggccctagggagagggagagagagagagagagagagagataaaggctcttcctcaacaagctctcagcaaagtgggaagacagacatggacatcagtaatgaccattctgtgggtgactgttgtcacagtagagatgtctacaagggacaacaggagcaccgtagaggtttacctgagtctggaggacagtagggaagaagttagattaagggaaatttcccagggaagtttgaactgagtctgaaagcatttgcccaggaggttgggagtttcacgggcaggatgaggaagggcattgcacggaaggaacagcatgcacagaggggaaagagcatatgaagagttgagtaggagtagagtggagggtgttctgggtatggaggacaaggaagtgaggcttcagaaggtaggcagaggcctgttgggaaaaggtctgacatttccagcgtgggggttgggctttaccctgtgggtgatgagagctgttgaaatgtaaagcaggggatggagagaggaaaagtagagagtgcttggatatgccaggtctagcttaagagccttagctcctgagtgctatcactcagcaaagctgcacacacactctcgaatcctcacctgacaggcctgcaggccgggctctgagtgggtaagtggtcaatgcaagctgatatggccattaagatggcagctatgtttctgagtgctggtgtgtctggctgccgaggtggggtgggaaggcgcacttccctgtctcctctccagagccatcccttgtggccttcctggacccagccctccctcctgtcctggtgcctgccccagccatagcctctcctgcctcttcccatggctggggcagagtgtgtggataagggaaaatgcaaccagaacttgctctctgggcaggctcttggccaagcttcacttctcatcaaagctcacctacctctcagatgcacgtggccttggattccccactcctccttttaaggagttttgcccagtctgcctccaaacagcctatgtctggggtaggcacggtgcttcttcctattgtcatggcactgattttcccccacgttgggtggtcatcacggctctgggtaatgcattttaatgaattgttatttgctggacttggacccaaaggactttttatcatgaagggactcatcctgaaaaccttagtaactcattcgctattcaaaacctacctgctggtccgacagggaagggtctgtcttcactgagtcattgccaatgaaggtgactcctttcttgcagtcaatatggctggcaccttttattcttcatggttgggccgtctgtcctaacatctaaataagcaaaacctccctacttttcatgaggaagagaagtggggtttcttgatctcagagcccaaagtgctgatcagctggggcgggtttctctagatgtcctccagccatgtgtgtgccaggacccctggagagctggcaaaaatgcagattcctggccccaccccaggcctctgagtggaagtccctggggatagggtcctgaaatctagatttttaacaatctccagaggaggttcttgtgaacatcagaattagaaaacagctgccctgaaaccgtgtgactttaacatcccctatttgtttccttcgttcttttttaagtgtgtgagatggctgcatccttactttcctgcatcccagcctgagctgcatggctagtgccgcacacacctctgcacccttttctgggagggagccccggggagtgggtgcacaccctagtcagctggggattttcctcagagctttccaaaagcatgactcgtgcatctggattatggctgccctggaataaaggccccgtggtgcaatcaagctcagcatcgagggtggagtctggaactctctgcagctgctgagaagagcagggagacatcctcagacaaagacagtggggccatggagagattttgggttttgcaaccaccaagaggaatgggcaggacactggacctttcagcccacaagagcagatgtccaggctggctgggcttggggcctggagctctccacttggggctgcctgcagcttgtgtttctgcttcagtttatcccactccattgtcacccgtgacaatgcccacagcccccaaacatgcagacccctccctctagcccatgccccattgttctggatgtccagcctcctctcatctgagatgcattcccctgaactgatcactccctttgtggctgctgggacttcaagaggatggctctggagacccctcagattaagagctgtaaagccacctccccagcctcccttaagtccctctcttatcctcctctaccttatttcactcctgtcctctctgcccccgtctctcttttgcccttcctgccttgatggattgaaaccaacattgtgttccggcttcttgtggtcccggtaaaaagctctaatgtggccgtggtggatggtgagaagggaatgatgagagtgtgtgtgccggagtgggggctgggggacttttgtcttgtctctggtgggaggaggaggggcacgtgctccacagatcctgctgctatgctggggtttcagcagagtcctcatcagggctggacaggcctgggatcagcctgggtattctcaaaacctcccttggataggaagaggacaactcagcaaaggtgctgagtggcctggagggtgcaatctggggccaagagacatttccatttgtagttagcgaacaggagttaattaaacaatttgcatctgttcgattttcttactatgccttagtggcttggctatgattgttcctgatgttgttgctgcaaacaggagcccacttggggatagattacatgacagaacaagtttaacattgacattttcaaaatcgatgctgagtggggcttggccacaggggcaaggaagggctgagatatcaggtagtcaattctctctcctgcctgggggatgccttcatagtttttctgttagtcatgactgagatgctgcaggggcctatgtgctttctgatttgaatttgcccccatggctctcactgtggaacatgtctaagtggggaagccactggacacaccagcctttgctttgcagctccccacttctcagaccacatgagcatgaacgtgggggatgaggaggcacaaaggatggaggggatcactggcccaggagggaaattctggcacctcacagtgtaggtggcagagggggtgccctggctcaggagggggcctgcagctttctagggacagtgagaaggaaagccagctcttcagatttcggccaacttgtccaaggggccccatcctcaagagaaccaccccagagctatgagtgcatcagaggctcctgtcttcagtgctttgccccctagaaacaggcggctggggtctcttctttttttttgagatggagtcttgctctgtcacccaggctggagtgcaatggtgcgatctcggctcactgcaacctctgcctcccaggttcaagtgattcttctgcctcagcctcccgagtagctgggattacaggcatgtgctaccacgcctggctaattttttgtatttttagtagaggtggggtttcaccattttggccaggctggtcttcaactcctgacctcaggtgatccacctgcctcagcctcccagagtgctgggattacaggcatgagtcaccatgccaggctgaggtctcttcttttatgtgtagcaaggagctcagttctttggagagagtgggcatgaaggtcagcctccctcatcctacagggagaggacccctttacgatgataatagggggttggaagaggcagctgtgcctggtcctgcatcttagcagcctttaggggtctaggcacagggccaggttggtggagattcagaatgtattttagccaaaaccccttttcagttcagaccagccctgggccctgggccctgggctgctgcaatactttggtcctgtgttgtctggggctggtgttggctgaggtcccaaagccttggggaaaactgggggcagaggggtggatctggagaggtcagtaaatgaggagggcatccagtccctggggtgtgtgtgtgtgtgtgtgtgtgtgtgtgtgtgtagagggatgcaagtgcctggtggagcatctttgtgccagttctctgtgttgtaacatggctggcctgtggtctgtgtgtgtgtatgttgattgggatgttcctgttttgtggttgtctgatcacttgtttttggccatgggcttctgtcagagtgtttatttttagaggctgccacttctggcctaagggctgatccttgggcatggtaggaacatttgtattttctgaaatatttgtggctttaagtatttatttgggggtattcctgcctgttatgtgtttattctaatttgtgtgtatgtgtgtgtgtgtgtgtttgtgatatgagggaggtgtagcataataaaaattacatactgtttgaaggaaattagctctgattttaaatcttggctttatcaggtagcattgttggcacataaatggtttcccctctcagaggctcagtttctcccttactgtgatgggtgtaatactgtctggctcggaggcgatggctagagaggatgtgcgtgtagagtgcctggcgaagtgttggcgtttgcgctgtgctcactgcacggtggtcactgttgttggtatttgtgtgtacatgttcatgccggtgctgtctgactgtggttcttggcattgtgtggcacctagtgtgtgctcatgcctgggtgtttctgatttgggtgatctcttactgtctttttgtctggctcggtgtgtgactgctggtgtctggctggagctggtgcagtctttgggagctggcttttttccttgctaacggagagcctggattagagtaaggggaggtgcgtgcgtgcgtgtgtgtgtgtgtgtgtgtgtgtgtgtgtgtgtgtgtgtgtctgtcggggctggtggctgggctgctgactgtacagggtgtgaaatcactgagttcctctgggcggggaagttcttcattcctgagtcagccctttggccccgagccacccagcgctcactttttccttccagagaaagtgttgctcaggggggtcctcagagctgtctgcagacaagaggaccctctcccccatgaagacatcttgtttttgtgttcacgatccctaagacgcttcccctcctgccctagtccctgaaccccctgcatcagcaccctatatgccccccatcctccagcataggaaaagcgtgtcccctctggcacagggactgttggcttggctgagccccaccttggcctgttcttcaggggcccccgggctggctcagagcagtgggatcaggatgctcgtctttgcagacctgctgtgatcctgcccggcataccttcccaggacccgcgtccctttcctggagtcttgagtggtatgggctgagcttgctggtggaggggtaggggtccatcaggagtgggcagtgctggggaggagctgggaggagcctctggaaatgtggcagtgggcagcatgaatgacattgtatctctgaatggttctatcacatcctttgcattgagctggagacaaatctagctgagggcaagcttgtcttagagagtcccagctctgccttcagcctccctgccaccaccaccttgggcatggtggggccctttgctgcaccctactgccctcctgggttctccccctgcttccgtgggcaaaggctatcctcggggcgactggccgtccatgctgatacctctatgggcattcaaggcaatggctactctcctggcattctgcctctaatccagagtgggaactccagacatcgaagcaggggtgagactttttgagatggggtggcggaggggactgaggatgctttggaaatggtcattcaggaattaatgatactcataatggtgatggttagggctcccagctgttgaactcccatcacgtgccaggaactggtctcagcatgtcatgtgtcaactcatttaaactcaaagcacagtgtatttaatgaatattggcaatttcagatggttcaaccagattctattattatccccattttatggaccaggaggctggctcagagagttattcatgcctctggtcaggaagctggtgaaatgccagagctaggcttgggactggagcgatttgcccccagcacttcctgctcagtgttgggctccactgcccggccctgaagctgagtgttggtgaggctctgccccaaagcctggggtagaggtctttctgtcagctccccttttccccacctcagggtggtgagaggaggttttaggatgcagggcatgggagctcttagcttctttctctggcagagtggatgatacccctgcctcccgctaatgtctgttgtctgttgtctcccctccggctctgtcccttgcagaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggtaagaggtattcagtcctgactccttctaccccttccttatttggtcttgctggggggaggtgcaggtccagccatgacccctaagcagatgttgctttcactggtgggaggaggctctcaggagcctatatgctagccagttatcccttcctgcattcattgtctgataggcaccaagccagacaccaagtttcaaagttcaatgtcaagcaattcctgccctcaagaaatttacagtctagtgagcggacagatacacagacagatgatttcattagagagtaatgtgtacggtgacagaggtgggaccaagatcccagagcctgggaaagcaaagcttaccacctagggcagtcagggaaagcttccaggaggtggtgactttggggttggagtacagactttctagacacagaggagactctgcaattgcctgtcgtgctgtctgtcctcagactttagttccttgggggagacgtggagaaggctggagggaggcctttgtagactcaaattccctcttaggtcccgctcctagaggccatgaaagagtccgagagggtatcctcaagcccttaggctctatctgctggggcggggaggccaaggttccccttctaagtcagttttcctgttagtctttgctgaggaccagccctgtatgggaagtaggtgctgagagacaaagctccttttcctatcagagagtgggcttctcttttgggagagaggaaagtgggacactcagaagagcttttggggagacaaaggcaagaaatgacagcatgtctggggccatgttgggagagacagctgcgaggttcccttcccactggtctaagcctatgcccattccacaagggtggctgaacttggcaggaaaacctgttgggtgactttattctggaggtggagcccagacaggggtggaccagagactgtggatttgggtggaccttgtgccagcccctcagctgacagggtggtgggagctcagcgaggaggagaggagcctgggcagctgtctctgtcctccaccccttttcctaaatttaggggaagctgagtcaccatgccagctgcagggagggaaggaaacaccctccctggagatggaccgtgggtttagggaagcagcttggggcaggccagctggctcaggacctggtgtggggacacaggctccctgctcctatacttcagagcagagcagagtccccagctccactattggtataatagcttgaaattggccattgcaggagtatttacaccatggaaattggcaatcagcctcacctcccatagagagctggcctagcagtaacaattccttttacctgagcatcggaacaaaggatgggcagttcttaacctcggatgaaacgctccatgggtggtccatatgggctttgacttctgccttctcccacatctgggcccctgagataaagatacccccctggctttgtcagcagagatccttttcttcttggtttttttgaggtgagagggatggggctttctgaattccctgggaatttaattcctctcccaatattttgcaaggttggagtggtggcctaaagattagtgacacgctagtctaatgaggggcaggatccaggagccttctctctgggggagcagaatacatttcctcccctacaagaacccttccatgcagctctcctggagcttgctcaagaggaggccataaccctaatggccctgggaggatgcccatcttgtagtggactgccttttagccctttctctcctaccagctttcgaaggcttgactgtcaacttccatattctgtagcctctcaggctttggctgccatgaagtcatagatagggaaggatactgttggcacaatgttcccattccctaaccctgttgccatttcctccatcaactgggagtgactcaagagaagggatgaaatgtatagaggggacacttatatttggctcccaggtctatgaagttgcctctttggttcaagccctgtcattatgacagaatttatgtcagcaggtcctgcatgagtaacttccttagtagcctttcagggtatctgcagtgcctgtgtagataaaggcagacagacaagatcaatgtgtggaaaagtctgggaggcagggaagatagatttcagcactacttctttctgctctgtctacatctctgccgtaagaagctggaacatacactttgacatgagtaacctaggaagctcagatctgtgggagaacctcttcatggccatgaacttgatctggtttctcctggctttcctcccccaggtctgccttttccccattggctgtcctccatacctcagtctcaagtccctggtttattccactttgatccaatcacccttgtgccttattccagcttaagttgtagaggagaaggtaggggcagttttctaatttgataaagggtagggaccagaaatttatagcatacatcacactttcctgtggagcattggaagcgttcctattagagccagggacaaaataaggatgtctgttatcaccacttgcatctaacattgtattggatgtcctagccagtgcaataagacaagaaaaagaaataagagtcagagttggagagtccaactgagttatcttatgtccctgattctgtggctggactgatctcagatgtctctagaggtggagatttcaatacatgttggaaatcagatatggatcttatccttaaggagtctagagtttaatagggggaaaaaagaactggaactttaaaatagtcttttgtaataagagagataaggagaaagctctgcaggagagaggtgaagcgattgctgtcagctagtgatggggaaggcagtgttaagtgtggttttaaactgagccttggaagatggaataggattttgaaagtaaacgggatcactgggcagagagggttcacagtgaagacaggagagcacagaaaatgtttggagaatggcaagtagattgagaacatatggtctgtgtgagtgacagtcgggataggtagcctggggtctgtctctggatgatcttaaataccggactaaggagcttgcatcttacctggcagcaatgtaggaagccattcctgtggtttcatggggggaacatgccatgaccagagctgaggttcaggatgatgtgtctggtgggtctgggcaggaaggacaataaatgggagagactttgagccaggagatgataggagcttattagatagcctaagtggtgcggggctggattagggtgctgaccataggaatgcaaatgaagagatgatgcagtggatactgtgggggtagaaccaatgcacttatgtgttgattggctggagcggatgagggagaaggatcatcaaaaatgattctgagctccatgaatagaaatagaatgatggttctgttaacaagcaggaaggcaggaggaggacgttgggtggaagatgaagccttggtgttagacatgttgagtttgaggggagagtggagcctccagggagagacatatggaaggcagctgaactttggaattgagtgtgaaagaaaaggaagagctacaggttttggaatcattctcacaaaggtgatggttaaagctttgggtgtatgtgagatctcaatgtcagagggcttggagagaaaagaacttaggatggaatggccatgaagggaggtagaggctgtaaaggggctgagagtgagtgttcgggtggtggcaggagaccaggacagcatgtcatcatagaagtcaagatggtaaagggtttcaaggaggaagggcaggagattagcagtgtcagcctgaagagatcatgaggaggactgagaaaaatccactgggcttgcaaattaggcagccctgtgtaaaacatcaaaggcatatttttagtgcgtgttggtgacagaaaccagactgtgggggattgaggatgagtggagaaggagtgaagacagcaagccaagtactcttttcagtggttttgtgataagagaggagagagtggtagctaaagaggatagtgagtgattgggaacttttttgtaaatataagagtcatgagaatgtttgtatgtagaagaggaggggagtaggttggacatggggggaggaaggatgagaaaaagaagagaaagaaagaagttgatagaataaggtctctaaggaggtaagaggggacaggcctaggagcccatgtaggtaaattaggctcaaccaggaggtgagatacctcttcatgaaattagaataaaggatagataaagatagagggaaatattgatgtcaagctttgggagcttgaagtgaaaactcttgtgtttttttttttttacattttgttctgaaaataggagatgagttgaaggctcattcaatcattcgattcaacatgaacttctaatgggtgctgcttgccagtctaggctttgtgaaaatggtggcaaataaagatccttgcccttacagcagagatggatactgagcaaataagcacatatacataggatatgtcagataggtgatacgtgccattgagataaagcagtgagaggtagggggtggctggctgcactttacatgggatgatcagggctgggcagcgagagatgagccccatggagcaacaagtgcagaggccccgaggcaggagtgtgcctggcatggctggagtagagtgatcaagggaggcatagcaggacacaagttcagagaggaaatgggaacagggacagcttacagagggtctttgaggtgattgtaagaatggtggcttttactccgtgtggcatgagaagccttaggaaggatttgggcccaagagtgacatcatctgacttgttctgaattgaccagggtgggcaggatggaaggagggagagcagttaggtggctgctgctattgatctgggcagtggccatggaaaggggagaagtgctcggattttagacatattttggaggtagagccaacaagattactgatagattacacatggaatgagagagaaagagaaaagtcagagacaacgcttaggtctggggcctgagcaactaaagaatggagttgctctttattgagatgggtaacaatttatgaagagcagtttcaggggaacactagaaacatgacttttggacacattaagtttgagatgaccatgaaacatctgcagtggttggataaatgagtcaggagtttaaggagaagaggctggaacttagagatatgggaattgttgacgtgtacataccagattaagcatagcactgggcaatgtcaccgaggggttgaggacaggtaaggagaggtcccaaggatggagtcctggaacctcccacattccaaggctacagacaggaggagggaaccagcataggaactggcatggagcagcttgtgaaggagaggaaaggtaacatagcttgaactctgggggccagggcaggggcaatgttggccactcctgtggcccctgtggtgtgaaggtgggttagaagtcaacaaggggcaaggaaaggataacatagcaggtccttctagtgcatctgagaaggttcatcttaaggacttttctggtgatgaccagaagctgggggccagagcagaaaagcacaaggggttccccaggaaagaggatcactcagatggctgtggtaaggagccagggtgtgagagagggtgacccttgggctcaggctgggtgtgttacctgggtccagggagaggcaggtgcccaggaaaagatgggtggtccagggacaggcctgctgcctatgggagcaggtgagggatgcgtgaattctcctggtcccacgatggcacctctgcttccaccctggggttagaagagagggaaacgctgtggtgctggccagcaggaggtccatctgcctcttggagaagcaggaccttggatccccctctcttcctgtctgataccttccccacctccctccagtgtgtgcccagataccagagtcagaacaccaactaatcttgattttctctttgtttttgttgtgttttgtcctgtttaatgccccgtcccctgcactctctgtgtttcccatgtccatctgttccctgtgctgttggtggggtgcctgccttgccccatatcctcccttccttcctgcctcccactccctgctggctcccctggggtggggggtgggcagcgtacaacgccaggctgcagggcatcggacacagtggcagcttcccgccccctcctctccaccggctccaatcttcctccctctctggtgggtggctctccttcccccttctccctttccagctctttggcccacttttgagcatcagtttcttttcactccttcttcatgtgctattccttccaaatctttcccaccttcttccttctctcctctgtcttttcctctccctcttctgttgttctctggtttccatctgtttctccttctccttccccatttctcactatcctctcttctgtctcctcacttacttctccatccctcctctctccagccctctctccctcctgtctgcatgagccagagctcacttctgcatgaacatgggcctcatgctagccttggccttgcctgctgggaacaatgcctggaataactagactaacattcagggtcccctgaggagatgcaggcctttgcaatgagggtgctcaggagggctctggacagtccagcactccggccaccctggccagactgcctgggctgcagggctaggtctcggcaggagccaggctgagctttgcatggggccaccagacacaacacagagtggtgccccagcccctgctgctctgtccactctagagcatggcacaccctggggacagcgtaccccctctggtcccactcctaatctctgatcccatggccaagagtcagaagccctgggttggggtcctggccctgcctgagaccacctctgtgaccttgggcaagtttcttaactgtttagagctcaatttcccagtctgagaagtggacagatgatagtcctgtcctgttgtgtattttgcacggtggtttgacatgccctggaccttgtggatgcttcactggggtcacagtaattcatttgagaatgatgccgtccactaacatctacccctggcctctgggacacgcaggcccttaggcgttgagccctggccagggaatcacctcttccttcccctgctcctctgacactggaggctgggtcagggaagatgccatgctcaggcctgccctacaccatgcccctgagcagctccaggaaaaggcctaggggcaatgggaactgttgattcccaatgtcagttatctggtgcctccatggtcccttcttctcccagtccagggatgatcaggagatggctctagcagactgctcccttcaaccgcccctccctcctttcttcttcctctgcccttctctcagcccagtggtggggagtgtagtgttcagctgggcctgggtaggggcaggttctgggatggtgggcctgcctcaaggggagctggcatggcttgccctagggctgctagtgtgatcgccgtgtggctttctggcaccctggcccagcaggtggcctcccggatcccctcgcttctggagccccaggcatgctgtcggacacccagccctgctacctggacctgaggaatccagtcttttggaaatcggaagactggaaagaagagctgggtctgtgagggtggcagtggccagtctggggggtgcagaggaggcacatcatgaagcctgacaccagggtactcgtcacgtgatccaggggtggtgggcagcagtgctttgccaaagtacatgtatcggtctgtgtcagggctacagctcccagaattgcagggtgtgcgagtgtgcgtgtgagtgtgtgtgcgtgtgtgtgtcagatgaaggggattaattgcctccagtctggctcatgctaggggagccttggagtgagctgttgtccagcacagcactgtcctggcagaagagtgacgcctccctgggaagggggctgctctggtgccctgctcctcaggtctgggggcctgtgtggaaccctggggctggggtaactgctcatcctggcagggctgtggggaaggcctgatgcccgtgtatgaagcagcccttagagaacgcccagggctccttgaacatagggtgttagggtcctaaagatactttgttgtcataagggtaccccagccttctcagcctcctgggagcttctcttcctttcttcctctggccacacggcctcctgctggggtaggggctggccctagaggttctgagggtgacccagtggccccactatgtacccccatcatcccagtgtcctgctgccatttctgttaggctgtgtgtgtgtgtgtgtgtgtatgtacatgcaagcatgcacatgtgtgtctgtgcaaggcacctgcctctgcctaggtgggtgtaggagacagaggccctgagagagagaatggggccaaagactgagaaagtcctggggtggagggtggtggcgggagggagggaggtggggagagcaggcctatttttattatcagtcagactctgggacgtgagagagggtgttctctccatgacactggttgtcagcttgtgtccagacaccctagcttggctaaggaacaatggggctctcttctctcccctctgccacgccagtctcccctcccatagagcaagacaagagagagggaacatgtctctccaggcactccaggcggatctgggcttgccaagggggacaacagtgggacactgtgttcaaagaatgtgagtggccctgactggccattggtgccatggggccattggtgctctgcaggggaggggctggccccgtgggagtggaatgcagggtcttacccttccgcagagggaggcactgccctgcagctccttagctctttggaggtcattccctccatttccctgcctctggtcagaacatgctcccacgtgccattctggtggtgatggagagaggattgggaaggtgcagctcaccctcagatggctgactgcctcatgccaggatctcacattctctacggatgtcaggtgccccctgcaccccaagctgctgcaggcatctgtggcccctgaacatggagaaagctttgggaaggttgggcagaatgttctttgtttgtccaggagattcggtgcctcaaatgcaaacagatctattttttaatggcaaacgtcagatccccaagcagggaaactggccaccccttgaaaaggcagagggatctgccagaaagagctgctgggggcagaggagcccggaactgagaccagccctaatgcatttattttaaccttggggctgaactgagttccaaaccccaagagcgtctcccaaatgggcttcttctgtcacaattattgttagaaaatcaatggctatgtctgtttctctctaatgtttttgccaggaatgaaatcagtggcagtgttggtccaagctgcccaggagacctgagtgggatgggggctccggggagctaaggcctgggagcctggggttgctgcagggttgcagcaagctgcccacccttcccaaaaccacgcccttctttccttcaggtagatgctcctggcagcccctggctgggtctaatgggactcctatttttctgttctgcgaataagggctcttcaaggtgtggggcttgtttgctttaagtggaacagtttgtaagtggcagagtgaggtcagagtctagtttactgtccccatcctgggcgctattttcttagctgagatggcagcagggctgcccctgattaataaaaagcccaaagcggagactcagggcaccactcggtaccttctgcatttaatgtgcaaatgccagtcctgctgctctcctgatgcgccccccacccccgattatgggagcccctgattatgggagagtatgagggcgtgtctcagagtggctgtgcctatgtgagtgtaagtgtgtgtctgcccgtaggcttggcagccggcagcctgctgttcatgacaagtaggaaggcttcccaggtggcgctgtttatggcagcctttgtggctgtgccagactgggggtgctggggggcgtggctggggacatgcagtcctcactgtggatggcagaagatgtttctgtctgaatgagggtgatttctgcttggctgtactggcacattcctaggggctggcagtgtgtgtgcagtgtgtgtgcacacacgctgacccatgtgacctgaggcctttgttaagtcctagtggtggtgaaagcagggcggggaatctcttcccagaagagagtcaagaccagaagcccacgcttcaggctgggtcttggcctctgggacccaggaagtgagttttctaggattctgggagccagctcaatgaggcaatggattccgtgcctcagcccagctgtgggaagagggagtgggaaggaaggagggtgagattaacagcatccccaggcctgtggaatgggattgggatgggaagtacagaaaagcagatggagcacacgacttctctctgtctgctcttcagctgggagggacatggtgggatccgccgctatctttggggcagggaaaagggggcggggagctaagaggccagtataaggggagttggtaagaggttcagcggtacaccggatgaagttggggaaccccagagaaagccaaaaatatcccagaggccaactggggctggggacttcgtaacaaggcttagtcatgtctttgtttctccttgggagcaccatttgcaagatgatgcaatttagccctttccaagagttcttccccacaggcttgatgttgctggttggttgatgcagttgccttggagactgtcttttccctccacctcccctcccttgtctggaagctctggccctccgcctccaggggttggaagtagttgacatctgtttcttgtatcagtcctttgtgttcttggtctcagctctgtgtggagagattcctggtgaagtctgagccaatctaagcagatcccctctcctgcagagaaaacctggggtgtgaacagagttggacccaggagggctgaggggaagacaatgggggatgacaggcgagccccagcatggcctctgagctaggaggcactgccttctctgatgggattaggccgattgatcatttcttacacaaaaatgctcattgtcctctacaccctgctttcctcccaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagaggtgagtccttaagctgtatcttggggctatggagggtagtggtgcccactttaaatctccagaaacctgatggtcaacttggcactgatatcagtatactcagtgatttgtctccccctacgtcctcacccaaactctcttctctgacatgtggagtctggggcccattaaatagctctatgttcccacttcttgcattaatattgagattgaagtttcctttttgattcctagagagagtgccttaataaggtggtaagaatcctggggatgatataggtgaacacaatttcaaaactccaaactagatcctggagagtggcaaaattatttttgagccctttgcagatataaggtttttctcaggagatttaattttcattccaaaagatttgcatttctaagacatttcagtagttggaggcagtgagtctcaaacttcatcatgagtaacaaccaatggggagcttgttaaaactgtagcttcccaaatccacctccagagatttcagggtagtagatctggatgggacccaggaatctgcattttaaatgtgtgccctggaagattcagatgtaggtggtccatgggccacattgagggagcgagtgtactggcctataaaagccaggctaatgagtcattctggatagaagtggcttgtggatatcttttctctcctgcctgtggcaggacctgtctcctgccctgagcaccagtgaggagccaggctgacgaggggatgtgggggctggttaactcactgtcctcatacctcaggtcatctgaaggggaaatctctccttctcatggtttccctctttttctcccctgtgttctcccacagccccatttgcacagctacaaggaggccttcgaggagatggagggaacctccccgagcagcccaccacccagtgggggtaagaattccctgtgaagctcgtcttccctgtgtaccctccagcccctcagctcaaccctgcctgtgggagtgccccaggcctgagggttgggggtgacagtgccccaggtggggccagaacgtgctgctcctcactcccatggccccttctcttccattgcttgtggccattgtcttctccgtcgtccacactcacacatctaagggtgcagccgccccagttttagggtccagactgagtgaccatgggactctgggctcccacattatggagttttcttacttgttttgagtctttttaccgtccacactcaaaagaccctaccatcttagcgtgactctttgtgacttgactttgactttgtttctgacctccatttctgcctgcatccagacacctcttccattccaggcaacctatttagcttctaccaaggagagagggacccaggaccctcaggctgacagagcccccagctcatccatccttggcctccaggcagaggcatttagcccccagcccctatacacttactggggaggcagatccccaaaggacagagacacatccacctaaggccaagacccaaatgagccaaggcatggggcagtgttcctttttatagaagaagagacatgaagaggaactggaggaggtggttgtggggaaggaagtgatggattaataccaggccacgagggactcagtgtactcaggagaggcctgggtcagcacaaaaaggagacactggtgctgttcagggatcaggttggctgggcctggctcaagctatccactggccctggtgagaggagggagaactggagctggctgtgcattcccctaggggctggctgtcctgtactggagaggaatgtggcaatgtacgtggcccctgtgccaacagaacttgtgttggctgccatcttgggcatgaggaggctgaagctgtgactgattggtggccccaggaagccgtggctctcccttgagcagtactgtccaatggaaatatactatgagcacatttataatttaaaattctctagtagtcacattaaaaagcataacaggaaactggttacattaattttaataacatttttgttaaatccaaaatatcctttcaataggcaaataagtcaataaaaatattgagctattttacaatctcttataaaatttaagaagaaactggtgaaattcattttaatatgttttatttaaccccagtctaaaatattagcatttcaacgtataatcaatgtaaaaaagaacgggatgttttgtgttctttttcatactttaaaaccctgtgtgtgtttcacacttatggcatgtctctgttcacactggtcaccctgcaacggctctgcggccatgtgtggctcgtgactgctgtgctggacagggtgagcctagagcaggttacgtgagagccagctctgcagcctcttgtgactgcggggaacctctctcactttccatggtgacatctgcttccattcactgttagctgtaaatggccagggaaaggacatcaccttgccttgggtggaagccacctgggctgtgctagaactgggttttgccttcttctctccctcctcttggccagccatgggtacctcggtgagaagtcagaggttccatagacacacagggttagggagagaagacagaaggtggagaaacgtgtggaatttttctctcaggaagcaaaagacttgcctggctttagcgtcgcccactcatctgcctcagcagaagggcccaattgcccaggaactgggggaacgaggaattcaggagctggaggtgaacaagggaggaaccaagagagagctcctgccctgtctggtcctctcgtccgcttcacctcctcacgggcccacctgcgcctccgctgcaccagttggttaaacatgcgcgtacctgtgggctggggctgcttcgtggttattccatgaatgaccgtctctgaggccaggcatattatttcgtaattaatttcattcaaccgccattggtttgacaaacattaataagtgtttgataagcgtctatgagcaagacaccatgacagggaagagggggtgtggcggtggtagaaacagaatctgtgtgtgtctatgtgtgtgtgtgtgtgtttgtgtgtgtgtctatgtaaagacagagggaggatagacagagacatgaggcctagagctatcccatacctggaggtgtatgtttgtacccatttgtcccctatgctgtgtttgttctttggacatccaaggacagagtgagggtgaagggcaggggtgtgccactcatccggacccctgtgatatcttcctgttcccacgtgcatgtgggtgttcacctgcacaaacgagttatgtatgttgcttgcatggagagagagtgtattttttcattgttgtaagattcctgtaggtctgactgtcttttggggaaagcagcaggggcagggagggtcgtggagcatttgctgctggtggttcctgggcatctgagggccacagctaatctgttgaggccattcggcaggcagagtatccttggggctgtggtctctgcaggctcccaatgtcgttgataggagacacagagttcattttttaacttcttctcagagctgtgtcaggagacatggcagctgccacccaggtatctcgtgactgggcataacagccaccctgcagatcagctctgaatctggccaggttcttggctaatgggaaaaagccagcagccctttctgaccttgtgtgttacatgacacttgtaacccagatgggcggcctgggaggagcccaggcttcgcatagggagtgggtgctcttggccacagactataggcttctcctccttccaggacactgaggtttggggggacagagccccacattgagaagttctctcctcctgggcttttcaagggacatgcttggccgagggctggcctgaggtctcagggttggcgtggctctggcccattatctccttctgtctctgtcctttgcagggtgtgccatcctgaggcccaattttcttctgttctcttctgaatccatccaagtacatgttttaaatggactgtgtgtgtctgtgtgtgtgtgtgtgtgtgtgtgtgtgtgtgtgtgttgggtgagggtaggaagagggatgagagagtattatagagaaggtcagagacagctgcaaaagcctgcgtgtgtggtataagccattgcaaagtaaagggactgcagcgagaagctaagggcctaggggtggaaatgattctctcaaggttggggccagagccagggcaaggttgccatttcctgagtctttccctttatcctttaaactgttcaaatgtagagaaatacggaggcgggaaagggcagtggagccaaagcgctgggcctcagggtggttcctcggcaccgtctccagccccccagccctcactaagcgtgccctcacgtgcctggcgtgtctgccctcctgcccacctctcactccctgtgtctcccctcttcttcctggcacagtgcggtcccccccgggtctggccaagacacccctgtctgctctgggcctgaaacctcacaacccagcggacatcctgttgcaccccacaggaggtgagttgggaagagggaagatggggaggggggccagggggaggaggactcctgtggttctggacagaaacccgggtctcagaatctggtcagcagccagctttgtgcccacactgaggtcaggcctgggttggggctctctgtgtaggggttgggggtgacagatttccttgcagccttcctgtctgttgacttgtggagtttgcacaactcccagcctcctctagcttgaggctttggaggcctggtctcagtttccttggtggtgttgagatctctgctggaagccacacattctaggtgttcaggccctcgggtacacgtacatgggcgcacatacatgcacacatgggtacacacacatgtacacacacacacacagagtcagagaagcatgcccctgctgctgtgtgccagggcctctgctggcagcccagctggctctgctctgagcatccacgaagcatcacaggcattcacctggcatccacgaggcatcacctggcattcagagtggtctctaggtctgcctcttcaggcccagagaaccctaccagagaaacccatgactagcagtggccatcattgcctgccgtttcctcgatccccttgccctcagcccaggtcttctcctgactgtcaaaggacctgccacctccgggcttctgactctccctggcctgtgctcatcccccatccctactcccgatgctggctgcatcttactctgctgctgaggagagcagcccaagctctgaggaaggaaggaggatggctgctcggcctccctggggtcaaacagcctgtcctgttggcacggtagagggcagggccctgggcctgtctgggagaaggtgctcctctgagcagacaccaccccaggttcacacctcctacctcctcctcccatttcccagctcctctccttcttatggtggagggagacagggctccctgggcccttggtggccatgtggggccactgaactcagaaagctgctccctggactctggttttagggctgggtgggggctattggggtcaactttacttttttccttagttaccagaagacggatccagccaggtaggtgggcagtggcatgcatttgtgacccatgaagccacgcagctgggcatagcctcccactcagagtgtcggcatggccagggacactgagccacgggggatcagtagaagggggctgggggctgcctctcaccagccagcacactcctgcttgacacttggcccacagagccctgggcacaggggctgcgaggggctcaggctcctgagagccggggactcaactatgcctcggagccttggggtcctttgcagggtgggcctcggccttccccttggagtccttctgtggacagcgcaaatcggccctggcctcaccccagctttcccatctccgttttctccacagattctctttctcaagaaataatccctgttaatctctttctctctttttccttttttgctcttcctcatcttcaccacctgcccttctttcctgcctctccttcctcccacctctcttctcgtcttccctcagaggaagatgaggggaaggtggtggtcaggctgtcagaaggtaagtagcatttgctgtgacttcctgctctctgggtctggaaatggcttttcacgcagggcttgaagaggctggctggaggcagctctctttcctcactgggactcaggcgaccaggcacatggccttcctgtcccccaacgcttggtgatgagataccaccctggacacctcctgagtcctgatgggggagcttgtagctgccaggcgctggctcaggcacagccagtgtctgggggctcctgcagtgtcaccttgttgaccaaaacgctcctcttgcaccttcctctcccagcgccatttgcaccagcctgcctggtgtgcagcagctcatagaggtagacagggagggactcagatcccctttcccgggacgtgctccacaggcatttctcagagaagagattctccacgttggcaccactgacgttttggcctgaatgacgcctttttttttgagatggagttttgctcttgttgtccaggctggagtgcagtggcacgatctcggctcactgcaacctctgcctcccaggttcaagcaattctcctgcctcagccccctgagtagctgggattacaggcatgcaccaccacgcccagcaatttttttttttttgtatttttagtagagatggggtttcaccatgttggccaggctggtcttgagctcctgaccttaggcgatccacccaccttggcctcccaaagtgctgggattacaggtgtgagccactgtgcctggccctgaatgactctttgttgtgggtgctgccctgtgcactgtaggaggattagcagtgtccctggattctacctgctagatgccagtagctctcactcagtcatgacaatcgaaaatgtctccaacattgccagtgtcccctggggggataattctcctggcgcagagcccccatcttacagccacgatttgccctctggaagccctgcctggtttcctatcaacacagaaagtactaagtctgtctttcggggatctcagacaacttcgcgtgtttcaggaaatctatggactcaccgtgtatacaataatgcattgggattcccatgcacgtaattctgaaaagcagtttcaaggagttggcatgtctatgggtcccagaggaacccctgatttagatgagccctgcactgggcaccagggaagcagagagggggcataatcaggtgggaggccttggacacaccaggagcagaactcgagtgaggactcaaaccagcaggtgaaacaaagtgggtgccagcctgggcgggaggccagggtgtggttctgggcactggcatccccccctcaggaagatggggcaagatgggtgctgtgatcacttccagttctgatgggttaggtgttctgacttcccacctgggccctgggccgattggctggttttctcaggcctatttcccattttcctttgaccacaccaccttgattttccaccccctaagcggggatggcctgtgctcctctaaatctgctgtcacccaggtaggatgattggagtttcccagaagactttgccctctcctgaccagctggggtttgggcaacaacatcaggctgctcaggggctgcagaacagggcagcttccagagacagaacaggtgggccacagcatgcttccctctgctgggaacggcccctccttgctcccccgcagcctcatgcttggggaaagggctttctcccaagctggaggctgactgctggtcctggcaaggcaggagctgggagagagagtctagaattagctggagctcagagccaacgtttctgtgcttcagatgccggaccacgcaataggctctcagctctcctcgcagctggttgactttaacagaccagtggtatctcaaacactctccagtgggaagggccatggggtggattatccagcaagctggcagagcctggtgattgtgtctctcactttggggtgacttcaggggcgtgggcctcgacaggactgaactatctgccaattgcacctgctgagttactctcatcttacagggccccaagtgctctggccagagccacagagtttggaggggaaggttcttaggggttaactcagccacacccatcgttgtcacagatatgcagctgacatcagcactgtgggtggtgttgggggatctgcccaaggtcacagttaggaggtaatggagccagactggagttattggtctcctgtctcttcctcaagtggccatttcaaagtccttctcctgcctgcaggcaccgtgccctgggattccagcgtgggagttggaattgctgcccgtggcctggggagtggagcggggaaggggcagggagcaaagctgtgggcagccagttccttatttcctgactcatgtgccactgcccgggtcagactaaagctcattctttgctgaccctctgaggctctgcttgatttccttgctgatactttgatgggaaattcagaaaaaaatgccagtgaggcaaaaatggccagaggcaggattattcggcttggggaaaagaataatttgagggatgtctgctatgtcccaggcgctgtgcgaaacactttacattcattcattctttcatgcattgattcatttattcataatactttgtgcgctgactgtttgccaggctttgggaatataaggatgtgttaaggcagctggtgaggagagtgatgccaacagacatttcaatattaggcaaaagtgctgagctgaggtaggaataggatgtcatgggggctgggaggagggggcatgtggctcaatctaaaatgtttggaattctaacttttgagcttctagatctgggacctgggggtttccatattcccttctttctttcccacccacatgtcttgattttagttagggtgggtgtgccccttctctccaagcaaagagcctctttgggagacagaaaatgcacttcagggtgtggacaaggagctgacagtgccagaccggaggagcccaagtcaccctgtgctgcagctgctcttcaccgccagcagccacttggcagggtttgggctcctggaatgttctacatgaagcaccctccctgtccccacctctcccgccctgcccaactccctgtagcctctgatgcagctgctccaggattggagggaaggaggaaaacagcaggagaggtggtgcgagtgaggagtggaggaaggcagggatgggcggctaggagcagcggaggcagcagcagggctggttctgaacactgggcctggaattggcaggaaagaattaggaagaactttctttcctgcctcttctcacctgatcctagctgggcaggtgggtatcctcattcccactttgcagatgaggaaacggagtcccagaaagtctctagtaagtgcacgggtggtgggtgaggggagagcttgcaagtagaagtatattgtcctggggtgggagagagagaaagagccagggaataaacagaaaaaggaagcattttcactacggagatctgcatctgaaaacttgggaaaactaatgtttagccctgaagatgggttttaaacagttctggagatgaactcaggaaatcaaataacttctcaaaggtccttcccgctctgggttcatgaggagtagagattgtatggaagggcttcgttcatctccaccccatgatctgggactggaagggcaggtaggggtggcagtgggagggcagaccagctgaccaaggaagaggatgcactgggaaggagaaaggaggtgggggcccggtgagggcagggccaggtggggctgggtctgagtggccttggctaggttggccacccaatgcacaagggctgtttccaacattgtggtcagaatggatgctgctgcttctccctgggcgagccatcctgttccccaagttcagactcccagtgtcttgagaactcctctggtgttctgcagtttaggagctgaaggggccaatgggactgttgccttaagaacttggccatgctatcgagccatctcagggtttctaatacactgtcccatgggccctccatgcaatcttgccatcagactcccaggctgcagctcaggtgcctgtgtttaggccagaagcagttagtagacccagccttgcctaatggcaagtaagcacccgcaagccacaggcttggctgtgtcctgaccacaggacggggtggtgtggcccactttatctcagttttactgttgctagcaggggtacctgtacttctttaaaagggtggggcgtagggcaatgtgaattgcttacctaatgtgtgggtcaggggcctggtgggaaactgatggttcattccaatggagcaacctaggacagttgatggactcttaaaaggtctgggcagagcagtgagggatggtaaagcaccccgagtgctccctatcaggagcagggagccatcctcccaggccttaaggaaccaggagggagctggagggcagggctgctgactggagtgtggctagagggaggtgggtaggggatgtagccactggcaccttgcccttctctctccctccctctcataccctgccagtccctccttactagccaaaggccaaagctatcctgagccagagactaagggggtctggatgacatagtaaataaaagtctgccttcagggatgcagatcagggtagagagtagatcaggagcgacgtcagtgaattggggaagagcacacaccttcacagtgtcattcacataggtttcaacttgaacttcagggaatgagaaaaatggatgtgtgcctctgaggtcttactatgtgtctctggatggggctggagggtaaggatcatgcttctgtgactttgtggagcacatgcagattgagggcctgctgtgtgccaggtgctgtgtgagggctcggcacacagatcagctaggcaggctctgggagcccacgggcagccaaagagtggctttctctccctggctgggagagaggtggtgccgagagccgtggggacctgggtgtagccatgatgagtgcctggaagggtctgggaagagttttcagagagtgacctagggtggcaagagacgggaggggagagtggactctgatcttgggtgtcatttgcatggctgtgggtgagactccctctgatgttctcttctcccaagttgggttaccagttgcccaagactaaagacactcactgaaactattggcttcccgacttgcagagggttgtatgtgcagtgggtaagggcaggttggggccagactgcctgggttccttggctgactgtgccccttgccagctgtgacctgggcaaggtacttacatcccccgaatcctacttttcctgtataattgtttgctctttttatcactaggaatagccctatggagttggcttttctctgcctgatgggctgaagtgctggatagagccagctctgggtgtcctgtgagcctatgggccctgtctaggtcacccagagccagcttgtgagtctggagactttggtgctagtgttcactgccactaattatccatgtgtcctggcgcacggctccacctctctgggctgaggagataggttagatcaggggtcagcacactgtggcagctggtcagatcctgtccactgactattttggtaaagaaagtttgattgcaacccaaccatgcccattcactgtcctgttgtctatgtaagctgtcacaccacaacagcagagttgtgtagttgcaacagtgacagccttacccaccagcctaagatatttactattaagtctttacaaaaaagtgtactgggcctggtcaggggatatctgcattgtcttctagttccagcagagcctcgtgcttgggtggcacagaatccatgcctttggtatgaatttggcctgggccttctgcgaggaggtgggtggcctgggctggttgagggaggctttcgaggaggccttgctggcactgcctacatggattccagctttgggtgccgaggtgcctggttctacatcaccttgtgcctgctacctagaatagacctcccgtgcctgcctctttgcagacaaactgccccagccttgtccactgtcttgctgttgggtggagggggttctgtatggggacaaaagacagacgggcaggctgtggctggagctgtgtgcagactccattgcagcctctgggtcctgctctgtaaagggtcctgtgctgagggaccatcctcttccggggtctagagaggcctctggcctgggtgtaggatgtcagacctgagggccaccccagaagccactccacggaggccatgcccctatgcagcaaaggctggaagcaccctgctagcaccctggtgactaggctccttccaaattaaggttttctttgggctaaggggaggaaggttgcatttcagctagctggaccccaggcctgtcacccatgagggacctggaggagggacctggaggacctgactattttggtaaagaaagtttgatggcaacccagccatgcccatacactgtcctattgtctatgtaagctctcacaccacaacagcagagttgtatagttgcaacagtgacagcctgacccaacagcctaagatatttactattaagtctttacaaaaaagtgtactggccctggttaggggatctctgcattgtcttctggaggagacctggaggagggggctcttctccaactctgaccattgcagtcttggccagcaggggctgcaggggcctggcctcctgagggatgcacagactctggttcttcagtttctcaggctgatttcagtggatgccttagttgtgggcagtatggctctgtactcaggccaggttcctcctgggtaagacagggacagggtgggatttggaggtggtaggaatgacattcctcccggatcatggcccggggtaaacaagagcgttctgttgcttcttcctctttcaagcggagttcgtttgggagctggcctcagaggccgtagaggagttgggcaggtgccggtctgggagtcgggccatctggggacctagtcatttcccttgtcgggcctcagcatccatccttatctgtaaaatggccttttctagcgtgtgtcccccaccccctcttaggctgttttgaacaccaggtagtgccgtgtataatgaggtcctctgtaaactaaactgctcagtgctacaggaatgccagaggtgggcgatggaatgttgagttccgcctgggaatggggttccctgatgccagtctctagaggaatgctgagtgtgtcaggcagagaggggtgggtgtgtcttggcatcaaaggggctggtgagtctacagcagccccacagggcaagactcaccagtgcaggcctgttgctaggtggccaaggctgtttctggattctgggcagggggtggagctcacatgaactctggcactatcctgggatacaggcaaggcagggatggacctctgggcccactgtagggccccagactctagtggcacgaggagaacctggaagggcctgggtgctgagcaagatcattgaagaaagagagcagccaaagggggtgccagctatggacagcctcctagtccttggagggaagagtctctgatggccatgttctgaggcggggcctgggatccatttcagggccccctcctctgagcaaggccctggtgaaaggtcactgcagggcagggtgggtctgggcaggcaggagccctgcctgtcctttgggggctattcctatgttcccaggcaggagtccaggaagctgtgttccaggggaggttgggggggacctgcactgcacccctgtgcatctgtgctcagtgtctctgtcctcttgccccttccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacaggtaagccgggaaggggcagtgggtgggggatgggaatccgggcctgggactgggacgggatgggtgaggcctcctggatctgttgcctatggcgtggacaggcagaaagcatacccagatggcggtaccttgcaaaccagttcatcaaggtgcattgagggcacatgtcctgcgcgctgaatcctgtggggagcccagtgacctataattcccaggccgcattcaattccgcccatccaaaactgtgctggaaggagtgaagggtaccacggtgaatgtggcaaagtccttccccaagttgaaaatctaccaacagtaatgacttatgtagtgggctcatcctaggtacctggcactttgctaagtgctttatgcagttatttaatcctcgcagcaatcctaggaggtgagcactattattgttcccacttttcagaagaggaacctgaggcataaaggtgccacagctaagcagtggcagaaatcagattcaggtggaagcgtgtgattccagagcccgcatctctatcctctgccccagacctgcatcatggcgccctccctgcacaggatgagagtcagatgggcccaaagcccacacatgagtgaagggcttggagctcagaacaaggggccattatttctggctagggatgcagcgaggatttctgagggctggaggcatttgtgaagggtgtagaggaagtagcaggatgttgaaagatgaagaaagagagacagggcattccagaaggacagcccagcagggacagaggactgggctgtggccatgttgggggtgtgaggctgagggcatgtggcctgccattagggggtgcctgggtggatggatggctggcatccatatttctgagtgcatcacacagagatgaaagcccagaggtgggtgacagtccctgctgacaggcttagtggaggggtgcagcaaggagctgcttgactggggtagtgggggtgaaggtggaggggacaaagagatgggatgacggcataggaaaggagggttgcaatcagctcaggcaaggcatcgagtgccaggcaaaggaggaggacctaggaggtgtcgcccccaggaggggagactctgccctgaccatcccttcttcgccgtgcccactgccctccctagcctgggatgtcacagagcctgcaaattcccctgccaggcccagtgggtccagtttgctgcacagtctacattggctcaatgctgagcctcccctgcaagtgggggcaccatgggatgactaggggagcagatgagcagaggcaactgtcttctggattctaagccaagcattccccttccccagcctcttaacaggcagcagcctgcgttgctcaggaggcctgactctggccgagggttgcatttcctattttaaaggaaaggggattttcctaagttgtcccagccacccattgttgatgttcagtgagccctggcattaggaagttgttcattgtttctcactcaaatccctcctgctgaagtgttggccctttccaggaagctagcctttctcccctgggattagccttccagaactccattttagtgtctccttctctcaccctgctcagcctggctctgtctcccactcctcagaatccagtttattctggattataccaggaggtggccttctgctttggccccttctgggatgcaaggtagactttgccctagcctggcccctgaccttctccttgcccttggctcttgcctggcccaagagcacacccccaaccaaaacctcatatcaccccgtgaacctgagcttatccagcctggcccagggagggccagcccacaacaagatccttccagcctgcagctccaggttttggcccattggctaagtaaggacctctccccatggggggttcctggtgcacagcctgcctgctccctccctacatactagtttatgtaaggcccctgtcaacctttgtttctctcaccatagttggatagaaatttgggtctagaaggagtcagggtcacctaatccagtcctgtcattttccacatggaaaaactttaataagcaaaaaaactcactggccatcacattgtactgctgtgctttcatctgtcactccatgcagacctagacttaactttacaagggaacctttgactgtggcaattaccccaggtatagtctcctctgaactgagttgtttcagagtcagaattggtagtgacctctgagctcatctcatctaacctcccaatgcaggaaattccctctacagcattcaggccaataggtctgtcagcctctgcttaaatgctcctaatgacaggagcctcattaccatgcaagacagctttctccattggtggccacatccccagtggctggagagcagaccttacaatgacctcaaatcccctgatgtgaaaccttcccctgtgattccttgtctttgcttttttggagccatctaggagtgaaagcccaattctagcactctctgtcaatgtttaaggatgatgatatcacacttgaggaaactgagtcaagacagggctactcccagtaggaacaggagccaggaaactccattaggaatttctgtgatgctggaggctataacatgacagccacctccagtttcgataggagagggctcttcactttgacatggctcaggagtgagcatggtgcagtggggaagacgtgggctttggaatcagacacagctaagttgaaaccctggtcttttataagcagtgtggtactaagcctactgcttaacctccctgagcctcagtttcttcttctgatggttctgtaaggtaacgtataaaaccctgatgtccttccgcactgccagtgggaccattcttactgttgttcatggttggagggagggcagacagcctgctgtaaatccacccttcattcagttctgtccactgacatcgcaacctgccatctctctgcagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagcgggggcagcaccgtctccttctcccacactctgcccgacttctccaagtactccatgccaggtgggcctctcccccttccattttcacctctcctgctgatgaagtaagtagaagagtgaaatatctatcccagtgtctattctgacattctcttggcagacgaccctgggtgaatcactgacttctgggacttagtttctttatccgtataaagagagttggaggtatccttacgatacgtgtgctgtggttgtggatgctgagatgaggatgtggatacagatgaggatgataaaaatcataatgaatagtattactgttatgattatcatcgtcctcatagccattaccactcattgagcacatgctgtgtgccaggctctgagctgagtactgtgtcatttaagcttcttggccacttagtaaagtaggtattaatattattaaccccagtttacaaactgaggcttagaggctctgtcacttgtctagtatcatacagtcaagaaatggcagagccaaggcttccaatccaggccacgccaccccaaaactaatggtcttcaagcatcactggagttgtctttatcatgtgtccatatcttgggggtcatatttagcatgaccttgaaaacctgccttccaaacctggatctccatacctttgccagccccacagtgccacatcactcctcgtagacccaacttcatcgaaactcatgcaggtttgtgcagtgaattcttcacttatcgccagaacttgccacctttgcctctacttagaaagctcattgtctaaacacaaaggccaactttgaacttgactgtgtgcacagtggccctggatgtttgaggcagatttagaatgttttgggcagcctcagatgggccccagctgcctagattctcccggcgtcactctcaggtcctgccctgagcctgccaagccaggacacctagaatgaccctgcactgcctgtttcctgccgcccaccggggacatctggttcccagcccctctccttgaaggatgcaaaacttctagtagctgggacacttcctgtttcccaccatcttccctgcttaaaatagcctttggagtcaacacaggaaggcacgtgggactgcagccacctctgacagctcgttaaacaggccacggcagcagtggggcctggggcttcagacagagaaaggcagcctgcagcagttgcatggcccagctgcctaacccagagaccttccttagcacacggctgccaggaaagggagctgacctctcccctcacactcgcccggagacagatcccagaagcataagggagtgtaaatcataggttgaaattgactaagcactggagacacaacttgtgtctcctgatctgctctcttaactttgcagtgtctttcatgccaacttctgtctctgaagacaggagaggaaaaatgtggaatcctcatctttttctgttctccctccctttttgtgttttctttggtgccaaaagctgaaggaagaggttgagagtgagggccgcacatcctgatgcttagacaggaagatacagtttagctggtcctaaactgactgctagggcctcttaccaaggtcaccatctgtgtgacttgggcaagtcacttctcatccctgaattcctccttttatgtaaaattaggcagttggactgtgtcctgtctgagctccctccagaatctaatgttctatgacaaattcccaaggtctgcagagtctgggcatgggtgtgtgtgggggtgctgtctgcctgagaagtggggtgcctgacatgcagtagatggcctctagattctaggccagccatcacctgtttgatccaaagagaagtgattttttttttgttctatgtgatgcagaacataggccttccctgtggaaagtgaggagaggcctggggaaaagggggcagaaatggatctttctgccctcatcttcatggtgggtatgctgaagttgagaaactgaacctgtggagaaaggttctagaagcaagtgttttaggccatgggagaaaagctgtaggaaggctttagtcacagtcttctagggaaagggggacacggggtggaggaaggctttcagtgggctctgtgggaatgcagtgccaggccctccaccaggaggtggctcagccacccagatggcgggcaggggataggggatggatgaggaggccgaaggtcccttccactgtgttcgcatggtgttcgaggacatcagcttttgatgtcagtttcctggggctgccataacaaaggaccatgtgcttagtggcttataaatgacagaaatatgttctctcacagttctggaggctagaagtccaaaatcaaggtgttggcaaggttggctccttcctgatgttctaggggagaatctgtcccaggcctctctcccagtttcttgtggctgccagcatccttggtgtcccttggcatgtagacgcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcagggtgagtgctgggctctgtggtgcatcagaggccatagctggctgaggcctgctgtgtcttccctgggcaaggaacagaggcaaattcagtcctctttgtagcagggggtcatcacagagggggctggggttgaagctggacagtaggaagcacttcctgcagtgaagtgtgggaacacagaagcagtagttgtagacacctcttggaagggttcttaaaaacagcaaagccttggttttcctgggcaaagtaaaaggtctgctaagataatatgaaaccttagctctctgtctgcctgatgtgggaggtttttgcattttacagggagagagaacaaagttgggaataggggaatgattctcaggggaaggctgggtgtgggacaggggtcagcaacggcagcccatgggtcaaatctggatgctgcctgcttttgtaaatgaagttttactggggcgcccccacacctgctggcttgcatcctccctgtgctgctgtcctgctgcagtggcagagtggagtagttgtagcagaggctgcatggcctgcgaagcctgaaatatttactctccggccatttacagagtaagtttgccagccaggtgtggtggtgcacacctataatcccagcacttcaggaggccaaggcagggggatcacttggggccaggagttcgagaccagccagggcaacatagtgagatcctgaatctacaaaaaacaaaaagaaaatgagccaggcaaaatggcatacactgaatagtggcctgtggtcccagctactggagaggctgaggtgggaggatcacttgagcccaggaggttgaggctgcagtgagccatgattgtgccactgcatgccagcctgagtgacagagtgaggcccggtctcacaaaaacaaacataaaaacccaacagaataagtttgccaacctgagtacaggaagacccgtaggagtagttaaattttaactttaaagaaaatttgtctcacctaagaaagaacgaaggtcggtaggctcaatgagacttaagtaaaactagcgccaccgaggtcttgcttcctcctctctccttgtcccttccccatgcagccatcgcgctcctcaaggaccaggagccgggggccttcatcatccgcgacagtcactccttccgaggcgcgtacgggctggccatgaaggtgtcttcgccacctccaaccatcatgcagcagaataaaaaaggtaacctcatctcccagaatggggctcaggaccaggtgagctttacagtcgctaaacctggaggtgctggagggacccagggtgctgggcaggaccttaactcccatcaggctcttcggaagagggtgtcttgggcttggtgatggttgaggtcagagattgggaaagcaggacgattgggtgcctgccatgtgtttcctgaggggtgggagagcagcagtgggctctgcagtccatggggctccagccacgttctctcttcagtcatttctcccatcttggccccgcacactgcggaagttttgaagcagtcttgggaggtggtgggaggaagccatgggcagggactgagccttatttctttctctttgtcccaggagacatgacccatgagctggtcaggcattttctgatagagactggccccagaggagtcaagctcaagggctgccccaatgagccaaacttcggtgagctgtccccctgcccccatctctacagtctggcctgagtcttggtcctgtcctgggttcctccaggggtctgaccccaagttctttctgacaggctctgccagtcacccttgtcataaattcagcagagaaaatgaatgaaagcttctctccctccgcagtgcggctcctaactctgccaaactgcagtctgtgtttgtccgacccagctgggacttgttatcattataactggagtaacaatggtaaaatcagctgccttaattgaccacctaccatgtgaatgtcacagtctcagcaccttctatcacatctggcctcacaaccatcctgtttggtaggggtcatcctccctaatagggaggaattgacacatgaaaaaacgagagtcatcaaagttacatttacctgagaaccaacaggtgagaagtgactgagctgggattggatcccacaattctctgatccttctgccctgttctcagaggagccccagtaactggggtgcattaggagcgatgttaggaggaactttctgcaaaggaaagttgttaggtaactttatgactgcgagagtgaaccttgggaatcttctctgttggatcttgttcaacaagagggtgtgaattttcagctttggtggtgggttgaggtagaggtaataaagaagtggaagattgtgtgtatcggtgtaagggtagaggtggaggtttcccttctggcttccagtatcactgcccatgacatgccgtctgcctccctacaggatcgctgtctgccctggtctaccagcactccatcatcccattggccctgccttgcaagctggtcattccaaaccgaggtaggaacgtgagactcctggctcaccacccacacccttgagctggcccttgtcatgtcttgatcctgccagccactccggacatgggccagggctggaggacacatgtcattttgccagtctggagaaactcaaaactactctccttttcttcctattaaaaaagaagaaaaaatttatgaaaaagcttgactccaggaacatacataaatggacttgccagattgttcaggaaaactctccgtatgaagaaattcatatggaatcctcagaccacgtcgtcccagggatgacaggagacagaagtaggggacaggagacatgtcctggaggatgagatgggcatctggggaagagagtggggaggcagactgaggtgttgaggggttggtctggatggagaggagagagcagcctcaggaaagagaaggcggtgcctaaatgtcgccagactttctaatctgtgtgctgggagggtgttccctgactaaggggatgctgagctgttagggaagagcaagtcctgttttgattgtgggaagttggaatggactccaagagcatgaggacatgcaggatgagaatttgagtgagacggcagggctagggaaggagtgtttagcttctctcatggaggcgcatcagccctggagcgtggcaggtgggcacctagaactcctcccagcataggcctctactgcccagccctcagcaacacagggcccacctgagggtcactggcctcacccgcagtgcaaggtctcggaacggtctgggctgccttctccccactctgtctgttcaacaataggaccttcagaagcgctcctaggctgtggccctaggatttttttctagtctttcttggagctcctggggctatgcccacacataacaccgccagtatttttggacaatttctacttatccaattcagttcattgaattattaatggtaatggaccaatattattagcttataagttcaaatacaacttaaatagcactattaaccaatgacacaattcagacatgaattgaattatattcctatggaattcaccattgtagttcagcaattaaaaaactgtttaatatttagattgtataaacctgttgttttcaaagtatgggcctagaccggcagtgtcagcatatcccagggacttgttaaaaaatgcaaatattggctgggcatggtggttcatgcctataatttcagaattttgggaggctgaggtggaaggattgctcgaagtgaggcattcaagaccagcctgtagaatatcagaagaccctgtttttacaaaacagtaaaaaaattatccaggcatggtggctcatgcctgtagtcccagctacgctggaggctaatgtgggataatctgctagagcatgggagtttgaggctgcagtgagctgtgatcatgccactgcactccagcctgggtgacagagcaggattctgtttcaaaaaaaaaaaaaaaattatgtaccatgtacaatgtgatgttttgataaatgcatacattgtgggttacatcaatatgctaatatatccatcactcaattcttattaatattgaaattagagttatgctggatcaatggtttaatgaattaggggaattaggggatttattgacctacacaaagatatatcaatgcaaaacaataacagcaatgccaattgtcacttgaaggcttgctttatgttaagcactggctaagctgtacatggagtcgctcaaaaacccagtgacgtgggtaccatgatcatcgtctttgttttatagatacttagtaagtgctggggtgagggtttgagcccagttctgctggactccagagctcacaaccagtgtgctggctgcttagagcaatcatcaaacgttcagactgagcctaactcagggctgactgccagggtctggtatgaaaagcagcgttccttctgccaaagagttgcagagctcaccttcagcccagccaaacttgtgcttctttccagctctagggttttaattcctactgaatttttgtcttagaccccacagatgaatcgaaagatagctccggccctgccaactcaactgcagacctgctgaaacaaggggcaggtgagtggtcacctgaaactgtacccatgcccaggcctctctttctgccttcctgccctgacccctcctgcacgtgcaggctggaggtctctccaggcccaaatgtctctgggaagatcacatttctatgtgcagatgccttggctcaaggctagcctgaaatttatctgctaccttctccctgaagaatggatctgggttaatgtcctcacccacgccagctcccatgactcccccttgggttggtttcttccagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagtaagactcccctgcctgctcctcggtggggttctccttcctgtgactcatctattcatccgtgtacccacacatttaccacttgattgattccttgcacccaactgctcatctaccttctcatccatctatcttgcatctacctcccatctacccagctacttatccatccatccatccatgcacccatccatgcacccatccatgcacccatccatccatccatccatccatccatgcacctatccatccatccatccatccatccatccatccatccatgcatccatccatgcacctatccatccatccatccatgcatccatccatgcatccatccatccatccatccatccatccatgcatccatccatccatccatccatccatccatccatccatccatgcatccatccatccatccatccatccatccatccatccatgcatccatccatccatccatccatccatccatccatccatccatccatccatccatgcctccctgcatttattcatccctcatctatcccttaccacctgtttttcccttcatccatctgtatctccattcatctatccatccacccattcatccatccttctatgagaatttgccagcattgggtatacagctgtaaatacaactgataaaaaggacctgctttctaggagcagagcccgtccacttggactctctcctaacagtgtccctggcctctttgcttcttcttccagcccctccccacatttcctattcctcagtgccagtttcttccttccccagcccctagcatttgggatgattctatggcacatctgtctctgtacattgcttgggtcaccagtgtcaacagctcaggccatcttgctcataagagagaagttgtgtggacctgcgatagccacagatggtggaaaggtggcctgacctgctggtggaaggaggggaaaagcagccccttcagcactcattctctgtttatctgatgtctgtgctgcaggctctttttcagacgccactaccctctcaacactgtcaccttctgtgacctggatccacaggaaagaaagtaagtctcttgtacacagcttctctcccacacagctttctaacactgacgtctgtgtgggtgcatgcatgtgcatgtgtgtgtgtgtgtgtgtgcatgtgcatacattctccattcagctggaaggtctgcccatgtgtgagtaatcgtgttgggcatcttttgagtctttcccactatagatatggagaccctcccagggactcagtgcccactgctaccccctctgccatgccctgaccttgaatctgcttctcctctccatgatggggagagcccctcaggaggcaggctgcagtgttctctcgaccttgaatgcatctgtgtgatcttgggcagctcctgtccctggggaatgggggaatgggggaatgaggggggaatggggggcagctcctctccccagaccttcctgcagagggtctgggcatgggtggggctgggctctagggagaaagtacgatgatttaccctgagcccactttctctccacaggtggatgaaaacagagggtggtgcccctgctaagtaagtgtgacttcttacccctgcccagcaggctggcctttgtacttcacagtgagggaagcacggggcacatttagaaaccagggctgggggtagggaaagagcagcaaaaacctttgtgccaaggtcactcagcttccgagtgaagcttgaccaggcttccaggccttttgccttgtcctgcctcgaggccagaggcccagcgtctggtccagctgccttcactctcccagggttagaagcagcagggatggcaggaagtggacagaaaacagtcttattagaagcaatggaaatgggtcagagattgcttacatgatcttttctgccccaattctagctgcctttatttctgctcttgcttttttggtgggctttcctgtgagtcttgtggccgagcaaatcagccttatcagaatgtgggagcccagaaagtctgaattctggggatggccctgggaccttcgggtggattcctccatccagcagacatgtcctaggggcctccaagggactcagatcctgcctgggtctctgaccctgccctcaggaggcccattggcacagcagataagacagatgtctaaatagcactaagatgcttctgtgattttcaaactgtattccaaggatcctagcatccttggattgtacctgatgtacagaagagagggaaagctctgctgctccttgcagttgtctatcagcagtaactagggttttttcacaatcacaaaaccaaacaaaatataggcataacctggggtctgaagctgacatgagactatcaccatgatctgtcatctacttttcactttgtcaggattattccaacagccctattatcctcactgattgactttataataggtaaatgtcgtgcttttggattgctgtttatagctgtaaaatactgctttcacctttatatatgcagacttcatataaggttgctttagaaaaacaaaacgttcagtgttaaaaaaatgacagttgcaagggagggagaggcagcaagagagttcagcttacgtctggggagctcatgcaggagaacacatcagcacctcagagaggtggaaagagcagatatttaaggacgggtcttcaaagacaggttcaatttggacaggtcaaaatgagaatgggagtaggaggggctatttcaggggaggggcctcatggccaccagcctgcaagctccccaagggaagggccatgtctgacacatggggaggtggtatatatttgttgagtgaagaaatgagagaatggaggctggaagagcagaggcaggaggaggctagtgagaatgcctcagtccgaatgaatggactgactagtctatcacatggtcagtgatggtagcttaggagaggccatgtgggatggtggggttcagccttgtccaggcttcatagggtcatcagtgctttgagttcctgcatttcccgtgtctctgctggccaaggcagcaggctggaacttcctgtttgaaggggcttgtgctcactcaccacagggccctgcgagggaagaaggtcagggacagaagggaactgggcccccaagcctggaaatccctcttttcctccttcaggagctggttttgagttgagcctcctgctgaagaagctttgatgggtggggcagaggccacagggagaggccaagcagggcagtgggctaacagggaatcatgacagggacgaggtgaggccagccagggatctcatgtgcaaaattcaaggagatgttagatcttgggatcttgcaagcgcttcctcctgcccttgcgggctgaggcttcttgcctggatctattccttgtggcagatgacaggactgggctattgcgggagcctggaagccacagctgaaagaaatatcaggggagggcaggctcggtgctccagtcaggtgcagttgccgggtctccatcctggtagacacccgcagccagggctggcatgcttcctccctctgccaggatcacccccacccctgctcatggtctgagccagctaggaaagggaggtgctgggggatgccctgtggaccccagctcccccaccacctgggcattaccccaggcctttggccctgttgctcctggcccctgaaacaagactggaggagcagagctgtaggaaatgctggattatgtgtgtgtgtgtgtgtgtgtgtgtggtgtgtgtatatgttgtgtttgcgtgttgtgtgtggtgtgtatatgttgtgtatgtgtgtggtctgtatatgtatgtatgcatggtttgtgtgtgtgtggtgtatgtgtgtgtggtggtgtgtggtgtgtatgtgtggtggtatgtgtggtgtgtgcagtggtgtgtgtgtggtgtatgcatgtggtgatgtgtgtgatggtgtgtatgtgtgtggtgatatgtgtgttgtgtgtgtgtgatgtgtgtgggtgtgatggtgtgtatgtgtgtggtgtgtgtggtgtgtggtggtgtgtgttgtgtgtgtggtgtgtgtggtggtgtgtgtggtgtgtggtggtgtgtgtggtgtgtgtggtgtgtgtggtgtgtgtggtggtgtgtgtggtgtgtgtgtggtgtgtgtggtgtgtgtggtggtgtgtgtgatggtgtgtatgtgtgtggtgcatgtgtgtggtggtttgtacacacaggcacacagggaccagcagaatccccctttgctaacttcagctgccgtggtcctgcggtagggagaggggttttcataggaatctccagctgtcctcatttccccatctcgctctaattagcaacatgctggctgggaggggacctgagctcacattctgttctctgccctcatatttttaactctgttttgcgaagagaatgctgggtcactccagtcctgcgggtgggggtggggaacgggtgtggggtccaccttcccttttattttctggcttccaaggttcttgagcccaggaagaataagtgtgtgtgtgtggaggggtgtgagctacttgacctttgtctccctgaccttgtggtgtctgaggaggctgagccgtttgcaggcagacagcactttcctgattggcatatgtgttgtgtgtaagaacagtcagtaggggtagggctgggatgggcggggagaggcctgtctaggaatgttcccattttattttggtctcctccccacccctcactatccagccttgtcaatcctctgcagctcccctcgcaccccttcaaaggggatttctgcccacccttaaacaaggtgggacactgtctctaggacttggcttgtggtcaggggagtgcacagaggattctcttctgcacctctctgagtccctgatgctgaggcctgctggagggatggggaagagaggttggcctgagaccagcttgctcacctgggctgctgtccacctcctggggttccacttgcccttccctcatgcccgttgccctctcccgcctgcaggctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgtacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttggagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatctttcaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactctgtgccgttatctatctgtgttgttcggacaggggtctgccatgtctctggtgggcaaaaaggggcctctccagagatccaggtgggcttcagcgatgcctctagtggacagctcaaatcctcccagcggcctccccaccatctgcgtggtggttctggttccctgtgtttattcatttggactctttcagctgcaagagaaactcaactcaaacttgtttaagaaaaagataagtttcttggcccgagtgactgagaaggccaggcctagctgcatttaagggctcaaatggtagaatctggaattcatccccatcacttggttctgagttggcttaactttcaggtaagctgtatctgagtggcggtgcccccagatgctctgggcttccatcccaccagctcggtagctctaggagaaaggggggctcttttctcccaatgttctcagcaagaaactgggacatgcgatcattggctgtgatctggatcctgcctggctcatatgattaactcgaaaccaatcattctatccggatctgggtcacgcaactgcctctggagccttctgaaactacggggactgagaatggggaagtggttgatcccggaaggagtgaggtctgtcagagacagggggaacacgggttgtcaggcaacatctattggggcctgtgcccatcaagtggcaaatgtgtggttcactcgtgcactaggcccagggctcctgggcaaattctttggaattcagaaagtttgggggtgggacctattgagacatgcctagcacagcacaggggtctctgggagatccaaaatactcagtgacgtggtgctagctctccactgagctcaccatgtggctggaggaggctcagatcagcttatttgagcaggtttgtgctgagccccctcagtgaccctcacggtcctcgtgtgggcagccttctcaagcttttgggtcttgggattcctttacattcttaaaattattcaggaccccaaagggcttttgtttagaaggattatatcttttgatcttttaccatagtataaattaaaactgagaacattaaaaatacttaattcacttccatagtgataaattcatcacatgttaatatagagagcatttttgtgagaaataatattttctaaaacaaaaagcactgggtgagaaggtgactttgctttgcattattattattattatttttgagacggggtcttgctctgtcgcccaggctggagtgtagtggcacaatcatagctcgctatgactagcctccacctcctgggttcaagtgatcctcccacctcagcccccaaggagctgggaccacaggtgtgcgccaccacacctggctaattttttaatttttttttttgtacaaaagaggtttcactatgctgctcaggctggtctcgaactcccgggctcaagcaatcctctctccttggcctcccaaagtgctgggataacaggcgtgagccaccatgtgctttgcagtttttaaaggcctaatcatgtctggcttagcaggagatagctggattcttatataagcttctgcatacaatctgttgcaatatcacccatcatgggcctctggaaaacactgtatacttgtgggaaaatgagcaaaaaaaagtcaaataatggcttaatagcattatgaaaatggttttgacctcaacactcctgaaagggtctcagggacccctggggtccccggatcatactttgaaatctgttgctatgagggatacaagacacaggaaactcagaccctgtccaaggtggagactgaacatgtcttgcaccctgctctctgttaggtatcgtcatgctgagtcatcccaacaaacccatgaggtaggcgctgttatacacagggacaagtaaggaaaccgaggctctgagaggtcacacagtttctagctggcagaacttgtactcagcatcaccaccaccggtgaaggctggca

SEQ ID NO: 17236 - DNA, 48682 bp, Human
gaaactgttgggctttgctgtggcacgaaacttcacccttacccacgccactgcaggactcctcctgccagcctcggggagccgggtgagagtcagaagggtgggtctaccttgcactgcagaaagcagctctgagtttcctggaagccctggggaaaagggaaagcccagaagttgtcactgggggacatggttctaggtgagacccccctcctcctggccttgtggaatggcctggctgagccctagctcattcgtgcactgaccttatccattctggaatgtttctgcaagtttcccctcctcccctgctgagaacgggatggagcatctgaaggacgcatagtctagaagtgcttacagtggctgatgactgatagggtggtttagcaaggtgctgcctcacccagcagacagcagccgccctctgggccaccccgagggcccagcctggaagaagaatgtattcaggcagggcacccacagttgtgtgtgcggaaacgctgccaagcccagtgggatttaccctctaggggctggaaagccattaggaaggaaaagtggtgcttcttaaagcccagttttgtaacatcctgccgagaggtgaccttctgcccagcagctggggctgtcgtgctaatgctttctggcatttgagtcctttagaatgaggtccaagtatgtgggcacctggcacccggccgctcctcccttggggcacaatggggtcttctcccttccgtgagctgaggggctgggagggtgcccactggggctgtagcctgggctggggcatggggcacaagggcctgtgtgcccagctcatttgggccgtggcctggctctgagggtgtgggccggctgcttggagcgtgatcctttcatctgccctttttgcgagtgggagataagatggccaggctgcggttactcctgaacctgtgctctctgctttgccagtcctgtcctcaccagacttctcacaggtccccgtttctgtggaagaggggatcttgtggtaagtcaagggcagaaaccatcaccagcctcggtttcctcaatctgtagcttgaggcttatgtcccccctcctgcccctttgctcccaagattaaaggagaaaacacggatgtgggtcacagaagctggtctagaaatggtggtttttaggctgggtgcggtggcttatgcctgtaatcccagcactttgggaggccatggctggccaatcacgcaagttcaggagttccagaccagcctagccaacatggtgaaaccccatctctactaaaaatacaaaaaagtagccgggcgtagtggtgggcacctgtaatcccagctactcaggaggctgaggcaggagaatcactcgaacctgggaggtggaggttgcagtgagctcagatcgcgccattgcactccagcctgggcgacagagactctgtctcaaaaaaaaaaaaaaaagaaaaaaaaagaaaatttttttttccttcttacttgactcagctcgttgcattttgaaccccctccctgtttgcagtctctcctctggaaagagtcatgtcggctgttccctgacctgctgggctgggctggccggcagcatggccgtgcctctgtcatcaggggctgtctttcttgcctactggactgtgaaggcagggaccctgtctggacagggaccgcatcagcatctccagcatgtggctggagcagggatccatgtgtgcttggatctcaggggctgagccgcagccctgtccaagctggattcagatgggggaggattcaggtctttcttctaggaaggagtggggtgtggactcgcagctggggtctggtggggttttcagtactggtttgcagagtgactaagggatgtgcccccagcctgatgctgtcgtcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggtacgtttgccagtggccactgtttcactggaacaatgttcctttagagaaaagtgggggaggaagggacagtgtgtgccagacctctcgggagaggctggacacccaggcccggatccatccaggctgcgggtgctgcagtgggtgactcctgcctccctcctggcaccggcctggcaccgggccttggctcacccttcctgtgccactctgtgattgtcggggtatgtgtctctttcactgggctgggagcaagaagatctgggcttgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatctggatcgaccgtttttattcttctctccctacattgactccagctctctgaaaattctgagaccgtgtaagcttagaataaataatgagaagccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaatcgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagcctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggctgtggtggcgggcgtctgtaatcccagctactcgggaggctgagacaagagaatcgcttgaacccgggaagcggaggttgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacagcctgccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgataaattttggagttatcttttttctttattttttgaaactgagtcttgctctgttgcccaggctggggtgcagtatgttgatcttggctcactgcaacctccgcctcctagattcaggcgattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaataccatcagaatggctgagagggcattccttctctctttaagtgcgggtgcaagtccagactcctgggtatcgtgagtttccatatgacagtgtccctgaaacacgtggctcaatgcccaggacaccactccagggtcaccagatgcaagtgactggcccattgtgtcacttaggccccaggaggcccattgactcatcccagtggacacacaggccaggggccacatacctgtcctaggctgcctctcaagtgagctactgagctgcccagctctgcctgcgtcactgccctgtggccccaggtgctgtccgctgccctccagcccttcctgtgtgcttcccctttaccctgttctcactggggtccaaaccccacgcagcctgtgccaatcagaggccaagcctgggctccaggtcacagtgagacggagcccacataagggttcaggaggcagtcactgatgtggctgtgggggtcctcgggtgagcaggaccccgccccagcctccccaacctggggaggtcagagctcctgtctggttgaggcaagggctgtggatgcggggtgtggccagcagtgcagtgatgctaatgaagggattttctaatgagttttgtatagattttcatttttaatgaaggcagggaagggatagggcagatcagaaatcaaatcttatttacaagaatcctcttaatagtgatatttaaaagatgcaaaaaacagggatcactgaccacctggtttgtctgttgtgttagccagctctttttttttttctttttgagatggagtctggccctgtcgcccaggctggagtgcaatggcgcaatctcagcttgctgcaacctccgcttcctgggttcaagcgattctcctgcctcagcctcctgagtagctaggagtacaggtgcctgtcaccatgcgtggctaattttggtatttttagtagagacgggagtttcaccatgttggccaggctggtctcgaactcctggcttcaagtgattggacgcctcagcctcccaacatgctgagattacaggcatgagccactgcacccagccaaattctcttcttttgaagtggctttctgtgaggctcaccagctgaagtaaaatcagtttttgttcattcaacaaatctttattggttcttgatgctcaggaagaggcaggatgaaagccatgagcaggcaggcaagcccaggccagccctcctggcagcagtcgagggtgtgaggccctgagggtccatagggcccaaaggagggggtatcagctccctgagtgggtgagaggctcagagaggactgcagggagaggccgacctctccgcaaccatgggctgtagccaagcaggggttaagcagcctgcagcttcaacaaggacgtgtttggggtggtcagaagatggcagctttgatgttttcccatcatgaatcatcttgactctaggtctccaccaaggcccgacattccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggggatcaatcggtgaacgaaatatgcaagtcccctggcctcgtggaggcggcattctataggggatgcagaatgcaaagaaagtaataagtccgtctgatggtttgtaggaaggcaggatgtgccgtgggggaaacagggaggcataggggcttctgctcatggtgggtttataattttagagccgtggggttggcctcactgtgccaggacctgaatggggcgtgggcagtatggaaagtgggaagagcatcccaggccgagggaacagccagcgcaagagcccagaggagagggtgtgtacagcaaggcggccagggtggctggagtggagccagcaacggccagtcccagggaggaagcaccagatacaagggtaaccaggtggctgagggggccatgagatagaggctggggtgttgggggtgagcctgaggcagctggacaccctgaggtgcctgggacacttgattgcttccaccttttggatgttgtaaataatattgctgtgaggccgggcgcagtggctcacgcctataatcccaccacttcgggaggctgaggcgggcagatcacttgaggtcaggcgtttgagaccatcctggccaacatggcaagatctcatctctactaaaaatataaaaaattagctgggcatggtggcaggtgcctgtaatcccagctgctggtgaggctgaggcaggagaatcacttgaacccaggaagcggaggttgcagtgagccctgatcgcaacattgcactccagcctgggcgacagagcaagactccatctcaaaaacaaaacaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattcccaccagcaatgcacacgggttccagcatctccacatcctcaccaacacttgtgattttctggctagccaatagtttttgaatggatgcacgcatggctggtggctcgctctggcagtttagtgaaacgccgttatttgcaaatccaccgaaagcatgagtgaaatgtgtgctagctcagctcggtaattccatcctggagcctgaaggcagttttgagacacacgggcagccgggttcagacctccagtcccccagggaaggttgggggaaggtgcactggcagctgccatttttgtgcagaggtggcctggctggcagtgcagggaagctggggaggcccccaccctctctcctggaggcacgagttgggtggctcttcctgcccttgctggctttggctggagctggggttattttgggtctggtcaggggccacccgtgacacactcctctcctgctcattgcctttggagcccgcccacgccagcccctagctgtcacagcctcatggttgtgttggaggagctgattttggcaggtcgaggacctctccccagagccccggcagggctgggaggtgtgggctttgcagctaggtgccactgcagccaccatccctccctctggggccttgggcaggctacccaacaggactctcagaagctgtttgctctgagcctggaagatggaacgagcactgagaagagcttgacctgataaaggggtggaaggttgggcccagagtcagccccccgccgctttttggttttcaaatcagcaggaacattgtgcgggtgaagcctagtgctcagaggagtgacgcggccactctggtgacaaaactgggcctcctggctctgactccagacaccatactacattctgtctttctttttttaaaaaaagaggccaggcatggtagctcacgcctgtaatcccagcacttcgggaggctgaggcggggggatcacccgagctcaggagttccagaccagcctggccaacacagtgaaaccccgtctctacaaaaatagaaaagttagccaggtgtggtggcgcatgcctgtagtcccagctactggggaggctgaggcaggagaatcgcttgaacccgagacgcagaggctgcagtgagctgagatcacactactacactccagcctaactccatctcaaagaaagaaagaaagagagaaagagagaaagggaaagagagagagagagagaaagaaaaacagagagaaagaaagaaagaggaagagaaggaaagagagaaagggagaaagagagagagagagagaaagagagaaagaaagaaagagagaaaaagaaaagaaaagaaagaaagagggtcttaccatgttgcccagactggtctcgaattcctgggctcaactggtcttcccacctcatcctctcaatgtgctggcatgactggtgtgaaccactgtgcccggccaagcctttctaactaaatgctaattgagctccttctgtatgccactggggcactgtgtatttctctctctgtgtctgtgggagcagggaaggggaggctcaaaggtgagagcacccccacccccgaggatctcgtgccctgggccccctgcgcacagagccttggcccagcccacccctcacccacaggatggtgcaggagcagtgctgccacagccagctggaggagctgcactgtgccacgggcatcagcctggccaacgagcaggaccgctgtgccacgccccacggtgacaacgccagcctggaggccacatttgtgaaggtgagagccaaagaccatgtggggtcgctgcccgtccccactagtcggcagacccaggccctcccagccaagcggcactgtctgtcagcgctccctgcctcaggccacctttctttgtgagcagctgggggttcctgggccaggagggaggtggaaaaccccactgtttctccccctccactgtagccgtaaaccccggaggacacctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcctccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccaggaggaacttgggcctggaggagctcgggtttggaagctgggcttctgttggaggtgccagatgacgaaaatgcattccctggaagaagcttcccgttcctagttaggaaggtgatggaataattttaagaagcaagaatctgaatgaagtctggattccaggagagggtgtgggagctcctttgtggggattctccacatagattgggctgtggagggactccgtgtggaggagttgggggtcccgagtcccctgcccaccttggcctgtgtgggctttcacagggcagggctctggcccaggagagagctgggtggggtgatggtgggggtgcctgggaaccaggactttgggcgtttcatgactgcccccgcaccctcccacccaacacccaatgcagggctgggccttgcagatgccgtcggtccggcacacagctgtgcccatgtccccagacttgagaggtgtggaaaaagcacagaacattctagcaggagtgggaacagatcgctctggcagatgagcgacttgtgtttccaggaaggattactcacaccccaaaagatggatgaggtgactgatgctccctacactttctggcagcggagggcgtagaataagcagcctggaagacccatcagtgccacataactgaggcaaagctacacctcctggctcctgctggggactgtttagaaagttctgtgctcctcttaggataaccacttaataaagactgaaggagggcttttcgtgtgtcagggcaaatgttgcttctgggactcaggtgtgaggccacagggacttggaagtaactattgggacctgggcccaggtggcagacagccaccctgtcctttgaccttgcttgatgactcgtcttgaagttcctgtgctttcaaatgcacggtgcaattcctgctgccagaacccctctaactcaaaaacggagaggcagcatgcatgtgtgtcatttttccgggcatggtagagaaatctcagaccatgcaaaaggaacagaactttggagctggtgcatggtgctataagaagctccctcttcctggatgtgtgcgagcagagccgggtggtctctgggcggggcagggatgttgaggggtgcaattgcatgttggggtggggaggggaggtggatgccaggccctttaagcttcctttcaaaactgggacctagatgatttggagtagggggatggccttgctttgctatttgttgctgacatttagaagtggtatctaagccagacttgagtcatcactctacaggttgtgtggacagggggctcagagaggcctcccctgaggcctctcgtggaccccgctgggctgtctgcccgctcctccatctgggatctccacctgtgtttgcagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacgggtaactttcccccttccttccctaatgagcagtgtattaaggttctccgggatgtgtatatagagcgagagtggagagagagagattttaaggacttggctcatgtgatcgtgggggctggcaagtccaaaatctgcagggcaggccttcaggctggagccccagggaaggaggggcattgcagctggagttcaaaggcagtgtgttggcagaacgccgccttccccggggaggccagtcttttttctctgaaggccttctgctgattgagtgaggcccacccacggtatgaagatgatctgcttttctcagcatcaacagacttacatgttaatctctttttttttttgagacagaatctctctctgtcacccaggctggagtgcagtgcagtggtgtgatcttggctcacggcaacctccgcctcccgggttcaagtgattcttgtgcctcagcctcccgagtagctgggattacaggtgtacactaccacacctggctaatttttgtatttttagtagggatggggtttcaccatgttggccaggctgatctggaactcctgacctcaggtaatccacctgcctcagcttcccaaagtgctaggattacaggtgtgagccatcgtgcctggccaatattaatctctaaaatatagcttcacagcaacatccaggctagtgtttgactaaatatttgagtaccataccccagcccaattgacacttacgatgaaccattacaggtaacacgtgcatccgtgtcaccattgccttaactcagcacggactgactccggttgtcggagccattcatgtttgtgaccttatctgaaagccgctgtcctggagtgacgctgagtgcttggagtctgggatcggacaaatctgtgctcccatccgggtcctaatgtgtaccttggtcccctcatctgggaagtggggatagttgcagtcctacttcatcaggtgctgggaggatggagtgcgagattgggtgtcaagggttgggtagagcacctggccccataaatgtctgccctcaccatctgcccttgtcccttcagctgcccggggcagcatgggtggctggccttgctcccacttcttgggtgagggtctgatgctgaagatcgcacagccgacacgtggaggagggagagcctggccttccacctcctggccagtgccctctccatctggagctgacgatgtatgggcgagcagctgggggccatcgctggctaatagctggctatgctctgtcaaatcatagacacttactcagcaaaggggcatgtgaccccaagagcagcttcaagagcgctctcagctgtgtgcccccccgttctgtgtcctcgccctgcatttctgtgtggttcagttacagggttcaggagactttgtggctgtccagtagcctcttacacttaggccacggtttcttgtgctgtaacagaattaacctggaagaaggcaggactccgcctgggccaagcttgctgtgtagttttcggcctgttccctcctctctctgagctttgcccccactctcctaaaaaataaaagaggtgtgagctgggcacggtggctcacgcctgtaatcccagcactttgggaggccgaggcaggcggatcacctgaggtcaggagttcgagactagcctggccaacatggggaaaccctgtctctactaaaaatacaaaaattagctgggcatggtggcgggcgcctgtaatcccagctacttgggaggctgaggcagggagaatcgcttgaacctgggaggcggaggttgcagtgagccgagatggcgccattgcattccagcctgggtgacagaacgagactcagtctcaaaaaaaataataaaataaataaagaggtggggaggtgccggaaggggcgaaagggaagaaccctcagacctgtagtctctaagtcaaggtaatggctgtagggtcctgggtgacacggaacctttcacttcttgttcttaggttttcaagtccaggctgtagggcccctggtcacagaggacccgggtcacccgggactcatctttcacttattgttcttagtttttcaagtccagggccccatggatgccactgagatgatttcagatgttacagtcatcaagagggattggggccgcattctgcctcattccttggcttttgaaatcagagacgacattttcactttaaacaaacccaaaccattcctgctggtggaggatttctcctgcatctcgggggtggattttcactgatttatgtctgcagcgtgagcagtctctgggcttttctgcagctccagatgttagatgttttatctctccgtcttttatctgcttcagtccttgccccagactatcctcgcatgctccctcctctgggagggcttcctgtcttcacagccgcaccttcctcccactgctaccagtgccatggacccactgtatgtttcctgggggccatgcagaaggtccccagaccagtgctggcctgcgacaaataagtacagaaatggagaataacccttttcaaacacataatagcatttgatagaatcaatcaggagactcaagtttttactgcgtgcattgctttagacttggagggcgtgtgttggttgttagcaaggctgtgactgcatttgctgagatggtcaagtaatttggactatgggaatatcacccagcatgaagtcaatgattacaggcctttgtgtctgtggtctttctgttataactgatcttttttttttgaaacggagtctcgctcttgttgcccaggctggagtgcaatggtgtgatcttgactcactgcaacctccgactcctgagttcaagcgattatcctgcctcaacttcctgagtacctgagattacaggtgcatgccgctacacctggctaatttttgtatttttagtagagacagcatttcaccgtgttggccaggatggtcttgaactcctgacctcaggtgatccgcctgcctcggcctcccaaagtgctgggattacaggtgcccgccaccacgcctggcctataattgatcagatatcaattatacattttcaagtgtaattctagcttaaagaggataaagttaatacttagctgtttatataagatgttcaaatgggcattactgcctgatagtgacaagaagagagaatgttgggagtttcttttaagataagatgggtgtttggataaatgtctgacttggtctttttcccccttagataagatcattgaggttgaggaggaacaagaggacccatatctgaatgaccgctgccgaggtgagactcgggcgtctcccatcagttggtatttaaacaaaccccaaggggccagcaaggtggctcaggcctgtaatcctagtactttgggaagccaaggcaggaggattccttgagcccaggaggttgtggctgcagtgagctatgactgcacctttgcactctagcctgggcaacagagctggaccccgtctcaaaaacaaaaaaacaaacaaacaaaaagcaaaaccaaggaatctcggtgctgatctcactggaagttggaatccaggttttgctttggtttaccctgcaaagtaccctttggctgggagccagccatgagccacttccaccctgaggagtcgtggactcccagctcctccttccctttccccttccagatctagggctggctggggaggggaagggtgggcttaccaaggaggggccctggtgaggccctgctggggagggtggcccaggcccagggccagagctggtgtggaaagcctgcacgttaccgagcccccaggccttgtgaaggtgacagaggcctccctcaggctctcaggggagaggagggggctcagcgttccctgcctttgtgcccctggagccccagccacggttctgtcaccattggtgatattcatttgcctcacagggagatgtctgcacatttaactaagggcctcgcaggtttgtttttcatatgataaaactgcttttctttcatggaacattctggcatgtctagacctgcagatctgcctcacaagctctttcagtggttccccctgtggttagggtgttaattaggggccagtttaatccttaaatgatgcagtcagtgtacagtgacagttggtccaggggcgctgtccaggggcctggtggagggaggaagggagtgacctagagccccagcaagcctcagggctatgggaggagctttctgggaaggggagagctggtctgcaaggaggaggtgggattagctgggaaaataaccctgaaacggtcctcagggagacctgaagccttgtaaagggcacggacccactgtagcagggtactgggaggcagtgggctggggaaggaggtggggttacagggccagagagaggggccctagaaacaggcaggctggcagcagttagaagtgtatctcgtagaatctttccctggttgaggcttatcctgatgagatttgcactctgagcatcactctggccaccctgtaggaagaacaggttgtggggtgcttctgggctatgcagaaagaccaggtaggaggctgtggccacagccaggtgggcagctgcaggaactgaggccatggtagtgggcttggagcagtgggacagctcgagagttcagtgaggagcaggtacatgaggcctagttggggcctggccttccacgtggagcccacacccccatgtctgtgaccggcagtgagctcttctctgccttgccccttccaggtccaccccagcctacaaagggcaccctgcacaccacctgattttccagacggggaggttgggacctgaagccgcaggccctggggggtgtccagagccagagcctgggggtctcccagtagggcagcaggtgggctccagccaggtcagcctgccttcctgggttcatctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaacccagaccccattcaggggtggagagcagcccaggacgcgctttctcgtgttcgctggagtttgcagcgcagaggcccctgccgagacttccctccaagacaatataagcactggggttgggaaagaggatggagttggggtctaaccaggttccggatccaggatctgctgagtggccttgggcacatccttcagcctctcctggcccctgcgtctgtgagatgggggagatggagaagatgctgcccctccatggggttcttgaggaccacataactacagtctcagaaaaagcagtagatatgaacgttagcaggggagagaaatcactgctttcgactccgtgcagtccacagcccggatgtgcacatggtggacctgagctcagtttgcgagggtgcagggaagcacttccaccgtggctttggcacattccttcctaggatgtattaggatgggtcgttcttgctggtcacccccgcactgcctcggtctctcctagatgtcaatgaatgcatcacgggcagccacagctgccggcttggagaatcctgcatcaacacagtgggctctttccgctgccagcgggacagcagctgcgggactggctatgagctcacagaggacaatagctgcaaaggtacagcatgcgctccgagtctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttgcagagggtttcaagcctttcagaaggacaaatccacttgtgtaaaaatgtcactcactgtatcatgagagtgacttcaaagcatggcacaccccttctgacatctgagggccacagagcaaattctgtcctccccacccccgcacaccagctgggtggtttggacccctagagcccagtggctgagccagctgagtatacacatttgaccatttgacagccatgaacttcaagggaagggcagcccatcacatcccatcatgactgtaacccttgttaatatctggattattgtgaagacttcagaatggatatgtttatagagactgtgtttgttgccactaagataattgctttatgatctaaactaaacatacacttagcctgaatgaatactaatatatatatacctgccaggaaaatgccagggtgatttattataacagacagtttgcctcataagagccttgggaaaaaaagtcagctttttaagtctttagcaactggagcacgatttggctcagtgaagtcttttttgtgtatgatttctctattagaatgttttgggttatagtctgagtaatgcgcattagaaaaaagctttcttgtgattttaaagtgttgtaagatgcttctggcaggactcttgctaacaatttcctttttttatgatgtaccagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggtcagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaataggcagtaggctggatttggcccaaggaccacagtttgctgatctgggtttagattaaagagcttgggttttggagttagagtgacccaagaaaattacttctgagctttaattttttcctctataaaatgggagtaatcataatacctggcttagagacttgaggccaggattaggcgagtacttgcgaagtactggtacacaggaagcactcggtgagtggtgattccctgccacaggcatttagcctattaaaaaattattttaaaaaatacttggctgggcacagtgggtcacgcctgtaatcctagcactttgggaggccaaggcaggaggattgcttgagcccaggtttttgaggccagcctgggcaatatagcgagaccccatcactacaaaaaattagctgggtgtagtggcgcatgcctacagtcccagctacttgggaggctgaggtgggaggatcccttgagcagggaggtcgaggctgcagtgagctgtgatcgtgctactgcactccagtctgggcaacagagcaagaccctgtctcaaaaataaaataaaatataaaaataaaaaacagtctgtgttagtatttgaattcatagagacagaaagtagaatggaaggtgccggggctgggcagggtgggggatggggagtgagtgtttcctgggcgcagagtttcagtttgagaagatgaaaaagttctggagatggatgggggtgatggtggcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattagctgggcgtagtgatgggcgcctgtaatcccagctgcttaggaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcctgggttactggttctggaaagacaggaggtgagtcctgctttccccagccgttgtcaggttaactgcctggctaggccgctgcagtcagcgcttaagtcctgatccaccggctctccctcggcctctgcttggcagacgcccctgggtcctgcctttgaggtcagagagactttttaggagaagaggtgaggaatccgagctacagatcacactagtcagaacctccccacctggggtggccccatcacctctcccctgccatgagcaagggggtatacatttccatcttgcttcgatttcaacttttccttagcgaaatctgtattgatcatttatttgaaatagtggtttggagagagagctcttcccccactgcattatttttaaccactgagatatttaaagataagtggatgtggccgggcacagtgactcacgcctgtaattctggtactttgggaggccaaggcgggtggatcacttgaggtcaggagttcgagaccagcctgaccaatatggtgaaaccccgtctctactaaaaatacaaaaattagccgggtgtggtggtgggcaccttgtaatcccagctactcaagatgctgaggcaggagaatcgcttgaacccaggaggtggaggttgtagtgagccaagatcgtgccactgcactccagcctggacaacagagcaagactctgtgtcaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttcgctcagcgcagggggtggtgagcagggaagccatgggctctccgggaccagcggggaggatagtcctgctcagacttgcagcctgctcaaaggggggtccggaggaggctggcgtcgactgaggatggaaaccctgactcatggcaaaatcagccccgatttccacaaagaggcaatgtttgcaagtctcaacctagccctgactttcctctctacagggtgcagcactgtgtatgggctgaggctcgggagccgtccccttactgtccttccaggactggcaagcaggctgtgggctgaaggccagcctggcggcactgagctgttccgtgccatctccctgggtcctcagtgacagcatcgaaagccaaatgttcagctccctcagggtccccttagcttgggatgctgggatgaggatggggttccccttttcatgtgctctcaatccttgcaatcaagctcaggaatcattgttttaaaagatctctatttatttcaaaaattatgtatgtcttgacttataaatcagcaaacaaaacctaagtgtaggaagtaaacgctcctcccctggccaatcctgcccgcctcttggcagggtccatgagcccttctgggctctgctcccttgagactttttgtttttttatgaaaatgggatcagactgttctgccacttgcttttcccccccacttgacagggtatttagaaatcatttcatggcagcacctttatgttatctttttaaaaatgactgcatcagcagaaatacgtctttctaaggagaaaatacatcaagatagaaggtagtttcaggccgtctgggagagggctgaaaaggttctatgtcaggtcctggtcccccagcacgcaccctgggtcctctgctcccacacctctgcccatggtacccgctccctcacccaggaacagcatggtccgtggtgggaagcgttgatttccttgtgtagccagaatccatcttcctggagctcctagaaccatcctggggccccaagagcccatccgagcctcctgcctgtagcagaagagctcttcctgcagagctagtacaagggatgggtcagggtcccagaaagtggaggtctctgcccctatcatgcatggagaattttctagaaccttaaggttgggtcaccgagggctttgagaccagcatggctttgtcgggttttctttgctcttttcttcaaattccctcctcctgctgctgtattcctttctccttctcctcctcctcttccccctcccatcctccccctcccttctcctcttcccctccccctcccctcccacttccctcctccccctccttcccttccccttctctccctccccgcctccccctttccctccttcttttcttcttttttttttttttttgagacagtctcactgtcacccaggctggagtgcagtggtgcaatcttggctcactgcaacctccaccctgctgggttcaagcagttctcctgtctcagcctcccaagtagctgggattacaggtgcccacaaccatgcctggctaatttttgtattttcagtagagatggggttttgccgtgttggccaggttggtctcgagctcttgatctcaggtgatccacccctcggcttcccaaagtgctgggattgcaggcgtgagccaccacgcccagcctcttcctttcttcttgagtggggaggaaggaatgggccagggcttcccacgtgccctggctgaccttgcctggggatgtcggcaggtcctggggcaggaaggggttccactgaatctaggaagcactgggtgaagccaagtgaacggggaccttggtagcttgggcttttcccatgtgaatccctgagagggagagatcgggtgccctgttcccaaactcaccctatgctttacattgatttgctgtctgtttattcattcccattcattcattcattgatagccaggtcttacccctgtggagtgcacgatgttctgagggacactgttgttctgtggaacagagtttggggaatctagtctgagtgaggaacctgcagcgccagtgggaaggcagccaccgctctgctaaacgctgcatttattcgtgttacagggcaggggccacccagctgtttctctaaagggctagatggtaactaacaacttcagtctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctctggaccttggtttcctgtttataaagtgcaggcagtaatgatagtgatacctgcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaagggtcttccaccatcactccctctctttgttcccccataccagatgctttgtaagtgtctgagcaaggttctccaaggtgatgtttagatgcttaggtccttttccactccctctatcaggaagtgcaatctgtgtattcttcctccgaatttgagcagaaggagggtatccctgtgtagcatggccctcctggaccattcatgggttcacacttgctcattgtatgtcatcaaaggtaaatgccccacggtccccatgtcagagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctggaacaccctccaggtttaaccacatggtctctgtcttttcccgctgtagatatcaatgagtgtttgagtatcagtgccccgtgccctattgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcccacctgctcctacgttcctttggatccagggcacccagcctgcctagatcccgccagggaaggagccttcctcgcataacccccaggacacttcttcagtgtctccctgggttcctgggcacttcctaccttaatgagagtcattgctggcctgccagccaggtagggctgcctctgggtcagctatcttcccagtccagggcccggcactcagtaggtgctctgtgaagtcgtgttgaaatggaatgcctgtttccatgtccatgtgttcctttcttgctttcctttctgatcatcttggggggaaaaaacccaaactaaaggttttcatcatggctttctttctcctttgcaagatgtggacgagtgcgcgccacctgctgagccctgtgggaagggacatcgctgcgtgaactctcccggcagtttccgctgcgaatgcaagacgggttactattttgacggcatcagcaggatgtgtgtcggtgcgtggggggccccgcaggcctcgggggaacccagccacgtggcaccagggacacatttctgtggcacctcgagtgatgtggtctgatcctcatctcagataatcccaagtgcaggcagaccctgagagaagatcctgagtcaggagaccccattctagccccagctctgctgctgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtctagccagtgcctgctgtcaccaaacctaggtgctcagggaagcctggcagctgccaaccactcccccaaagtgggcactttgctagatcctggcagaccctccttgtgggtcctggggaggaggactggcaggagggcacaagttcagatgtgctgccgcagaaggagcacgaggctcgcccaccaggcaggcacagcgcggcagtcccggctctcccactgacttcccgcatgctcgggacaagtcactttgcattccttgtctgagaaatgaggctggaggccaggcgcgatggctcatgcctgtaatcccagcactttgggaggctaaggcaggtgaatcacttgaggtcaggagtttgagaccagcctggccaacatgacgaaacctcatctctacaaaaaatacaaaaattagccgggcgtggtggcacatgcctgtaatccctgttacttgggaggctgaggcaggagaatcacttgaactgggaggcggaggttgcagtgagctgagatcatgccactgcaatccagcctaggagacagagcgagactccatctcaaagatgaaggaaaaaaaagaaatgaggctggaggaggtggaggacaaaggacatgagctggccttactaggagggtggagtgtggtgccactgtgttggacattgccctgagtcagcccacccctcactttcagatgtcaacgagtgccagcgctaccccgggcgcctgtgtggccacaagtgcgagaacacgctgggctcctacctctgcagctgttccgtgggcttccggctctctgtggatggcaggtcatgtgaaggtgaggctggggccccgtccactcacctcccccaggtcaccttcctcctggggaagccacccttctgcagaccggtttgcagcagatccgcgatggtttccctgttaaatgacatgttagcaggggaagtgcctgtaaaatattgttcatcagagaggactgcccgcctgcccacccgatttctcctgatgacatccaccctccgaggccgtgtcggggttcataggctgcggcagaggccatgcgggatgtggctaggattatggggcttggagcatgacacccacgagtcacagggccttggttatgcccgacctctccctgcctccgtgtcctccccggggagaggggttgatgtgtgaaacagcagcgaaaactggacacttgttttgcacaaagacagtgtgtgggttttaatcagatgctgcctaggggagacaggcctctgtgtccattgatctcaagtcacccaaacaaaaggagggaggctttgtaaatgacgagctgtgagaggaagtactgaggcctttagggcgtgggtcactgtgcacctgcctctaacttctttttttttttttgagacggagtctcgctctgtcacccaggctggagtgcaatgctacgatctcggctcactgcaacctccgcctcccgggttcaagcgattcccctgcctcagcctcccgaatagctgggattacaggtgcacaccaccatgcccagctaatttttgtatttttagtagagatgaggtttcaccatgttggccaggctggtcttgaactcctgacctcagatgatccgcccacctcggcctcccaaagtgctggcattacaggcgtgagccaccgcgcccggcctgcctctaacttcgtgttggagttaggctttccccacccgcagagacagggagaagcaccctggccttccggatgacgacattccccaggcatgtccccagcccttgagaaagacactccttggttgcacatctcaaagggacagagaaaccgtttacatttgcaagtttttctaaagtagatgcttctaaggaacatggaggtcagcgcctgtagtcaggtttgggctggaaccaagagaaaattcttttggcagcattgatctttctcagacaggcatgtcaagggggctgggtctacatcctggatacctggtcttgggccaatggcagccacgctgaagttgggtcaggtctcttggtatgtgggggttggacagagttgttcctgccaacagtcttgtggttctcagataacaccaacctcctgggctgatgggaaggtcacatgaactgcatgtcagcccagggcctggcacatactaggtgcttggcagatgtcgtgtcttgtatacggattaggttctgagctgagcagacactgagagctttggatggccctccacaatcgtccacattgccgatgacaccctgtttggtgccgtgcactggctcacaggacagcttctgcagcctgactcaaacatggcaggtcctaacattttgccgtgagaattttccttcctgatgagatggtcgcaggggttggatatgccacagtgagctgtggtgtgcatgattctcaaatcggaggacggacggtgtgaggggtcctgggcttagttcacaagaacgtgtatggacaaggaacaagattcacgagttgagtctctcaggcttgtgttcaaacctgacttctgccatttccatggccttgaagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccagccttgctatgtgaccttactaaccatttgttaaggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagtgtggcagggcacagtggctcacacctgtaatcccagcactttgggaggctgaggcaggtggattacttgaggtcaggagttcgagaccagtatggccaacatcgtgaaaccctgtgtctactaaaaatacaaaaattagccgggcatggtggtgcacacctgtaatcccccagctactcaggaggctgaggcaggagaactgcttgaattcatgtccacatttagtggacaatagcctcccggaggtggagattgcagtgagctgagattgagctacttgtactccagcctgggcgacagacaaagactttgtctcaaaaaaaaaaagagtgaatgtggctgtattctttattttattgttattattattttgagacggagtctcgctctgtcgcccaggctggagtgcagtggtgtgatcttggctcactgcaacctctgcctccttgttcaagcaattctcctgcttcagcctcccgagaagttgtgactacaggtgcgtgccaccatgcctggctaattcttgtatttttagtagagatgggtttcatcatgctggccaggctggtctcgaacccctgacctcgtgatccgcccacctcggcctcccgaagtgctggaattacaggcatgagccaccatgccttgccgggctgtgttctaataaaactttatttataaaaacaagtgttgggacaaatttggcccatagactatgatttgctgacctctgctttaggtaaaggggacagttgagcagtagttcagagttgctgagtggcccagtgagttctgtgcattggagtatgaggagtactggcgtatgggctgggtggccgaggacttccttgtgtgccgtcatctgtttaggatgccatcttggaggtgaagtggagagcacaggatcagatttccatttgagaactagaatggactctggcagccaggtcggggcagacttccaggggccaaggctggaggctatcgctgccatcctggcaggagaagttgtggtcgaagcaggcaggagcagggatggagggtccggagccaccagcgatgacgcctctccctcggccacaccccccgggacctctgtctctccgagtgtgttaacctgagggaggtggagaggagattttctgttcactgaccctgagggctactgtggaggcagggacgtatgatgctctgagcggtgaccctcgttttgtatttcagacatcaatgagtgcagcagcagcccctgtagccaggagtgtgccaacgtctacggctcctaccagtgttactgccggcgaggctaccagctcagcgatgtggatggagtcacctgtgaaggtgcggacgcccctgcctgctgagggggaaagcaccccctggtcttgccatgacacagcagcacggcctctgactttcaaaatccacagggaagagcctgctgggatttcttcacctggcaaaccttccatgtccacccttggaggcaagcgggtggtttgctgttttccctccaactgaggtttttttttttttttttttttttttttgagacacggtcttgctctgttgcccaggctggagtgatatggtgcaatcactgctcactgcagcctcagcttcccaggctcaagtgatcctcccacctcagcctcccaagtagttgggaccataggtgtataccaccatgcctggctaattttttatttttaaaaaattagagacggggccttgctgtgttgcccaggctggtctcgaactccgtggctcaagtgatcctcttgcttcagcctcccaaattgctgggattacaggcatgagccaccgtgcctggcccccaactgaaattctaatatacttttcccatccttaagcgtgagggtgggaaggcagcaaaccactcctgacttgttctttaataaatgtgcacggcggtaattacaacatgcactgggaccttgggccgcatatctcaggtcttggtggtggtgcatggctgagaggtaaggagggggctcagggaccacctatatccctgactcagagctctaactcttcatctgtaacatgatgattaacttcagcctcaccagatcattggaggattaaactagatgacagcaattacaggcaattaagggcaattacgatgattaccattttcatgtaaggtgtgtgtgtattttgtttgcttgtttgtttttgagacagagacagctctgtcacccaggttggagggcagtggtacaaacacggctcactgcagcctccatctcctgggatctagcaattctcccacctctgcctccttgagtagctgggcccacaggcatgcaccagtatgcctgactaacttttttgattttttgtagacacagggtctcactttgttgccgaggctggtctcgaactcctgggctcaagtaaccctcctgcctcagcctcccatgcctgggattccaggcatgagccagtgcacccagctgaggtgtgtttcttattattgaactgtggtccatatttccccctgcccgccacatgcatacttcacaccatgaacttgctgtgtgaccctaggctagtcccatcgcctctctgagcacgatggtctctgaggcttcctgtgttcagcttgtcctgtgctgctgccctcccgggccccagtgcagcccccagggcgatgtagcatggccagcagccatggccaggtgccaggacactgaggctgaggtgggctttgccgttgcagacatcgacgagtgcgccctgcccaccgggggccacatctgctcctaccgctgcatcaacatccctggaagcttccagtgcagctgcccctcgtctggctacaggctggcccccaatggccgcaactgccaaggtgagcaggagggatgccctggggtccctcacgctctgcttggggccctgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgcccgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagccagttcctcgggagccccacacaggactgtggatcctggggctctggaagccccctgggtcccacagatgtagcttctggtcatgaggaaggtgactttgatgaaaggcaggcaggagctgcggtgtttcctgggaggccccctccgcttgccctgggctctggatggaaggctggttgtgtctgcatttctgacggagcaaatgacttttctcctggccaggctccctcaccacagcctggggtcccgcccagactcagcataaacacattcctgagccgggcctttgaggctggggagtgttgtttttgccaccgatgctcaggcatttggcacctcttaatggatgtctcccagggttggtgacagcccctgagccccactgtttggctgctccagagtctatgggagttgggctgctcccccatctccaggggcctctcagtgtggtgccccaggccccatcccaggagtcccagacctggtggttccagtccaccctgaacagccaccaaccccaacacacaggcaagacgtatgatccctcgaaggctgtttttctcattgttgtgtggagctagcagctcctgcccttttctcctaagaggttgagtcacacctagggtaagggtgctgagcctcgggagccacagagaggctctggttagttagtgtatggactctgatgccagcctgcccgggttcaaagctcagctctgacatttataaaatgtgtgacctcaggcaggtctcttaagctctgtgagctcctcataaaatgaggatcataacagtatctgcctcattgagttcttaggaggattcagtgacttatccttgcgaggtactcccaggacccatcatgtagtgtttacttttaccatcgtcacgctccctccagggattgcgaatgataagttaacactctataaatgtaaataccctataaatgtaagaactggcacaggacgctgctctgaagatcagccagtggagggcagggatggcctgatcgccacccctaaccctagttgatgggaggcctgggctcctccgtctccagatgggtatggctcctgcagcctctgccttcactgtgctgctgtggggtctcttgcagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcgtctgtctgtgttggccttcctggtgacccagttcccgggtgggtgggttatcaggctgtgacctcggtgtcctcccatgagggactcagggcactcaaagatcacctgatccctggccctcaagcccctaaatgctagtgacactggtctcggaaagtcaagggggtaactgcaaatgagtctggggtctatagtcatgttttcaggccaaggctgtgcacagaaccaggagaaaccacagccctcttttttcctagggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttgcttcaggaaaagctccatgctgggaccgatctcaggactgtggacttgtgacctctcccagcactctgagtgcacgatgcaggcagccagctgtttccgaggccttggccccttgaccttcagcctgccttgggctcttggccagctgcccccgcgacctgagggtcagtggtagtgtccacctcttgaccctaggggcagctgccctggcttgtggcatagcaaggcttctgggtacccgagcagccccgttgtccctggcagccctccatattcttcctggctttgcgattctcattggctggcccagccatttccctgtttcccagcacggatttctgtctgcttgaaaacccaacatcttgtttccttcctgagcttgggttaggaaaaagctgccccaaaactgggtttgcaagtctgtagcatcccgaagagctcatggttatgcaacagcctgccccaggcagtgacactgcttctctgagccattaagaaagttcgatggccttggctgcaggctgtgcagccgtctgtcattgtaagttcactctctccccagcctttgtcagcgcctgggcttgaggattccaggaggctggctgtggttgtgacctcgatttctaacttgcgcacagtcgtgaaaccacctttcgaagagggggaggctgccctgcacaggggccctggcgcctcctaagcctgagggtgggcgggttggccatgtgtgctgaggtcatggctgaaatcaggggaacccagctccacccctcatgttggctgtggaagcctctgccacccctcagtgctggagaaagtcgtttcttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgacccaggaagctgggccgcaaaccacagggctcggccttgtggacaggaccaggctgttacagtcctgcccacacaattcccttctgcccgcaggaggaagtgtgcaaagctgtcccacagcctttcatggggccggacacatcctctttatcccctcagtggggccggcgcctgatgacctgtggtctagaaagctggagcaaagccgggtggccttggttgccgcttcccggggatgggacacgagtgaacagctgtgggcctgagggtgtaacacggtggacggtggcagagatagagccgtcgatggcccccctgccttggccagttcctggggcttgtctcccggacgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctgtgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttttggggtgctctgaggaatgactgtgtggggtcggagggggagcctccaggggaggagtgaccagtcgctgtgtgtgatgacggcgggagctgcaccagaacaccacgcacacctcccattgctttcctccgcttccctctggcaaaacaaattccatccctggttagtacccgccatgctgagagaagcgggaagccgaaatcccaccagggcgactctagcgccacctgctgaccagccccatccaggctggtcctgaagttgctggtgtgtgtgcgtgtgcgcgtgcttgtgtgtgtgcatacattgtgtgtgtaaaagctttgaagtaagacaggccgactttgaaagccaagcttgccccttacgacacaccacggagctatcagcaagttctgcatcctcaatgggcgtctgtcttccagccagtagagcgggaggacgatgggagacagtggagggagcgagtggaaggaaagtctgctgcttgcagcctgctccctgcacccggaagcgcagttcacctgcacccggaagcacagctcatgggtcccatgctcctcccccagttcacggacgctttggtcatagctcctcagaggcccccctgggggagagctctcagatcgcctggagcactcccgtttggcctggacctgggcatctctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttaggacccgtccccgtctccaccacaggaagttaggacccgtccccgtctccaccgcaggaggttaggacccgtccccgtctccaccgcaggaggttaggacccgtccccgtctccaccgcaggaggttgggacccgtccccgtctccaccccaggaggttgggacccgtccgtgtctccaccgcaggaggttgggacccgtctctgtctccaccacaagaagtttggacctgtattagggttctctagagggacagaactaatggaatatacatatatatatatatataaaatggaatatatatatatatatataaaatggaatatatatatggaatatatatataaagtggagtttattaaggattaactcacatgatcacaaggccccacaataggccatctccaggctgaggaacaaggagagcagtctgagtcccaaaaatgaagaaaaaatgagtccaatgtttgagggcaggaagcatccagcacgggagaaagatgtaggctgggaggctaggccagtctctcttttcacgtttttctgcctgcttatgctgtagccgtgctggcagctgattagttggtgcccacccagattaaggatggatctgcctttcccagcccactgactcaaatgtgaatcttttttggcaacaccctcacagacacacccaggatcaatactttgtatccttcaatccaatcaagttgacactcagtattaaccatcacaagtccaccccttgtcaacttgaacccatgcacatctcctgagatcatacataatcttcaaataaagacaataataagatcataattacacctaacataactatacttcatacgaccagaaactcaccaatccccaacccaaatactattatataaagttaacgatacttaaatgctgatgtgaattcaataaatcttatgtcacttgataaaagagaaaggaaataaaatgaagtcatttttgttagtacaagtgtatacatgcacaaacatttttgattgttttttgtttgtgtgttttttaagacagagtctccctctgttgccgaggctgaagtgtggtggtgtgattttgtctcaccgcaacctccacgtcccgagttcaagtgattatcctgcctcagcctcctgagtagctgagattacaggtgtgcaccaccatacccagctaatttttctattttaagtagagatggggtttcaccatgtgggtcaggctggtcttgagctcctgacctcaagtgatcctcccgcctcggcctcccaaaatgctgggattacagtcgtgagccacagcacctggccatgtttttaaaagaaggaggaaatactcacgacaattacagtcctcgtttctgcaactggtcacatggctcgtagctggtattgatgactgccttcttctactacccattctgtattccctttgccttcagcaagcaccttggcagatcttgttttttttttttcctggtggagtgacccaaaccttcattcctgaagggtctgggtcatttgtagtcctgcctggattgggctgttgtagtttcccattgaccttaatcacagggcatggtaatactgagagatgccctaatggatctcctgtattccatgcatactctaacttatcttcattttggagtagtagactgatttcatcttgatagtctgggtcagccaccccagccaacactgtaactcccttcttagcctgttgacttaaaggtaggaggagcttcaagtgtccaggtggcaatcttaatttccagtttaatggaatccttgttctgtctcctggtggcggcgttcctccctctggaactaagacctctaggccagcagaacgtaatgttgcaggaacaggaagcaaaaattttgctagtggatcactaggggtgatggtgagtggtgccacttccatttccacccttggatgcctggacccgtgaatcctggctatgggagaaacagtgccataatattggaccctgattcagagcatacatggccttctgtagaactttgtcccagccctgcaaagtactgtcacctagttggcattgtaattgtgacttcaaaaggccattccactatcctatcaatctacctgcttcacgacgatggggaacatggtaaaaccagtgaattccatgagcatgagcccactgccacacctctttagccgtaaagtgagtgctttggtcagaggcaatgctgtgtggaataccatgagggtggataaggcattctgtgaacccacggatggtagtcttggcagaagcatcgtgtgcaggataggcaaacccatatccagagtaagtgtctattccggtgaggacaaacctctgccatttccatgatggaagaggtccagtataatcaacctgccaccaggtagctggctgatcaccccgaggcatggtgccacatcgagggctcagtgttggtctctgctactggcgaattgggtactcagcagtggccatatccaggtcagccttggtgagtggaagtccatgttgctgagcccatgtgtaacctccatccctgccaccatggccactttgttcatgggtccattgggcaatgacaggggtggctggggaaagaggccgagtggtgtccacagaatgaatcatcctatccacttgattattaaaatcctcctctgctgagctcttttatgtgatatggtgagcactctcatgtgatacaaatatcttcacagtttttgaccactcagagaggtctatccacatacctcttccccaaatttcattgtcatcaattttccaatcatgcttcttccaagtccctgaccatccagccaaaccattggccacagcccatgaatcagtatgtaatcgcacatctggtcatttctccttccatgcaaagtgcacaaccaggtgcattgcttgaagttctgcccactgggaagatttccctttgccactgtccttcagggatgtcctagaaaggggcagtagtgctgcagctgtccactttcgggtggtgcctgcatatcgtgcagaatgatctgtgaaccaggccctagtcttctcttcctctgtcagatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcacttactggatccaatcagcataatgtcaccaatttaatggaccagcgtgatatcttgcagaagcgaaatgcgatcaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaaccacatctggtacagcagctgcaaattggagtcaccacttggttaaacttacgataatccgctgccgttcaccaagatccatctgtcttctgcacaggccaaatgggagagttgaaccgggatgtggtgggaatcaccaccccgcgtctcaagtttttgatggtgacactaatctccgcaatccctccgggaatacgatattgtttttgatttactgtttttctaggtagaggcagctctcatggcttccatttggcctttccaaccataaaagccctcaccctaccagtcagggagccagtgtgggggttctgccagctgctaagtatgtctctgccaattctgcattctggcactgggaaaatgaccacaggatgagtccggggacccactggacccactgtaagtcagacctgagctaaaactccattaattacctgacctccttaagcccctatttaactggagggccacaatgacgttttgggtcccctggaatcaacctcagctcagaatcagtgtccaatagtccccaaaatgtctgatcatttccctttccccaatgcagttactctggtaaaaggccagaggtctctttggggaaggatgggagaaagattcactgcataaattgtcagtaatgtagtggggtccttcctcaagaggacccgcctccccttcattcaaggggttctgggtctgtaaactggttcaagtctggaaattgattgaggggccgtgattctctttttttgtaattcaaattagtcttttgtccacttgatctagaagttttcggcttatacaaatcaagtaggaatgcagtaggcttcctatcaatttcacttctaggaacactgtgattaattagccaatgccagagctctacacgagacagactattctgattgctgctttgcctctgctgtccattacagaagctacacccaccttgcctttgatggttgagtgctgtcacttggccactgccacctcaggatccaattatttccattgtatttaaattttgtagttgagtgactgtggttcccactgttagatctgacataccaagacgagcaattacagggctcttcaaagatgcaggtgctgccctcacaaatctgtttcgaaagacattggtcaagggtatatcttctgaatcctcccaacttggttgagtaggtctaaagtgactaatccactccaccatcccaatctccctaagtctttggattccttcctctacattaaaccaaggaagaccaagcatttccagcttgctcacagtgggccatctcttcatccgtatttcagctaaaccagcaaataaactattagaaccttttttaactccccgagttgcaacattaaatgcagagtccctgcttagtgggcctaaatctgtaaattcagcctaatccaacgctatgttccttccaccattctccgacacccttaatatccattctcatgcccgttctccagattagtttctataaattagaaaactcaagcagttcttttcgagtgtagctcacttcctcatgggtcacactctcaacctcatctctaggggcccgccaggactttagtctagttataggtctagaggcaaacaggggtgttaggggtggctcctgaggagaatcaacattatcttgcctggcaactgcctcacaggaggccatcactgttgcctcaggcagcgtggggtttatctccttagacaaaggtggaaaggctgatgggtcggggcggggatgttgccactactggggatggggaagctgttaagctgtttcttctggcaaaaaagattcatcagagtttataaactcagtgtccccagcttcatcaggctcctcccacatgtccccattccaagttgcagggtcccattctttttcaatcaatgccctcactttaacagcagacacctggcgaggctgtgcatgcatctttcattgcaggtcagccactcgcatgataagagcttgtgtctgtttttccacaatttcagctcttcctctacaggagataagactctcactcagggcaatcttagcagatttgaggctcagtatctgcttctgaagctgggagatggaatccctgagttcataattttctttcatcactttgtccactaaacttaggagcaaccaaccagcttcattatgttccttggttctccacatatgatcaaagatattatgtatagagtcactaaacttgcctcatgagcgatgaatcaggagtttcaaatgcgtttatttttcataactctctaaacagttcatgccaaggactatcagtgttctccatactattagaagtggagtccttagcatttttggatctaatcgttaaccagccaaccccagaaaccccaaaaccaatgaaagaactccatctttaatattctcttcctctagaaccactcctggtaccaaaatctgtagtagttagggttctctagagggacagaactaacggaatacatatgtataatggagagtttattaagcattaactcacacgatcacaaggtcccacaataggccatctgaaggctgaggagcaaggagagccagtccgagtcccaaaactgaagaacttggagtccgatgttcaagggcaggaagcatccagcacaggagaaagatgtaggctgggaggctaggccagtctctcctatcacatttttctgcctgcttatagtctagccgtgctggcagctgattagattgtgcccacccagattaagggtgggtctgcctttcccagcccactgactcaaatgtgactctcttttggcaacaccctcacagacacacccaggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaaggccacattctctctgagcctcagtgtcctcatgtgaaaaatatcaccgaagccactgtcatggggtggtggcagtgatcacactagagagtgcatggtgaggaagagctgagcacttggtaaacggcagcagctctgattgctagtggcagagatagtcatttcatgggtcacctccgagacacaaccaagagccctgcgtagccctggccactgtctgggcaagggcctgggaagggcagggtgtgcctggggagtgcccctggggtggggctctgccagtgagcaggggacgcacctcactccgggcacagcctttggcccccggccacccagcgcccgagatggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaaccctcttcttgtctctctgcccacttttcttgcagccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcgttttacagatgtggaaactgaggcccagagagaaggggaagggttggccagggtcgtctggcctgctgtggccatgccaggtcaaggaagcgggtctgctggcccctgcctggttctttgctgtatccccggaggtgagcatttcactgagacaagaaagctctctcctgagattcaagcctcctcttctgtttgtcttgatcagaagcccaaatctgtggtgcagaaacacgggatgcggttgcggctcctaggatgcagctcttgcctcagtgaagtcgttttgcccccactgaggatcctggccctgtgccggggcgaggcaaaggaccacacaatacatgtgatactcaggggatccttcataggccttacaccagtcctgccaggcaggtggtcatcctcatgaagactcagagagggcaagtgatttgcccaagatcacacagctggtatccgagccctggtttactgactccacagatctggctgttgcgttctgccagaatacctccactgagggccttaaccccctgcctccctccatctcctccaccatggtccagccaagccagtcatctgtccccctctgctgctcccagcgtccattcacctcccctacagctcattctttgcttagcagctggagtgatcttttagcctctgcctaaaaccgttcctggcttccttaccatttgggttaaggcctccagatcctcaagatgtctgaaggccgtgcctaatttagtccttgcatgcaatttccagcctggcctcaacttgttctatccttgcccacttcccttgagccacgctgcaagctctgctgcctccggcccttggtacgtgctttgcacccttggcctgaatgttgcttaaactccagctcatgtgcctgcctcagagaggccttccctgccacccctggcttctgttttctctgtccgtccttctcatgacccctttccttcatggtgcttgtaacaggctgcggttcctgttgactcgcgtttcacatttgtcttccgcaccttccagaaggctctgtgaaggcagggaccaggtctatctcattcagtgcggtgttcccagctccttgcaagacatctcgcgtgcagaaggtgctctgtcaatgtctgttcagggaacagatgactctgccagccctggcttatgtcactagcatttctgtggctgtgacactgtgctgacactgtttccaggcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgtacctgccccaccccagctcatccatgtg

SEQ ID NO: 17237 - DNA, 48682 bp, Human; identical to SEQ ID NO: 17236

SEQ ID NO: 17238 - DNA, 48682 bp, Human; identical to SEQ ID NO: 17236

SEQ ID NO: 17239 - DNA, 48682 bp, Human; identical to SEQ ID NO: 17236

SEQ ID NO: 17240 - DNA, 86213 bp, Human
gaaactgttgggctttgctgtggcacgaaacttcacccttacccacgccactgcaggactcctcctgccagcctcggggagccgggtgagagtcagaagggtgggtctaccttgcactgcagaaagcagctctgagtttcctggaagccctggggaaaagggaaagcccagaagttgtcactgggggacatggttctaggtgagacccccctcctcctggccttgtggaatggcctggctgagccctagctcattcgtgcactgaccttatccattctggaatgtttctgcaagtttcccctcctcccctgctgagaacgggatggagcatctgaaggacgcatagtctagaagtgcttacagtggctgatgactgatagggtggtttagcaaggtgctgcctcacccagcagacagcagccgccctctgggccaccccgagggcccagcctggaagaagaatgtattcaggcagggcacccacagttgtgtgtgcggaaacgctgccaagcccagtgggatttaccctctaggggctggaaagccattaggaaggaaaagtggtgcttcttaaagcccagttttgtaacatcctgccgagaggtgaccttctgcccagcagctggggctgtcgtgctaatgctttctggcatttgagtcctttagaatgaggtccaagtatgtgggcacctggcacccggccgctcctcccttggggcacaatggggtcttctcccttccgtgagctgaggggctgggagggtgcccactggggctgtagcctgggctggggcatggggcacaagggcctgtgtgcccagctcatttgggccgtggcctggctctgagggtgtgggccggctgcttggagcgtgatcctttcatctgccctttttgcgagtgggagataagatggccaggctgcggttactcctgaacctgtgctctctgctttgccagtcctgtcctcaccagacttctcacaggtccccgtttctgtggaagaggggatcttgtggtaagtcaagggcagaaaccatcaccagcctcggtttcctcaatctgtagcttgaggcttatgtcccccctcctgcccctttgctcccaagattaaaggagaaaacacggatgtgggtcacagaagctggtctagaaatggtggtttttaggctgggtgcggtggcttatgcctgtaatcccagcactttgggaggccatggctggccaatcacgcaagttcaggagttccagaccagcctagccaacatggtgaaaccccatctctactaaaaatacaaaaaagtagccgggcgtagtggtgggcacctgtaatcccagctactcaggaggctgaggcaggagaatcactcgaacctgggaggtggaggttgcagtgagctcagatcgcgccattgcactccagcctgggcgacagagactctgtctcaaaaaaaaaaaaaaaagaaaaaaaaagaaaatttttttttccttcttacttgactcagctcgttgcattttgaaccccctccctgtttgcagtctctcctctggaaagagtcatgtcggctgttccctgacctgctgggctgggctggccggcagcatggccgtgcctctgtcatcaggggctgtctttcttgcctactggactgtgaaggcagggaccctgtctggacagggaccgcatcagcatctccagcatgtggctggagcagggatccatgtgtgcttggatctcaggggctgagccgcagccctgtccaagctggattcagatgggggaggattcaggtctttcttctaggaaggagtggggtgtggactcgcagctggggtctggtggggttttcagtactggtttgcagagtgactaagggatgtgcccccagcctgatgctgtcgtcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggtacgtttgccagtggccactgtttcactggaacaatgttcctttagagaaaagtgggggaggaagggacagtgtgtgccagacctctcgggagaggctggacacccaggcccggatccatccaggctgcgggtgctgcagtgggtgactcctgcctccctcctggcaccggcctggcaccgggccttggctcacccttcctgtgccactctgtgattgtcggggtatgtgtctctttcactgggctgggagcaagaagatctgggcttgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatctggatcgaccgtttttattcttctctccctacattgactccagctctctgaaaattctgagaccgtgtaagcttagaataaataatgagaagccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaatcgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagcctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggctgtggtggcgggcgtctgtaatcccagctactcgggaggctgagacaagagaatcgcttgaacccgggaagcggaggttgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacagcctgccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgataaattttggagttatcttttttctttattttttgaaactgagtcttgctctgttgcccaggctggggtgcagtatgttgatcttggctcactgcaacctccgcctcctagattcaggcgattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaataccatcagaatggctgagagggcattccttctctctttaagtgcgggtgcaagtccagactcctgggtatcgtgagtttccatatgacagtgtccctgaaacacgtggctcaatgcccaggacaccactccagggtcaccagatgcaagtgactggcccattgtgtcacttaggccccaggaggcccattgactcatcccagtggacacacaggccaggggccacatacctgtcctaggctgcctctcaagtgagctactgagctgcccagctctgcctgcgtcactgccctgtggccccaggtgctgtccgctgccctccagcccttcctgtgtgcttcccctttaccctgttctcactggggtccaaaccccacgcagcctgtgccaatcagaggccaagcctgggctccaggtcacagtgagacggagcccacataagggttcaggaggcagtcactgatgtggctgtgggggtcctcgggtgagcaggaccccgccccagcctccccaacctggggaggtcagagctcctgtctggttgaggcaagggctgtggatgcggggtgtggccagcagtgcagtgatgctaatgaagggattttctaatgagttttgtatagattttcatttttaatgaaggcagggaagggatagggcagatcagaaatcaaatcttatttacaagaatcctcttaatagtgatatttaaaagatgcaaaaaacagggatcactgaccacctggtttgtctgttgtgttagccagctctttttttttttctttttgagatggagtctggccctgtcgcccaggctggagtgcaatggcgcaatctcagcttgctgcaacctccgcttcctgggttcaagcgattctcctgcctcagcctcctgagtagctaggagtacaggtgcctgtcaccatgcgtggctaattttggtatttttagtagagacgggagtttcaccatgttggccaggctggtctcgaactcctggcttcaagtgattggacgcctcagcctcccaacatgctgagattacaggcatgagccactgcacccagccaaattctcttcttttgaagtggctttctgtgaggctcaccagctgaagtaaaatcagtttttgttcattcaacaaatctttattggttcttgatgctcaggaagaggcaggatgaaagccatgagcaggcaggcaagcccaggccagccctcctggcagcagtcgagggtgtgaggccctgagggtccatagggcccaaaggagggggtatcagctccctgagtgggtgagaggctcagagaggactgcagggagaggccgacctctccgcaaccatgggctgtagccaagcaggggttaagcagcctgcagcttcaacaaggacgtgtttggggtggtcagaagatggcagctttgatgttttcccatcatgaatcatcttgactctaggtctccaccaaggcccgacattccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggggatcaatcggtgaacgaaatatgcaagtcccctggcctcgtggaggcggcattctataggggatgcagaatgcaaagaaagtaataagtccgtctgatggtttgtaggaaggcaggatgtgccgtgggggaaacagggaggcataggggcttctgctcatggtgggtttataattttagagccgtggggttggcctcactgtgccaggacctgaatggggcgtgggcagtatggaaagtgggaagagcatcccaggccgagggaacagccagcgcaagagcccagaggagagggtgtgtacagcaaggcggccagggtggctggagtggagccagcaacggccagtcccagggaggaagcaccagatacaagggtaaccaggtggctgagggggccatgagatagaggctggggtgttgggggtgagcctgaggcagctggacaccctgaggtgcctgggacacttgattgcttccaccttttggatgttgtaaataatattgctgtgaggccgggcgcagtggctcacgcctataatcccaccacttcgggaggctgaggcgggcagatcacttgaggtcaggcgtttgagaccatcctggccaacatggcaagatctcatctctactaaaaatataaaaaattagctgggcatggtggcaggtgcctgtaatcccagctgctggtgaggctgaggcaggagaatcacttgaacccaggaagcggaggttgcagtgagccctgatcgcaacattgcactccagcctgggcgacagagcaagactccatctcaaaaacaaaacaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattcccaccagcaatgcacacgggttccagcatctccacatcctcaccaacacttgtgattttctggctagccaatagtttttgaatggatgcacgcatggctggtggctcgctctggcagtttagtgaaacgccgttatttgcaaatccaccgaaagcatgagtgaaatgtgtgctagctcagctcggtaattccatcctggagcctgaaggcagttttgagacacacgggcagccgggttcagacctccagtcccccagggaaggttgggggaaggtgcactggcagctgccatttttgtgcagaggtggcctggctggcagtgcagggaagctggggaggcccccaccctctctcctggaggcacgagttgggtggctcttcctgcccttgctggctttggctggagctggggttattttgggtctggtcaggggccacccgtgacacactcctctcctgctcattgcctttggagcccgcccacgccagcccctagctgtcacagcctcatggttgtgttggaggagctgattttggcaggtcgaggacctctccccagagccccggcagggctgggaggtgtgggctttgcagctaggtgccactgcagccaccatccctccctctggggccttgggcaggctacccaacaggactctcagaagctgtttgctctgagcctggaagatggaacgagcactgagaagagcttgacctgataaaggggtggaaggttgggcccagagtcagccccccgccgctttttggttttcaaatcagcaggaacattgtgcgggtgaagcctagtgctcagaggagtgacgcggccactctggtgacaaaactgggcctcctggctctgactccagacaccatactacattctgtctttctttttttaaaaaaagaggccaggcatggtagctcacgcctgtaatcccagcacttcgggaggctgaggcggggggatcacccgagctcaggagttccagaccagcctggccaacacagtgaaaccccgtctctacaaaaatagaaaagttagccaggtgtggtggcgcatgcctgtagtcccagctactggggaggctgaggcaggagaatcgcttgaacccgagacgcagaggctgcagtgagctgagatcacactactacactccagcctaactccatctcaaagaaagaaagaaagagagaaagagagaaagggaaagagagagagagagagaaagaaaaacagagagaaagaaagaaagaggaagagaaggaaagagagaaagggagaaagagagagagagagagaaagagagaaagaaagaaagagagaaaaagaaaagaaaagaaagaaagagggtcttaccatgttgcccagactggtctcgaattcctgggctcaactggtcttcccacctcatcctctcaatgtgctggcatgactggtgtgaaccactgtgcccggccaagcctttctaactaaatgctaattgagctccttctgtatgccactggggcactgtgtatttctctctctgtgtctgtgggagcagggaaggggaggctcaaaggtgagagcacccccacccccgaggatctcgtgccctgggccccctgcgcacagagccttggcccagcccacccctcacccacaggatggtgcaggagcagtgctgccacagccagctggaggagctgcactgtgccacgggcatcagcctggccaacgagcaggaccgctgtgccacgccccacggtgacaacgccagcctggaggccacatttgtgaaggtgagagccaaagaccatgtggggtcgctgcccgtccccactagtcggcagacccaggccctcccagccaagcggcactgtctgtcagcgctccctgcctcaggccacctttctttgtgagcagctgggggttcctgggccaggagggaggtggaaaaccccactgtttctccccctccactgtagccgtaaaccccggaggacacctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcctccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccaggaggaacttgggcctggaggagctcgggtttggaagctgggcttctgttggaggtgccagatgacgaaaatgcattccctggaagaagcttcccgttcctagttaggaaggtgatggaataattttaagaagcaagaatctgaatgaagtctggattccaggagagggtgtgggagctcctttgtggggattctccacatagattgggctgtggagggactccgtgtggaggagttgggggtcccgagtcccctgcccaccttggcctgtgtgggctttcacagggcagggctctggcccaggagagagctgggtggggtgatggtgggggtgcctgggaaccaggactttgggcgtttcatgactgcccccgcaccctcccacccaacacccaatgcagggctgggccttgcagatgccgtcggtccggcacacagctgtgcccatgtccccagacttgagaggtgtggaaaaagcacagaacattctagcaggagtgggaacagatcgctctggcagatgagcgacttgtgtttccaggaaggattactcacaccccaaaagatggatgaggtgactgatgctccctacactttctggcagcggagggcgtagaataagcagcctggaagacccatcagtgccacataactgaggcaaagctacacctcctggctcctgctggggactgtttagaaagttctgtgctcctcttaggataaccacttaataaagactgaaggagggcttttcgtgtgtcagggcaaatgttgcttctgggactcaggtgtgaggccacagggacttggaagtaactattgggacctgggcccaggtggcagacagccaccctgtcctttgaccttgcttgatgactcgtcttgaagttcctgtgctttcaaatgcacggtgcaattcctgctgccagaacccctctaactcaaaaacggagaggcagcatgcatgtgtgtcatttttccgggcatggtagagaaatctcagaccatgcaaaaggaacagaactttggagctggtgcatggtgctataagaagctccctcttcctggatgtgtgcgagcagagccgggtggtctctgggcggggcagggatgttgaggggtgcaattgcatgttggggtggggaggggaggtggatgccaggccctttaagcttcctttcaaaactgggacctagatgatttggagtagggggatggccttgctttgctatttgttgctgacatttagaagtggtatctaagccagacttgagtcatcactctacaggttgtgtggacagggggctcagagaggcctcccctgaggcctctcgtggaccccgctgggctgtctgcccgctcctccatctgggatctccacctgtgtttgcagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacgggtaactttcccccttccttccctaatgagcagtgtattaaggttctccgggatgtgtatatagagcgagagtggagagagagagattttaaggacttggctcatgtgatcgtgggggctggcaagtccaaaatctgcagggcaggccttcaggctggagccccagggaaggaggggcattgcagctggagttcaaaggcagtgtgttggcagaacgccgccttccccggggaggccagtcttttttctctgaaggccttctgctgattgagtgaggcccacccacggtatgaagatgatctgcttttctcagcatcaacagacttacatgttaatctctttttttttttgagacagaatctctctctgtcacccaggctggagtgcagtgcagtggtgtgatcttggctcacggcaacctccgcctcccgggttcaagtgattcttgtgcctcagcctcccgagtagctgggattacaggtgtacactaccacacctggctaatttttgtatttttagtagggatggggtttcaccatgttggccaggctgatctggaactcctgacctcaggtaatccacctgcctcagcttcccaaagtgctaggattacaggtgtgagccatcgtgcctggccaatattaatctctaaaatatagcttcacagcaacatccaggctagtgtttgactaaatatttgagtaccataccccagcccaattgacacttacgatgaaccattacaggtaacacgtgcatccgtgtcaccattgccttaactcagcacggactgactccggttgtcggagccattcatgtttgtgaccttatctgaaagccgctgtcctggagtgacgctgagtgcttggagtctgggatcggacaaatctgtgctcccatccgggtcctaatgtgtaccttggtcccctcatctgggaagtggggatagttgcagtcctacttcatcaggtgctgggaggatggagtgcgagattgggtgtcaagggttgggtagagcacctggccccataaatgtctgccctcaccatctgcccttgtcccttcagctgcccggggcagcatgggtggctggccttgctcccacttcttgggtgagggtctgatgctgaagatcgcacagccgacacgtggaggagggagagcctggccttccacctcctggccagtgccctctccatctggagctgacgatgtatgggcgagcagctgggggccatcgctggctaatagctggctatgctctgtcaaatcatagacacttactcagcaaaggggcatgtgaccccaagagcagcttcaagagcgctctcagctgtgtgcccccccgttctgtgtcctcgccctgcatttctgtgtggttcagttacagggttcaggagactttgtggctgtccagtagcctcttacacttaggccacggtttcttgtgctgtaacagaattaacctggaagaaggcaggactccgcctgggccaagcttgctgtgtagttttcggcctgttccctcctctctctgagctttgcccccactctcctaaaaaataaaagaggtgtgagctgggcacggtggctcacgcctgtaatcccagcactttgggaggccgaggcaggcggatcacctgaggtcaggagttcgagactagcctggccaacatggggaaaccctgtctctactaaaaatacaaaaattagctgggcatggtggcgggcgcctgtaatcccagctacttgggaggctgaggcagggagaatcgcttgaacctgggaggcggaggttgcagtgagccgagatggcgccattgcattccagcctgggtgacagaacgagactcagtctcaaaaaaaataataaaataaataaagaggtggggaggtgccggaaggggcgaaagggaagaaccctcagacctgtagtctctaagtcaaggtaatggctgtagggtcctgggtgacacggaacctttcacttcttgttcttaggttttcaagtccaggctgtagggcccctggtcacagaggacccgggtcacccgggactcatctttcacttattgttcttagtttttcaagtccagggccccatggatgccactgagatgatttcagatgttacagtcatcaagagggattggggccgcattctgcctcattccttggcttttgaaatcagagacgacattttcactttaaacaaacccaaaccattcctgctggtggaggatttctcctgcatctcgggggtggattttcactgatttatgtctgcagcgtgagcagtctctgggcttttctgcagctccagatgttagatgttttatctctccgtcttttatctgcttcagtccttgccccagactatcctcgcatgctccctcctctgggagggcttcctgtcttcacagccgcaccttcctcccactgctaccagtgccatggacccactgtatgtttcctgggggccatgcagaaggtccccagaccagtgctggcctgcgacaaataagtacagaaatggagaataacccttttcaaacacataatagcatttgatagaatcaatcaggagactcaagtttttactgcgtgcattgctttagacttggagggcgtgtgttggttgttagcaaggctgtgactgcatttgctgagatggtcaagtaatttggactatgggaatatcacccagcatgaagtcaatgattacaggcctttgtgtctgtggtctttctgttataactgatcttttttttttgaaacggagtctcgctcttgttgcccaggctggagtgcaatggtgtgatcttgactcactgcaacctccgactcctgagttcaagcgattatcctgcctcaacttcctgagtacctgagattacaggtgcatgccgctacacctggctaatttttgtatttttagtagagacagcatttcaccgtgttggccaggatggtcttgaactcctgacctcaggtgatccgcctgcctcggcctcccaaagtgctgggattacaggtgcccgccaccacgcctggcctataattgatcagatatcaattatacattttcaagtgtaattctagcttaaagaggataaagttaatacttagctgtttatataagatgttcaaatgggcattactgcctgatagtgacaagaagagagaatgttgggagtttcttttaagataagatgggtgtttggataaatgtctgacttggtctttttcccccttagataagatcattgaggttgaggaggaacaagaggacccatatctgaatgaccgctgccgaggtgagactcgggcgtctcccatcagttggtatttaaacaaaccccaaggggccagcaaggtggctcaggcctgtaatcctagtactttgggaagccaaggcaggaggattccttgagcccaggaggttgtggctgcagtgagctatgactgcacctttgcactctagcctgggcaacagagctggaccccgtctcaaaaacaaaaaaacaaacaaacaaaaagcaaaaccaaggaatctcggtgctgatctcactggaagttggaatccaggttttgctttggtttaccctgcaaagtaccctttggctgggagccagccatgagccacttccaccctgaggagtcgtggactcccagctcctccttccctttccccttccagatctagggctggctggggaggggaagggtgggcttaccaaggaggggccctggtgaggccctgctggggagggtggcccaggcccagggccagagctggtgtggaaagcctgcacgttaccgagcccccaggccttgtgaaggtgacagaggcctccctcaggctctcaggggagaggagggggctcagcgttccctgcctttgtgcccctggagccccagccacggttctgtcaccattggtgatattcatttgcctcacagggagatgtctgcacatttaactaagggcctcgcaggtttgtttttcatatgataaaactgcttttctttcatggaacattctggcatgtctagacctgcagatctgcctcacaagctctttcagtggttccccctgtggttagggtgttaattaggggccagtttaatccttaaatgatgcagtcagtgtacagtgacagttggtccaggggcgctgtccaggggcctggtggagggaggaagggagtgacctagagccccagcaagcctcagggctatgggaggagctttctgggaaggggagagctggtctgcaaggaggaggtgggattagctgggaaaataaccctgaaacggtcctcagggagacctgaagccttgtaaagggcacggacccactgtagcagggtactgggaggcagtgggctggggaaggaggtggggttacagggccagagagaggggccctagaaacaggcaggctggcagcagttagaagtgtatctcgtagaatctttccctggttgaggcttatcctgatgagatttgcactctgagcatcactctggccaccctgtaggaagaacaggttgtggggtgcttctgggctatgcagaaagaccaggtaggaggctgtggccacagccaggtgggcagctgcaggaactgaggccatggtagtgggcttggagcagtgggacagctcgagagttcagtgaggagcaggtacatgaggcctagttggggcctggccttccacgtggagcccacacccccatgtctgtgaccggcagtgagctcttctctgccttgccccttccaggtccaccccagcctacaaagggcaccctgcacaccacctgattttccagacggggaggttgggacctgaagccgcaggccctggggggtgtccagagccagagcctgggggtctcccagtagggcagcaggtgggctccagccaggtcagcctgccttcctgggttcatctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaacccagaccccattcaggggtggagagcagcccaggacgcgctttctcgtgttcgctggagtttgcagcgcagaggcccctgccgagacttccctccaagacaatataagcactggggttgggaaagaggatggagttggggtctaaccaggttccggatccaggatctgctgagtggccttgggcacatccttcagcctctcctggcccctgcgtctgtgagatgggggagatggagaagatgctgcccctccatggggttcttgaggaccacataactacagtctcagaaaaagcagtagatatgaacgttagcaggggagagaaatcactgctttcgactccgtgcagtccacagcccggatgtgcacatggtggacctgagctcagtttgcgagggtgcagggaagcacttccaccgtggctttggcacattccttcctaggatgtattaggatgggtcgttcttgctggtcacccccgcactgcctcggtctctcctagatgtcaatgaatgcatcacgggcagccacagctgccggcttggagaatcctgcatcaacacagtgggctctttccgctgccagcgggacagcagctgcgggactggctatgagctcacagaggacaatagctgcaaaggtacagcatgcgctccgagtctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttgcagagggtttcaagcctttcagaaggacaaatccacttgtgtaaaaatgtcactcactgtatcatgagagtgacttcaaagcatggcacaccccttctgacatctgagggccacagagcaaattctgtcctccccacccccgcacaccagctgggtggtttggacccctagagcccagtggctgagccagctgagtatacacatttgaccatttgacagccatgaacttcaagggaagggcagcccatcacatcccatcatgactgtaacccttgttaatatctggattattgtgaagacttcagaatggatatgtttatagagactgtgtttgttgccactaagataattgctttatgatctaaactaaacatacacttagcctgaatgaatactaatatatatatacctgccaggaaaatgccagggtgatttattataacagacagtttgcctcataagagccttgggaaaaaaagtcagctttttaagtctttagcaactggagcacgatttggctcagtgaagtcttttttgtgtatgatttctctattagaatgttttgggttatagtctgagtaatgcgcattagaaaaaagctttcttgtgattttaaagtgttgtaagatgcttctggcaggactcttgctaacaatttcctttttttatgatgtaccagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggtcagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaataggcagtaggctggatttggcccaaggaccacagtttgctgatctgggtttagattaaagagcttgggttttggagttagagtgacccaagaaaattacttctgagctttaattttttcctctataaaatgggagtaatcataatacctggcttagagacttgaggccaggattaggcgagtacttgcgaagtactggtacacaggaagcactcggtgagtggtgattccctgccacaggcatttagcctattaaaaaattattttaaaaaatacttggctgggcacagtgggtcacgcctgtaatcctagcactttgggaggccaaggcaggaggattgcttgagcccaggtttttgaggccagcctgggcaatatagcgagaccccatcactacaaaaaattagctgggtgtagtggcgcatgcctacagtcccagctacttgggaggctgaggtgggaggatcccttgagcagggaggtcgaggctgcagtgagctgtgatcgtgctactgcactccagtctgggcaacagagcaagaccctgtctcaaaaataaaataaaatataaaaataaaaaacagtctgtgttagtatttgaattcatagagacagaaagtagaatggaaggtgccggggctgggcagggtgggggatggggagtgagtgtttcctgggcgcagagtttcagtttgagaagatgaaaaagttctggagatggatgggggtgatggtggcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattagctgggcgtagtgatgggcgcctgtaatcccagctgcttaggaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcctgggttactggttctggaaagacaggaggtgagtcctgctttccccagccgttgtcaggttaactgcctggctaggccgctgcagtcagcgcttaagtcctgatccaccggctctccctcggcctctgcttggcagacgcccctgggtcctgcctttgaggtcagagagactttttaggagaagaggtgaggaatccgagctacagatcacactagtcagaacctccccacctggggtggccccatcacctctcccctgccatgagcaagggggtatacatttccatcttgcttcgatttcaacttttccttagcgaaatctgtattgatcatttatttgaaatagtggtttggagagagagctcttcccccactgcattatttttaaccactgagatatttaaagataagtggatgtggccgggcacagtgactcacgcctgtaattctggtactttgggaggccaaggcgggtggatcacttgaggtcaggagttcgagaccagcctgaccaatatggtgaaaccccgtctctactaaaaatacaaaaattagccgggtgtggtggtgggcaccttgtaatcccagctactcaagatgctgaggcaggagaatcgcttgaacccaggaggtggaggttgtagtgagccaagatcgtgccactgcactccagcctggacaacagagcaagactctgtgtcaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttcgctcagcgcagggggtggtgagcagggaagccatgggctctccgggaccagcggggaggatagtcctgctcagacttgcagcctgctcaaaggggggtccggaggaggctggcgtcgactgaggatggaaaccctgactcatggcaaaatcagccccgatttccacaaagaggcaatgtttgcaagtctcaacctagccctgactttcctctctacagggtgcagcactgtgtatgggctgaggctcgggagccgtccccttactgtccttccaggactggcaagcaggctgtgggctgaaggccagcctggcggcactgagctgttccgtgccatctccctgggtcctcagtgacagcatcgaaagccaaatgttcagctccctcagggtccccttagcttgggatgctgggatgaggatggggttccccttttcatgtgctctcaatccttgcaatcaagctcaggaatcattgttttaaaagatctctatttatttcaaaaattatgtatgtcttgacttataaatcagcaaacaaaacctaagtgtaggaagtaaacgctcctcccctggccaatcctgcccgcctcttggcagggtccatgagcccttctgggctctgctcccttgagactttttgtttttttatgaaaatgggatcagactgttctgccacttgcttttcccccccacttgacagggtatttagaaatcatttcatggcagcacctttatgttatctttttaaaaatgactgcatcagcagaaatacgtctttctaaggagaaaatacatcaagatagaaggtagtttcaggccgtctgggagagggctgaaaaggttctatgtcaggtcctggtcccccagcacgcaccctgggtcctctgctcccacacctctgcccatggtacccgctccctcacccaggaacagcatggtccgtggtgggaagcgttgatttccttgtgtagccagaatccatcttcctggagctcctagaaccatcctggggccccaagagcccatccgagcctcctgcctgtagcagaagagctcttcctgcagagctagtacaagggatgggtcagggtcccagaaagtggaggtctctgcccctatcatgcatggagaattttctagaaccttaaggttgggtcaccgagggctttgagaccagcatggctttgtcgggttttctttgctcttttcttcaaattccctcctcctgctgctgtattcctttctccttctcctcctcctcttccccctcccatcctccccctcccttctcctcttcccctccccctcccctcccacttccctcctccccctccttcccttccccttctctccctccccgcctccccctttccctccttcttttcttcttttttttttttttttgagacagtctcactgtcacccaggctggagtgcagtggtgcaatcttggctcactgcaacctccaccctgctgggttcaagcagttctcctgtctcagcctcccaagtagctgggattacaggtgcccacaaccatgcctggctaatttttgtattttcagtagagatggggttttgccgtgttggccaggttggtctcgagctcttgatctcaggtgatccacccctcggcttcccaaagtgctgggattgcaggcgtgagccaccacgcccagcctcttcctttcttcttgagtggggaggaaggaatgggccagggcttcccacgtgccctggctgaccttgcctggggatgtcggcaggtcctggggcaggaaggggttccactgaatctaggaagcactgggtgaagccaagtgaacggggaccttggtagcttgggcttttcccatgtgaatccctgagagggagagatcgggtgccctgttcccaaactcaccctatgctttacattgatttgctgtctgtttattcattcccattcattcattcattgatagccaggtcttacccctgtggagtgcacgatgttctgagggacactgttgttctgtggaacagagtttggggaatctagtctgagtgaggaacctgcagcgccagtgggaaggcagccaccgctctgctaaacgctgcatttattcgtgttacagggcaggggccacccagctgtttctctaaagggctagatggtaactaacaacttcagtctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctctggaccttggtttcctgtttataaagtgcaggcagtaatgatagtgatacctgcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaagggtcttccaccatcactccctctctttgttcccccataccagatgctttgtaagtgtctgagcaaggttctccaaggtgatgtttagatgcttaggtccttttccactccctctatcaggaagtgcaatctgtgtattcttcctccgaatttgagcagaaggagggtatccctgtgtagcatggccctcctggaccattcatgggttcacacttgctcattgtatgtcatcaaaggtaaatgccccacggtccccatgtcagagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctggaacaccctccaggtttaaccacatggtctctgtcttttcccgctgtagatatcaatgagtgtttgagtatcagtgccccgtgccctattgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcccacctgctcctacgttcctttggatccagggcacccagcctgcctagatcccgccagggaaggagccttcctcgcataacccccaggacacttcttcagtgtctccctgggttcctgggcacttcctaccttaatgagagtcattgctggcctgccagccaggtagggctgcctctgggtcagctatcttcccagtccagggcccggcactcagtaggtgctctgtgaagtcgtgttgaaatggaatgcctgtttccatgtccatgtgttcctttcttgctttcctttctgatcatcttggggggaaaaaacccaaactaaaggttttcatcatggctttctttctcctttgcaagatgtggacgagtgcgcgccacctgctgagccctgtgggaagggacatcgctgcgtgaactctcccggcagtttccgctgcgaatgcaagacgggttactattttgacggcatcagcaggatgtgtgtcggtgcgtggggggccccgcaggcctcgggggaacccagccacgtggcaccagggacacatttctgtggcacctcgagtgatgtggtctgatcctcatctcagataatcccaagtgcaggcagaccctgagagaagatcctgagtcaggagaccccattctagccccagctctgctgctgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtctagccagtgcctgctgtcaccaaacctaggtgctcagggaagcctggcagctgccaaccactcccccaaagtgggcactttgctagatcctggcagaccctccttgtgggtcctggggaggaggactggcaggagggcacaagttcagatgtgctgccgcagaaggagcacgaggctcgcccaccaggcaggcacagcgcggcagtcccggctctcccactgacttcccgcatgctcgggacaagtcactttgcattccttgtctgagaaatgaggctggaggccaggcgcgatggctcatgcctgtaatcccagcactttgggaggctaaggcaggtgaatcacttgaggtcaggagtttgagaccagcctggccaacatgacgaaacctcatctctacaaaaaatacaaaaattagccgggcgtggtggcacatgcctgtaatccctgttacttgggaggctgaggcaggagaatcacttgaactgggaggcggaggttgcagtgagctgagatcatgccactgcaatccagcctaggagacagagcgagactccatctcaaagatgaaggaaaaaaaagaaatgaggctggaggaggtggaggacaaaggacatgagctggccttactaggagggtggagtgtggtgccactgtgttggacattgccctgagtcagcccacccctcactttcagatgtcaacgagtgccagcgctaccccgggcgcctgtgtggccacaagtgcgagaacacgctgggctcctacctctgcagctgttccgtgggcttccggctctctgtggatggcaggtcatgtgaaggtgaggctggggccccgtccactcacctcccccaggtcaccttcctcctggggaagccacccttctgcagaccggtttgcagcagatccgcgatggtttccctgttaaatgacatgttagcaggggaagtgcctgtaaaatattgttcatcagagaggactgcccgcctgcccacccgatttctcctgatgacatccaccctccgaggccgtgtcggggttcataggctgcggcagaggccatgcgggatgtggctaggattatggggcttggagcatgacacccacgagtcacagggccttggttatgcccgacctctccctgcctccgtgtcctccccggggagaggggttgatgtgtgaaacagcagcgaaaactggacacttgttttgcacaaagacagtgtgtgggttttaatcagatgctgcctaggggagacaggcctctgtgtccattgatctcaagtcacccaaacaaaaggagggaggctttgtaaatgacgagctgtgagaggaagtactgaggcctttagggcgtgggtcactgtgcacctgcctctaacttctttttttttttttgagacggagtctcgctctgtcacccaggctggagtgcaatgctacgatctcggctcactgcaacctccgcctcccgggttcaagcgattcccctgcctcagcctcccgaatagctgggattacaggtgcacaccaccatgcccagctaatttttgtatttttagtagagatgaggtttcaccatgttggccaggctggtcttgaactcctgacctcagatgatccgcccacctcggcctcccaaagtgctggcattacaggcgtgagccaccgcgcccggcctgcctctaacttcgtgttggagttaggctttccccacccgcagagacagggagaagcaccctggccttccggatgacgacattccccaggcatgtccccagcccttgagaaagacactccttggttgcacatctcaaagggacagagaaaccgtttacatttgcaagtttttctaaagtagatgcttctaaggaacatggaggtcagcgcctgtagtcaggtttgggctggaaccaagagaaaattcttttggcagcattgatctttctcagacaggcatgtcaagggggctgggtctacatcctggatacctggtcttgggccaatggcagccacgctgaagttgggtcaggtctcttggtatgtgggggttggacagagttgttcctgccaacagtcttgtggttctcagataacaccaacctcctgggctgatgggaaggtcacatgaactgcatgtcagcccagggcctggcacatactaggtgcttggcagatgtcgtgtcttgtatacggattaggttctgagctgagcagacactgagagctttggatggccctccacaatcgtccacattgccgatgacaccctgtttggtgccgtgcactggctcacaggacagcttctgcagcctgactcaaacatggcaggtcctaacattttgccgtgagaattttccttcctgatgagatggtcgcaggggttggatatgccacagtgagctgtggtgtgcatgattctcaaatcggaggacggacggtgtgaggggtcctgggcttagttcacaagaacgtgtatggacaaggaacaagattcacgagttgagtctctcaggcttgtgttcaaacctgacttctgccatttccatggccttgaagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccagccttgctatgtgaccttactaaccatttgttaaggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagtgtggcagggcacagtggctcacacctgtaatcccagcactttgggaggctgaggcaggtggattacttgaggtcaggagttcgagaccagtatggccaacatcgtgaaaccctgtgtctactaaaaatacaaaaattagccgggcatggtggtgcacacctgtaatcccccagctactcaggaggctgaggcaggagaactgcttgaattcatgtccacatttagtggacaatagcctcccggaggtggagattgcagtgagctgagattgagctacttgtactccagcctgggcgacagacaaagactttgtctcaaaaaaaaaaagagtgaatgtggctgtattctttattttattgttattattattttgagacggagtctcgctctgtcgcccaggctggagtgcagtggtgtgatcttggctcactgcaacctctgcctccttgttcaagcaattctcctgcttcagcctcccgagaagttgtgactacaggtgcgtgccaccatgcctggctaattcttgtatttttagtagagatgggtttcatcatgctggccaggctggtctcgaacccctgacctcgtgatccgcccacctcggcctcccgaagtgctggaattacaggcatgagccaccatgccttgccgggctgtgttctaataaaactttatttataaaaacaagtgttgggacaaatttggcccatagactatgatttgctgacctctgctttaggtaaaggggacagttgagcagtagttcagagttgctgagtggcccagtgagttctgtgcattggagtatgaggagtactggcgtatgggctgggtggccgaggacttccttgtgtgccgtcatctgtttaggatgccatcttggaggtgaagtggagagcacaggatcagatttccatttgagaactagaatggactctggcagccaggtcggggcagacttccaggggccaaggctggaggctatcgctgccatcctggcaggagaagttgtggtcgaagcaggcaggagcagggatggagggtccggagccaccagcgatgacgcctctccctcggccacaccccccgggacctctgtctctccgagtgtgttaacctgagggaggtggagaggagattttctgttcactgaccctgagggctactgtggaggcagggacgtatgatgctctgagcggtgaccctcgttttgtatttcagacatcaatgagtgcagcagcagcccctgtagccaggagtgtgccaacgtctacggctcctaccagtgttactgccggcgaggctaccagctcagcgatgtggatggagtcacctgtgaaggtgcggacgcccctgcctgctgagggggaaagcaccccctggtcttgccatgacacagcagcacggcctctgactttcaaaatccacagggaagagcctgctgggatttcttcacctggcaaaccttccatgtccacccttggaggcaagcgggtggtttgctgttttccctccaactgaggtttttttttttttttttttttttttttgagacacggtcttgctctgttgcccaggctggagtgatatggtgcaatcactgctcactgcagcctcagcttcccaggctcaagtgatcctcccacctcagcctcccaagtagttgggaccataggtgtataccaccatgcctggctaattttttatttttaaaaaattagagacggggccttgctgtgttgcccaggctggtctcgaactccgtggctcaagtgatcctcttgcttcagcctcccaaattgctgggattacaggcatgagccaccgtgcctggcccccaactgaaattctaatatacttttcccatccttaagcgtgagggtgggaaggcagcaaaccactcctgacttgttctttaataaatgtgcacggcggtaattacaacatgcactgggaccttgggccgcatatctcaggtcttggtggtggtgcatggctgagaggtaaggagggggctcagggaccacctatatccctgactcagagctctaactcttcatctgtaacatgatgattaacttcagcctcaccagatcattggaggattaaactagatgacagcaattacaggcaattaagggcaattacgatgattaccattttcatgtaaggtgtgtgtgtattttgtttgcttgtttgtttttgagacagagacagctctgtcacccaggttggagggcagtggtacaaacacggctcactgcagcctccatctcctgggatctagcaattctcccacctctgcctccttgagtagctgggcccacaggcatgcaccagtatgcctgactaacttttttgattttttgtagacacagggtctcactttgttgccgaggctggtctcgaactcctgggctcaagtaaccctcctgcctcagcctcccatgcctgggattccaggcatgagccagtgcacccagctgaggtgtgtttcttattattgaactgtggtccatatttccccctgcccgccacatgcatacttcacaccatgaacttgctgtgtgaccctaggctagtcccatcgcctctctgagcacgatggtctctgaggcttcctgtgttcagcttgtcctgtgctgctgccctcccgggccccagtgcagcccccagggcgatgtagcatggccagcagccatggccaggtgccaggacactgaggctgaggtgggctttgccgttgcagacatcgacgagtgcgccctgcccaccgggggccacatctgctcctaccgctgcatcaacatccctggaagcttccagtgcagctgcccctcgtctggctacaggctggcccccaatggccgcaactgccaaggtgagcaggagggatgccctggggtccctcacgctctgcttggggccctgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgcccgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagccagttcctcgggagccccacacaggactgtggatcctggggctctggaagccccctgggtcccacagatgtagcttctggtcatgaggaaggtgactttgatgaaaggcaggcaggagctgcggtgtttcctgggaggccccctccgcttgccctgggctctggatggaaggctggttgtgtctgcatttctgacggagcaaatgacttttctcctggccaggctccctcaccacagcctggggtcccgcccagactcagcataaacacattcctgagccgggcctttgaggctggggagtgttgtttttgccaccgatgctcaggcatttggcacctcttaatggatgtctcccagggttggtgacagcccctgagccccactgtttggctgctccagagtctatgggagttgggctgctcccccatctccaggggcctctcagtgtggtgccccaggccccatcccaggagtcccagacctggtggttccagtccaccctgaacagccaccaaccccaacacacaggcaagacgtatgatccctcgaaggctgtttttctcattgttgtgtggagctagcagctcctgcccttttctcctaagaggttgagtcacacctagggtaagggtgctgagcctcgggagccacagagaggctctggttagttagtgtatggactctgatgccagcctgcccgggttcaaagctcagctctgacatttataaaatgtgtgacctcaggcaggtctcttaagctctgtgagctcctcataaaatgaggatcataacagtatctgcctcattgagttcttaggaggattcagtgacttatccttgcgaggtactcccaggacccatcatgtagtgtttacttttaccatcgtcacgctccctccagggattgcgaatgataagttaacactctataaatgtaaataccctataaatgtaagaactggcacaggacgctgctctgaagatcagccagtggagggcagggatggcctgatcgccacccctaaccctagttgatgggaggcctgggctcctccgtctccagatgggtatggctcctgcagcctctgccttcactgtgctgctgtggggtctcttgcagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcgtctgtctgtgttggccttcctggtgacccagttcccgggtgggtgggttatcaggctgtgacctcggtgtcctcccatgagggactcagggcactcaaagatcacctgatccctggccctcaagcccctaaatgctagtgacactggtctcggaaagtcaagggggtaactgcaaatgagtctggggtctatagtcatgttttcaggccaaggctgtgcacagaaccaggagaaaccacagccctcttttttcctagggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttgcttcaggaaaagctccatgctgggaccgatctcaggactgtggacttgtgacctctcccagcactctgagtgcacgatgcaggcagccagctgtttccgaggccttggccccttgaccttcagcctgccttgggctcttggccagctgcccccgcgacctgagggtcagtggtagtgtccacctcttgaccctaggggcagctgccctggcttgtggcatagcaaggcttctgggtacccgagcagccccgttgtccctggcagccctccatattcttcctggctttgcgattctcattggctggcccagccatttccctgtttcccagcacggatttctgtctgcttgaaaacccaacatcttgtttccttcctgagcttgggttaggaaaaagctgccccaaaactgggtttgcaagtctgtagcatcccgaagagctcatggttatgcaacagcctgccccaggcagtgacactgcttctctgagccattaagaaagttcgatggccttggctgcaggctgtgcagccgtctgtcattgtaagttcactctctccccagcctttgtcagcgcctgggcttgaggattccaggaggctggctgtggttgtgacctcgatttctaacttgcgcacagtcgtgaaaccacctttcgaagagggggaggctgccctgcacaggggccctggcgcctcctaagcctgagggtgggcgggttggccatgtgtgctgaggtcatggctgaaatcaggggaacccagctccacccctcatgttggctgtggaagcctctgccacccctcagtgctggagaaagtcgtttcttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgacccaggaagctgggccgcaaaccacagggctcggccttgtggacaggaccaggctgttacagtcctgcccacacaattcccttctgcccgcaggaggaagtgtgcaaagctgtcccacagcctttcatggggccggacacatcctctttatcccctcagtggggccggcgcctgatgacctgtggtctagaaagctggagcaaagccgggtggccttggttgccgcttcccggggatgggacacgagtgaacagctgtgggcctgagggtgtaacacggtggacggtggcagagatagagccgtcgatggcccccctgccttggccagttcctggggcttgtctcccggacgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctgtgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttttggggtgctctgaggaatgactgtgtggggtcggagggggagcctccaggggaggagtgaccagtcgctgtgtgtgatgacggcgggagctgcaccagaacaccacgcacacctcccattgctttcctccgcttccctctggcaaaacaaattccatccctggttagtacccgccatgctgagagaagcgggaagccgaaatcccaccagggcgactctagcgccacctgctgaccagccccatccaggctggtcctgaagttgctggtgtgtgtgcgtgtgcgcgtgcttgtgtgtgtgcatacattgtgtgtgtaaaagctttgaagtaagacaggccgactttgaaagccaagcttgccccttacgacacaccacggagctatcagcaagttctgcatcctcaatgggcgtctgtcttccagccagtagagcgggaggacgatgggagacagtggagggagcgagtggaaggaaagtctgctgcttgcagcctgctccctgcacccggaagcgcagttcacctgcacccggaagcacagctcatgggtcccatgctcctcccccagttcacggacgctttggtcatagctcctcagaggcccccctgggggagagctctcagatcgcctggagcactcccgtttggcctggacctgggcatctctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttaggacccgtccccgtctccaccacaggaagttaggacccgtccccgtctccaccgcaggaggttaggacccgtccccgtctccaccgcaggaggttaggacccgtccccgtctccaccgcaggaggttgggacccgtccccgtctccaccccaggaggttgggacccgtccgtgtctccaccgcaggaggttgggacccgtctctgtctccaccacaagaagtttggacctgtattagggttctctagagggacagaactaatggaatatacatatatatatatatataaaatggaatatatatatatatatataaaatggaatatatatatggaatatatatataaagtggagtttattaaggattaactcacatgatcacaaggccccacaataggccatctccaggctgaggaacaaggagagcagtctgagtcccaaaaatgaagaaaaaatgagtccaatgtttgagggcaggaagcatccagcacgggagaaagatgtaggctgggaggctaggccagtctctcttttcacgtttttctgcctgcttatgctgtagccgtgctggcagctgattagttggtgcccacccagattaaggatggatctgcctttcccagcccactgactcaaatgtgaatcttttttggcaacaccctcacagacacacccaggatcaatactttgtatccttcaatccaatcaagttgacactcagtattaaccatcacaagtccaccccttgtcaacttgaacccatgcacatctcctgagatcatacataatcttcaaataaagacaataataagatcataattacacctaacataactatacttcatacgaccagaaactcaccaatccccaacccaaatactattatataaagttaacgatacttaaatgctgatgtgaattcaataaatcttatgtcacttgataaaagagaaaggaaataaaatgaagtcatttttgttagtacaagtgtatacatgcacaaacatttttgattgttttttgtttgtgtgttttttaagacagagtctccctctgttgccgaggctgaagtgtggtggtgtgattttgtctcaccgcaacctccacgtcccgagttcaagtgattatcctgcctcagcctcctgagtagctgagattacaggtgtgcaccaccatacccagctaatttttctattttaagtagagatggggtttcaccatgtgggtcaggctggtcttgagctcctgacctcaagtgatcctcccgcctcggcctcccaaaatgctgggattacagtcgtgagccacagcacctggccatgtttttaaaagaaggaggaaatactcacgacaattacagtcctcgtttctgcaactggtcacatggctcgtagctggtattgatgactgccttcttctactacccattctgtattccctttgccttcagcaagcaccttggcagatcttgttttttttttttcctggtggagtgacccaaaccttcattcctgaagggtctgggtcatttgtagtcctgcctggattgggctgttgtagtttcccattgaccttaatcacagggcatggtaatactgagagatgccctaatggatctcctgtattccatgcatactctaacttatcttcattttggagtagtagactgatttcatcttgatagtctgggtcagccaccccagccaacactgtaactcccttcttagcctgttgacttaaaggtaggaggagcttcaagtgtccaggtggcaatcttaatttccagtttaatggaatccttgttctgtctcctggtggcggcgttcctccctctggaactaagacctctaggccagcagaacgtaatgttgcaggaacaggaagcaaaaattttgctagtggatcactaggggtgatggtgagtggtgccacttccatttccacccttggatgcctggacccgtgaatcctggctatgggagaaacagtgccataatattggaccctgattcagagcatacatggccttctgtagaactttgtcccagccctgcaaagtactgtcacctagttggcattgtaattgtgacttcaaaaggccattccactatcctatcaatctacctgcttcacgacgatggggaacatggtaaaaccagtgaattccatgagcatgagcccactgccacacctctttagccgtaaagtgagtgctttggtcagaggcaatgctgtgtggaataccatgagggtggataaggcattctgtgaacccacggatggtagtcttggcagaagcatcgtgtgcaggataggcaaacccatatccagagtaagtgtctattccggtgaggacaaacctctgccatttccatgatggaagaggtccagtataatcaacctgccaccaggtagctggctgatcaccccgaggcatggtgccacatcgagggctcagtgttggtctctgctactggcgaattgggtactcagcagtggccatatccaggtcagccttggtgagtggaagtccatgttgctgagcccatgtgtaacctccatccctgccaccatggccactttgttcatgggtccattgggcaatgacaggggtggctggggaaagaggccgagtggtgtccacagaatgaatcatcctatccacttgattattaaaatcctcctctgctgagctcttttatgtgatatggtgagcactctcatgtgatacaaatatcttcacagtttttgaccactcagagaggtctatccacatacctcttccccaaatttcattgtcatcaattttccaatcatgcttcttccaagtccctgaccatccagccaaaccattggccacagcccatgaatcagtatgtaatcgcacatctggtcatttctccttccatgcaaagtgcacaaccaggtgcattgcttgaagttctgcccactgggaagatttccctttgccactgtccttcagggatgtcctagaaaggggcagtagtgctgcagctgtccactttcgggtggtgcctgcatatcgtgcagaatgatctgtgaaccaggccctagtcttctcttcctctgtcagatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcacttactggatccaatcagcataatgtcaccaatttaatggaccagcgtgatatcttgcagaagcgaaatgcgatcaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaaccacatctggtacagcagctgcaaattggagtcaccacttggttaaacttacgataatccgctgccgttcaccaagatccatctgtcttctgcacaggccaaatgggagagttgaaccgggatgtggtgggaatcaccaccccgcgtctcaagtttttgatggtgacactaatctccgcaatccctccgggaatacgatattgtttttgatttactgtttttctaggtagaggcagctctcatggcttccatttggcctttccaaccataaaagccctcaccctaccagtcagggagccagtgtgggggttctgccagctgctaagtatgtctctgccaattctgcattctggcactgggaaaatgaccacaggatgagtccggggacccactggacccactgtaagtcagacctgagctaaaactccattaattacctgacctccttaagcccctatttaactggagggccacaatgacgttttgggtcccctggaatcaacctcagctcagaatcagtgtccaatagtccccaaaatgtctgatcatttccctttccccaatgcagttactctggtaaaaggccagaggtctctttggggaaggatgggagaaagattcactgcataaattgtcagtaatgtagtggggtccttcctcaagaggacccgcctccccttcattcaaggggttctgggtctgtaaactggttcaagtctggaaattgattgaggggccgtgattctctttttttgtaattcaaattagtcttttgtccacttgatctagaagttttcggcttatacaaatcaagtaggaatgcagtaggcttcctatcaatttcacttctaggaacactgtgattaattagccaatgccagagctctacacgagacagactattctgattgctgctttgcctctgctgtccattacagaagctacacccaccttgcctttgatggttgagtgctgtcacttggccactgccacctcaggatccaattatttccattgtatttaaattttgtagttgagtgactgtggttcccactgttagatctgacataccaagacgagcaattacagggctcttcaaagatgcaggtgctgccctcacaaatctgtttcgaaagacattggtcaagggtatatcttctgaatcctcccaacttggttgagtaggtctaaagtgactaatccactccaccatcccaatctccctaagtctttggattccttcctctacattaaaccaaggaagaccaagcatttccagcttgctcacagtgggccatctcttcatccgtatttcagctaaaccagcaaataaactattagaaccttttttaactccccgagttgcaacattaaatgcagagtccctgcttagtgggcctaaatctgtaaattcagcctaatccaacgctatgttccttccaccattctccgacacccttaatatccattctcatgcccgttctccagattagtttctataaattagaaaactcaagcagttcttttcgagtgtagctcacttcctcatgggtcacactctcaacctcatctctaggggcccgccaggactttagtctagttataggtctagaggcaaacaggggtgttaggggtggctcctgaggagaatcaacattatcttgcctggcaactgcctcacaggaggccatcactgttgcctcaggcagcgtggggtttatctccttagacaaaggtggaaaggctgatgggtcggggcggggatgttgccactactggggatggggaagctgttaagctgtttcttctggcaaaaaagattcatcagagtttataaactcagtgtccccagcttcatcaggctcctcccacatgtccccattccaagttgcagggtcccattctttttcaatcaatgccctcactttaacagcagacacctggcgaggctgtgcatgcatctttcattgcaggtcagccactcgcatgataagagcttgtgtctgtttttccacaatttcagctcttcctctacaggagataagactctcactcagggcaatcttagcagatttgaggctcagtatctgcttctgaagctgggagatggaatccctgagttcataattttctttcatcactttgtccactaaacttaggagcaaccaaccagcttcattatgttccttggttctccacatatgatcaaagatattatgtatagagtcactaaacttgcctcatgagcgatgaatcaggagtttcaaatgcgtttatttttcataactctctaaacagttcatgccaaggactatcagtgttctccatactattagaagtggagtccttagcatttttggatctaatcgttaaccagccaaccccagaaaccccaaaaccaatgaaagaactccatctttaatattctcttcctctagaaccactcctggtaccaaaatctgtagtagttagggttctctagagggacagaactaacggaatacatatgtataatggagagtttattaagcattaactcacacgatcacaaggtcccacaataggccatctgaaggctgaggagcaaggagagccagtccgagtcccaaaactgaagaacttggagtccgatgttcaagggcaggaagcatccagcacaggagaaagatgtaggctgggaggctaggccagtctctcctatcacatttttctgcctgcttatagtctagccgtgctggcagctgattagattgtgcccacccagattaagggtgggtctgcctttcccagcccactgactcaaatgtgactctcttttggcaacaccctcacagacacacccaggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaaggccacattctctctgagcctcagtgtcctcatgtgaaaaatatcaccgaagccactgtcatggggtggtggcagtgatcacactagagagtgcatggtgaggaagagctgagcacttggtaaacggcagcagctctgattgctagtggcagagatagtcatttcatgggtcacctccgagacacaaccaagagccctgcgtagccctggccactgtctgggcaagggcctgggaagggcagggtgtgcctggggagtgcccctggggtggggctctgccagtgagcaggggacgcacctcactccgggcacagcctttggcccccggccacccagcgcccgagatggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaaccctcttcttgtctctctgcccacttttcttgcagccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcgttttacagatgtggaaactgaggcccagagagaaggggaagggttggccagggtcgtctggcctgctgtggccatgccaggtcaaggaagcgggtctgctggcccctgcctggttctttgctgtatccccggaggtgagcatttcactgagacaagaaagctctctcctgagattcaagcctcctcttctgtttgtcttgatcagaagcccaaatctgtggtgcagaaacacgggatgcggttgcggctcctaggatgcagctcttgcctcagtgaagtcgttttgcccccactgaggatcctggccctgtgccggggcgaggcaaaggaccacacaatacatgtgatactcaggggatccttcataggccttacaccagtcctgccaggcaggtggtcatcctcatgaagactcagagagggcaagtgatttgcccaagatcacacagctggtatccgagccctggtttactgactccacagatctggctgttgcgttctgccagaatacctccactgagggccttaaccccctgcctccctccatctcctccaccatggtccagccaagccagtcatctgtccccctctgctgctcccagcgtccattcacctcccctacagctcattctttgcttagcagctggagtgatcttttagcctctgcctaaaaccgttcctggcttccttaccatttgggttaaggcctccagatcctcaagatgtctgaaggccgtgcctaatttagtccttgcatgcaatttccagcctggcctcaacttgttctatccttgcccacttcccttgagccacgctgcaagctctgctgcctccggcccttggtacgtgctttgcacccttggcctgaatgttgcttaaactccagctcatgtgcctgcctcagagaggccttccctgccacccctggcttctgttttctctgtccgtccttctcatgacccctttccttcatggtgcttgtaacaggctgcggttcctgttgactcgcgtttcacatttgtcttccgcaccttccagaaggctctgtgaaggcagggaccaggtctatctcattcagtgcggtgttcccagctccttgcaagacatctcgcgtgcagaaggtgctctgtcaatgtctgttcagggaacagatgactctgccagccctggcttatgtcactagcatttctgtggctgtgacactgtgctgacactgtttccaggcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgtacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatggatggatggacagaccaatggatggatggatggatggatggatggatagcatttttaaggcttagttcaaatatcgtctcctcagccaggtgtggtggctcacgcctgtaatcccagcactttgggaggccgaagcaggcagatcagctgaggtcgggagtttgagaccagcctggccaacatggagaaaccccgtctctaccaaaaatacaaaaattagctgggtatggtggcaggcacctgtaatcccagctactcaggaggctgaggcaggagagtcgcttgagcccaggaggcagagattgcagtgagctgagatcggagtatggcacaccagcctgggcaagaagagtgagactctgtctcaaaaaaataagtaaaaattgtctcctctgtttagccagcaagccacagcaggggttcttgtcctattcaggcatccatttgtcaggggcgggattactcaggctggaaggaacacctgtgccttcatgtgcatagcaatgtgaagaggtgggggaaacctctcaggggctttggaggctacccagtgaccttccacagcttgccagaagctcctctgcaacattcccaccaagggactcttctttgcttgtggaactccctgcctcctgaggggtcccgttgcattttgggatcccatcgacgtttgcgtgtgtgcctgagtgcactgtgggagtgacagctgagtgacctgagtgctcacccctgtcccgcagctccttggggctccttagccatgttctcggctcatgctgctgacagaggacaccatgcaggaaaagcaaaataagagcaggaggttgaatttccttcttgccatttactagttctgtgaccctggatacatcgtcagcctttcagagcctcaaggcccaccttatggttgattttgaagatggcctgaaatagtccagcaggcagcgcctgatacagagtaaacactccataggtgtgagtgtgggtttcttcattcattggaaggtaactgggtgttcgtgtggcttttcattgaaatggggatgaagattcagagagtttggagggatccaaggtcatatgtggagctgacatcacttttgattcagaacctgtgctttcctggttgtgtcactagtaaatcaagctcccaaggagaaaagacagcaataagggtgatttttattgtaatgataataataacaactccaacagctaacacatagagtgctgaccatgagacaggcgctgttccaagcatgtaattcgtttactcttcacagcagcctagggaagcaagcagtgctaatatccccattccacagtgaggacagggaggcacagaaaggtgaaggaacttgcccaaagttccacagctggtttccagtggcactgggattcagacgcaggcagcctgggctgggatctgtgctctgatcccctgtcctccactgcagcaaatacgggggagaggcagcatccctgggatgaatgagactgttgctccagccccatctcacagagcccgctctgccattcccaaactcaaaacaggatatcttattagctaaaggaggaggcagtgtggtaaggaggaaagggctatgaggctggaatgaaataagatatgcaaaatgggccaggtgcggtggctcatgcctgtaatcccagcactttgggaggccaaggcaggcagaccactgaaggtcgggagttcaagaccagcctggccaacatgatgaaaccccgtctttaccaaaaatacaacaattagctggtcgtggtggtacacacctgtaatctcagctgctcaggaggctgaggcaggagaactgcttgaacctggaatacagagattccagtgagccaagattgtgccaccacactccagcctgggcgatagagtgagactttgtctcagaaaaaagatatgcaaaacgtgtagcgtagagactggaaaggcagatgcattatttctgaagctctctagatcccaaccaaaaaacacccagacaactagataggaaaaaaaatgtttccatggaaaacatttacaaacgaaacaaggtatggttgtctgcagttcaggcccacctgcatgactttggcatctgtgcaggaaaaaacagtggcagaaccccaaaataatcaacaggtatccccagaaagtgtactaggtgctttgggggaacagcagctgaaactgggaggcgttttgctcactccaggggccagagtgtgcacagagccagtgggagggaggaaggggctggcgcaggcttgctcttgggagcttttgaaacttagccaccacagctctccctaaggtcagagtctcacacgagggagagactgctggaaatggaacagaaattgtgtagaaaagagaccatagagactgtgggaagagaaggtccgggtaaatgtggaagaatgtcaggaggtgagctctgcaaagtcaggaagataactgtgaatgatactctttctcaaattccaggaaaactagtttcctttaaggatgatcaacccaaaagcatcaaggtcaaattccatggatgagtttctataacaaagtaccatagactgggtggcttaaaataatagaaatgtattacttcatggttctggaggccagaagtccaaaatcaaggtgtcagcagggctgcacttcctctgaaacctctaggggaatgcctcttctgtaggggagtgctctttctgtaggggagtgctccttctgtaggggagtgctccttctgtaggggagtgctccttctgtaggggaatgcctcttctgtaggggagtgctccttctgtaggggaatgcctcttctgtaggggaatgctccttctgtagggcatgctccttctgtaggggaatgctcctgtaggggaatgctccttctgtaggggagtgctccttctgtaggggaatgcctcttctgtaggggagtgctccttctgtaggggagtgctccttctgtaggggaatgcctcttctgtaggggagtgctccttctgtaggggaatgctccttctgtagggcatgctccttctgtaggggaatgcctcttctgtaggggaatgctccttctgtaggggagtgctccttctgtaggggagtgctccttctgtagggcatgctccttctgtaggggagtgctccttctgtaggggagtgctccttctgtaggggagtgctccttctgtaggggaatgcctcttctgtaggggaatgctccttctgtagggcatgctccttctgtaggagaatgctcctgtaggggacttctgtaggggaatgcctcttctgtaagggaatgctcctcctgtaagggaatgcctcttctgtgggagaatgctccttctgtaggagcatgacttgtctcagcccctggtggtttgttggtgatcattggtgttccttggctcgcagctacatcgctgcaatctctgcctttgtcatcacatgatcttgtgtgtctttgtcgtcacatagccctcttcttataaggataacggtcatcttggatcagggcccaccctactccagtgtgacctcatcttaactgattacatctgcaatgaccgtagtttccagtgacgtcacattctgaggtactggggatggaactttgacatctttcttggaaggatgtaatgcaaaccatgacacccatagaaagtgttaggggctgaattgtgtccccccccaaattcatatgttgaattcctaatccctaatacctctaaagtccctatctccaaatgcagtcacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcatgtgcctgtaatctcagcgacttgggaggctgaggcaggagaatcgcttgaacccaggaggcggaggttgcagtgagccgagatcatgccactgtactccagcctgggtgacagggcaagactctgtctcaaaaaagaagaagaagaagaagaagaagaagaagaagaagaagagattaggaaacagacatgcacagagggaagaccatgtgaggaggacacagggagaagtcagacttctacaagccaaagagagaggcctcagaaagaaccaaacctgccaacaccttgatcttggactttcagccttcagaaccatgagacaatccatttctcttggttaggccacccagtctgttgtatagcaaacaaatgcacagctattataagcaaaaaagagaataagagacagaatgatatccctctgggtaatgaaagcacaccagaaagacgtgcccagactaaatgaaaattctaatattctatcttgaaagaaaccaaaagtgttaagaaaataaacaaaacatagaagaaaaatggggccgggtgccctgtaatcccagcattttgggaggctgaggcaggtggatcacctgaggtcaggagttcgagaccaccctggccaacatggtgaaaccccatctctactaaaaatacaaaaattagccaggcatggtggcaggtgcctgtaatcccagctactcaggaggctgaggcaggagaatcacttgaaccagggaggcaaaggttgcagtgagccaagattgtgccattgccctctggcctgggtgacagagcgagactctgtctcaaaaaaaaaaaaaaaaaaaagaaaagaaaagaaaagaaaaaaaaagaaaaagaaaaaaagaaagaaagaaaggaaaatagaaaaatcgagtcagaattagaagaaaactgagaaatgaagtaatagaccaaagaaacaaaaagttaaaaatttcagatgtaaatactaaactagatggaacacaaaagtgaataaacagataaatagaagttgaaaagaacaacaagttttaaaaatcaagaaagaaataacaagagatgaaaggcttgaagaaaaagtgacaaatattcaaaatctgtaagaagatctgacatttagataataggactccctgcagaagaagccgaatacatgggggaaagtactatacatgatctcaagaaaactttccataaattaaaaaagagatttgaaattccacattgaaataacacatagcgtacctgagaatatcaacaagaacaaccaacaccaagacacataacacattcttgtgaaattattgtactttaaagaaaaggaggaaggccgggtgtggtggctcatacctgtaatcacagcactttaggggccaaggtggcagatcacaaggtcaggatttcaagaccagcttgaccaacatggtgaaaccccgtatctactaaaaatataaaaaattagcatggtggtgcacgtctgtaatctcagctgctcaggaggctgaggcaggagaatcgcttaaacttgggaggcggaggttgcagggagccgagatcatgccactgcattccagcctgggaaacaagagtctcaaaaaaaaaaaaaaaaaaaaaaaaagaaagaaagaaaaggagggaaaaacaaactatgaacatttaaacaaaaacagtaagtgatttataaaggaaaaaaaatgttctcatcagactctttgacagcaacactttatgctaaaagaaaataaataacatattaaggactctcaagaaaagttaagcccagaattttatacctagcaaaactgactttcatgtgcaaaaagcataaactattatgaccatgcaagcattaaacattcagttacttctaaaactacaactaaatgagtgttataaggaaaagagtatagtatgaattactggataggtcagacaatgtagacatagcacatttatttttaaactctgagccgaatagggagagcatatcaaaaattattttcaataattatgttagtcatggtaactttagaattgttatcctgaggctactgtgtaggtaatgtgggataatgatgggatactgcatgtccttgaggaccaggattctgatgtggaagaaagaatgtgcctttgtaatacagaagagattaattaaaaaaccatatggtccttcttttgaattggatatcagtatgaactcttggtgtatattagtttttaaatgttcactgaagaggcctagaaacaatgaccaaccccctagcactgagcctccctagtatccagactggtcttgataagccatttctcactaaaaaacaaaaacaggccaggcgcggtggctcacacctataatcccagcactatgggaggccaaggcaggcagatcacaatgtcaggagttcgagactagcctgaccaacatgatgaaaccccatctctactaaaaatacaaaaattagctggtcgtggtggtgcccgcctgtaatcccagctactcaggaggctgaggcaggagaatcacttgaacccgggaggtggaggttgcagtgagccgatatcgcaccacagcactccagcctgggtgacagagcgagactcatctcaaaaaatatataaaaataaaaataaatgaaaaacaaaaacagaaatacaaatccaagacttcttggagaaatggttgattccaggtcttgggcagtaaaagtgtaaaatgaggctggatcatctcgtcacatcagatagcaagaaagctgtgaaagacgacaagggctgggccaaaaggacccaggagccaacttcattttccctctggcaagagatgggaaaatttgagtttcaacaaaggataaaaattgcagaggatcaaacctcatcggagtggcttccatcatgggttcatactgatttttttttccccaaaaatcctttggagaatgatagcacactagttagcttattatcctgaaaattagaaaattcaaggaaacaaccaagtattgatctgctatttcctggtaattaaatcacaagagcacatgaagggaagcatctgtttacaggagtagtccagctaataaatggaagtgaagtggtagaaccagactatcggcattttgcaatccttgatgaatcagtgggcgtaggccttgagcatcagtagatgctgtcctcacagagacagccagtcactgtgtggctctcactgaagacacactaccacctaccatcttgccaaagggaccgggcctgcatgggatcaggcctctggatctggctgccaatgtccaagaaatccagtggacagaggaccatgctgaactgcaccgtgaggatgcaatcagcaaagtccagcctgtaggaaacacaacagctcaaattcttcaggttctttaatagataagttgtatggaaaataaaggaggccgggcacgttggctcacgcctgtaatcccaacactttgggaggccaaggtgggtgggtcacctgaggtcaggagttcaagaccagcccgaccaacatggtgaagccccatctctactaaatacaaaaaattagccaggcatgatggtgcatgcctgtaatcccagctacttgggaggctgaggcaggagaattgcttgaacccaggaggcggaggttgcagtgagctgagattgcgccattgtactccagcctgggtgacgagcaaaactccgtctcaaataaataaataaataaataaatagaaaagaaaataaaggaacagagaagaaacctgtagcttaaaatggacttaaaaggcagagcaaaaacttgttgatggacaagtctgaatgattgtgtctagagacgcacactgatgtgagaaaactatgaagaaacccaagtaggccgggctcggtggctcaggcctgtaatcccagcactttgggaggctgaggtgggcggatcacaaggtcagaagttcaagaccagcctgaccaacatggtaaaaccctgtctctactaaaaaaaaatacaaaaaaaattagccgggcatggtggcatgcgcctgtaatcccagctactcaggaggctgaggcaggagaatcgcttgaacctgggaggcggaggttgcagtgagctgagactgtgccactgtactccagtctgggtgacagagcgagactctgtctcaaaaaaaaaaaaaaaaaaaaacccaagtagagcactgccgtgggactcaggctaggggtcactgttgggttgcaggaggggttgagttctgtctggcagttgcggggcgtttggtggctggccaagttctctttcttgacctgggtggtgattataaaggcatttgccttgtaataactcgttaaactatactttcattttgtgtaattttgtatccgtgttttattttatgatcaagaggttgtaaaaatctgtctagcacagtacctggaacccagacctctgagagactgtagcctcttctgcctccccgtcacctggtgatgtggaattgactgccctgtgctgggcaccgagcttggcgctttctatctgctccttcgtttattaccctgctgcccagcctcactgtgggctctgagaaggcgggaccatgtgtcccttgttcactttgctgtccctagcagccggcgcctggcactcaaaacatatttgttgggcaagtgaacctgtgactctattttgccattgtagctattgatgctcaattcgtgcagttgacaaatgtccaagctgtgcttatccgccagggcacatggaagctggagggtgttgctggcatttaggtcccggtccagtttgcaggaagggccatgaagcctccccacagagcagccaggctgcagagaccactgtcgttctctgatggagctgtctctgggacagatgcccctgccctggccacctgctcctcctccctagacctcggcccctgtgggagctgctgtcccagcttccccgtcagcctcgtgtgctgtggttcccctcaggctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaaggtgagtgggatgggtgtgggggtcccagggccccctagggcctccctcggcttcagctgagggcttggcctacaggagttgttccttgtaagatgtggcccaggctttgaaatgcagaactttcttttttttttttttttttttttgagacggagtctcgctctgtcgcccgggctggagtgcagtggtgccatctcggctcactgcaagctccacctcccgggttcacgccattctcctgcctcagccttccgagtagctgggactacaggcgcccgccaccacgcctggctaatctttttgtatttttagtaaagacggggtttcaccgtgttcgccaggatggtctcaatctcctgacctcatgatccacccgcctcagcctcccaaagtgctgggattacaggcgtgagccaccgcgcctggcaacttgacatgcagaactttctttgtgtctgtgtcccccccacacccacctggcacagcagcatttggcccattctcagctttccgttcaggtggtcttttcttatgggtaacggttgttctgcagagagccattaagcgctgattctgtgaccagcactggagaatcagggagggcctccgggaggaagtgatggccaggctgggtcctgagtggtgaggtatttgagtgaaagggggagaaggggaggagggtgcccagtggagcaggacatggccagaagggtctggaggtatgggggggcggtgtgggcgtttgagaaactgagccgaggttttctgctggagcgctagaggcttggcaagaggtgggctggaaggataaacaggaggctaaaactggagttgggccttcaacccccaggctttgggggaaccatcggaaggttgcagtggaggaggtttgcatatagaaacatcatcctgttgatccagggccaggtgaactggaggggccagacggggagcaggaagctcaggtgtaacccagtcagtgctcccacaccccagcctggctctctaggaagctcctggcatgcagtgtagtcatgttgtgtaacctgccatcactgcaccgtttctctggagcagggcctgggctgcgtgctcccaagcctggcagagggctatggatggagcattgtcctgttcacctcgcttcctggctgtgctgcccgtgtgcccggtccccaaccacccccgccctctagggagtccctatccctggcctgcggagaagcatgccatgatgagttcattcagcagccgtggacggagcccctctgtgtcaggctctagggacatggtgataagaaggggtcctcccaccctctcaggggaggcatgcaacggagccagccgcgaggacaccagtgtttacaccatgacacaaccatgcgggggggtggggggaggagaggctccctcagcacgtggttgcccaaggagccgtccccagtcccagtccccctaggtttgctcctcccgaaaaggaataacgctgaatcgtcacagggtggcacagacttgggtcagagaaaataactaactggtatttgccttttgcaaaatgatggggtttcaccaaaccacatacaaatccttcccaaatccccagtggctggttttgtggcctctccggccagccccgatctgagtgttggttatcgcagggagccgagtgccgttgggacacctgttagcatcttgggcccaggaaatccacaccctgaccttaagtgctgaaaggacctttagtgggtctccgccggcttccttcctcaccttacaggtgaggaaactgaggcccacagagaggactcccccaagacagcccagagctggggctgccctgcttcactgtctgatctgggagatggacacacaccccccagagaacccaggccaccgctcagggtggcccccctgacctgtggcactatagatgggagaggagcccacccctctggcctttctgctgtctccctctgtcccctcactcgctttcctcctctggtccccaccttcatgaatatgcacagtgactgatgacttctcaccagcccttcctctgattagctctgtgtccccaaggaagatccaaaatctctcctgacttcagtttcccctgctataaaacagggatgggctatgatataggaaggtccagacccctccaccctccccacacaggggatctctggcttcattgatgttgtctcatgaaagggccctgggttaggtcttcattccccaagggtgagttcctggggacgaggctgggactggggctggggccaggctgtgctgagcccttctccattctgtgcctctgcagagatcatcttcctccgggccatcacgccaccgcatcctgccagccaggctaacatcatcttcgacatcacggaagggaacctgcgggactcttttgacatcatcaagcgttacatggacggcatgaccgtgggtgagtggctgggaatatcagctctatccaggcacccctccccctccaccccgaaaccctctctggcccagcccaactcccatctgagtcccctccccaaattcaagcccacccaaccttcagggcccagcgccgaggccaccacagctcccaatcggtctcggccggaggaacagccagagtgggggatcctgcctgggatctgaccctagctgtgccacccactctctgggtgacccctctgggtctcggtctccctgcctataacatgggtgggttccagagagcgctgcgcctcacaaccatgaatttcaaatgataccacccaagtaaagtgcttgtcctgagggctggcacagtcccgcggtcggtgggagctaaggggattgttattcttggggtgcaatgggagggatagcaaagtaggaatcagagggcctgagctctggtctctcagccttggaactagctggattcgccatgtggccttgagcagtagtcgtcccctccctacgcatcagttggtaagaggaccaaggccactctgtgtgcacagcccatctgaatggggagctcactgctctttctccctggagatccggtgtttggggagcgtgaagggaggctggggcatgaggggactgtggaagtcctgttggtgggtgcaggctggggaagatgtttacaggcgggggcagggccctccctggctaggaacgggctttaatgacaacctactcgtgtgaaaaaatatccaggcccactccattccgcacgcttgtttctgtcattcacagcccctctcctgaactgtcacattttaaaagatttacagtcatgggaaatgaaaacggtggcatctgccattttggactcggatttatactctgaacactttcaaagcagctgagcaacggacggacagtccctgacctcccctgggcctcagtttccccattgtgaactgggaggagtgggcttcctagtcccttaggcgctggagtccgggaggtcctaaccagaacccacgagcgtgcagtgcgcacagagcagagcgttttggagcctggcctccaggtggcgctgttggaccttggacgctcagtctttgcgcctcaaacccgacggttgttaaaactggcagctggagaaagggaatcgttattcccgtcttgccaaagagccatttatagcacctttacaagcttttaaatgggtttgcatgttgtaaacatgactgagtcactggggggctccccaccccagcctcctcctgcgctagctggcagcaggaataattagttaattacaattaatggtgcattagccctcgcgtgattccaaggggaaggcgcatggtttggttgtcggcagttgtgaaacttgctgcttgcccttgagtcactccccactctgggcctcagtttcccccattgtgaaatgagagtttagatgaagacagccttgagggtccttcaggcccctgtgcaggagggcaggcagggagggggttgggtcagggctttgtcctgtcccactgggtgggtggggtatgcaccctgacactggcccacagccgccccccgccccaaaggggccagccctgtgcttgatgctgggcctgcagttgtggctgggacatggccctcaggtgatttctagatcttggaacatgggagtttggaatcctaggaccttctagttcactcactcattctttccgtttctgaacccttcttgagcctctacctgtgcctgaccctgggctaagccttgcagatacagagatggataaatgccacatagcccctgaggactttgcatctcagcagcagggagaagccaccccgtatcagatcatcaaaatatgatgccgaaataggcatgcacagagacaggccttgatggcctgtggaggctctcttaggggaagtctcctggcaggttttacgtctttagttcccacctacatccttcctggggtgacccaagccaagaggttgggcagctgctgggcctagaaccagcacccaccagcgcctttctctggctgcatctgctccagacagaaccaacctgggagtgtctgtttctcagcttcccatccactggggcagaaaatcctggcatgtcagagcctggaggctcctagagaccatcccttccttcttccgtaggaggggaaactgaggcccggaagggcgagggggcttgccagtcttcttacagtgaatcagggacacagtgggcaatggaaaggagtcccagggtatgagagatgatcacaggtgccgtcccggcagcgggcttctgggaacggaatgtggatgaggccacaaggacccagcggcttcccccggcacagttggtcacgggtgccctggtctttggaattctgggctggggctgcgtgggggagggccccagcctggcccttggaattgtcgtgcctgtagccctgtgtgctggggaggcccctgcctcttccacgcctcggtctgtgtgcaggatgccccacctggctgggctcctggagttgacctggtgcccatgtcatctcaggtggaagactgagaccagggaggcaagccctgcgtgttgggacctaggctgcattgctggctggctcctgtctctgtccccactgcgctgatcttatttctctgtctgagatctcctccttgggcttccatatccctacttccttctccctcctcttctgcccagaataacttccatacatcctgggagcttcctggtccctaggggcagccatcccggcacacggctcctggcctgtccacctggtaatagatggttccaccgttggactcgagcccagcctgaagcagccctgaaaacgtggggttgaacccttgccggctccttaccgttgctgggcaccttcacccccgcattccccagtcctcacagacactgccagcgacgggtcatgattgtctcccttgggcaaaggagggagctgagttaaatgaccgcctgagactgtgcaactgaaaaactgcagggcctgggatgttttccgacttgtttttagcagtgcagttctgatttcaagcagtgacttaggcagaaacccttcatggtggtggagaggaagaaagcggcttccagggctgctgctcctggtggggagcgtgggaggctcttgagcctcctgggcagccccgtgcagctctgtgctgcctgcagcacacggcagggaacgccgcctactcacggtgcttgctgaacacctgtctgctctaggccatgccctgtgtggacactgggcaccggatcaggagggcttcctggaggaggtgaggcccgagctgagtgtccttgcatgtgagggagtgacacttagtgagcacctgtgatgaccaggagccagggtttcatcatcgccaggaccctgtgacacggtgggattatctcctctaacaaaggagagagcgagagccagagagggcaagagatttgcccgaggccactcagagctggggccagagcgggcctggagcccggtcttccccagacaccacacccgcccagagccggagcccagggttgactgctgctgtggtgggctaagttgctgtgagtttggatgtcccagaaaaacaatcagcgcacaggccccggggctcgccgtgttcagtcctcccagagtaacagaagaagagggagaaatgccccgagtccactaagaacctgcaagggccgggtcgtcctctaatgtagccttgaaagacccgttcttagcggggatcgaggagcccgcagcagggcccgcgccgtcgtctttgtaaagcccccttgcattcctctttaaccggctgtcaaagaaaaatgaagaatgcgttttcgccctgtgcaaaaatgctccattaatgcccgagggattctcaggccactacaaagctttccttatctggctctggattcattctcagctctgcagcctgtaatccggggtgctctgggaagagatctttcaggtagtatatcctgagtgatgactaatgggggagccctggctgcagcaggggcgggctgtgtatcatcagcgtgcggaagagagagacagaaaggcaactcgaggccacccgggctccccgggcccctgggctatggctgctgtctgagcctcagacttcccctccagcctccagatcaccacttccttttaactctcaggccagccacatctgtgtctgtctggctccctccactcagcctcaagacccagcatgtgtgtgaccacttccaagaagcctcccctgactgctccagggtcatggctgtgtgataggagggcctggcctgcaaaaacgccctccctatttctccagggagggaaatctgtgtgctatgaggcttggttgtggccacatttctgttaaaaccctgccaatgccaacaggagctacagagcctgcaggtgaagtaattctttggcctacggacgaattttgcatgtggacctcctgacccttgggcctcccgggttgcagggagctacggagttgtctttgtagttttttgcaggccagcccctcctgtcgcacgggcatgaccatggggcagtcaggggaggcttcctggaagaggtcacacacattctgggtcttgaggctgaggggtgagccagacaagtgggacacccaaactcacagccacgtctgtggctggcccatgaacagcgcgatgagaggcagggagccaggaagggagggcacagcctgcggtttggggctgctggagcatccagggtgcagggagggtcgaggggaggccgaaaggggctgcagggccaggccttggtggatgctgtcctggggaccacgggagccacgggaggtctgtgctgcccatggagcttccagatcccgctgctttatttaacccactgggcctcctgcagcttgaggttgcggttgaggttgtacccactcagcaggtaagaagactgaggccggaagagccaagtccccaggatctcccagccaggaagtgttcgaggatagggcttagacctgaactgcccagatccgggactccccatccccatggcctatgttaagccctgattattttttctggtctatactagctggtatctacactggctggcatctgtcagccgtggttgagtctgagtcccagccgtagaggataaatagtgaagcacctcctttcacacagtcacagtgctcccggccatgggatcttgggtcctgggccagcccctgatgaggaaagacctccctgtatgtccaggcagtcaaaagatgaagttcagatgtcaccatgctgcggaatggcgaggtcctggagggtctctctccggctctttacctgccgagggcccactcatccttggtcacacaggcgacccatcatgctgctccctgggacccccagacctgcctcctttccaggacccctcccagcctcaatgattccccagtgacagccacagccgcacctggtgcagatagatgctggggctggctgcaatttagggaggatctttctaggctggggcaggagcttcacggctgggaatgggctttaatgacaacctacgcatcttagaagacattcagacccactccactctgcacagttgtttctgggcaagccctctgatatgatttagtgcacgtgtggctgggtgtggagtgtgtgcgtgtgtgtgggtgcgtgtgagtggtgagtgcgtatgcacagggtttgatctctgagatgttttatactctctggcttggagaagggacagtcctgtagtatcaagaccagaccttgtgtccccagcccaaggctgccctgggcctagggacagtatttggagacttcgctggcagttttgcgttggaatcacctggtgcctccctgtacgtccacccaccctgtgcccagatccccttcgcaagcaccatatgctgttagatcctcgagcagccttgtgggacagccaccctggggctggtatcaccatttatgtaagaaaaaaaaggaagtgctggcccagggtcccacagccagcaagttggagctgcactgcccaagcaggtcctttagtcagctctctgttgtcccccaagcccctcagccccccaggcagctctaagggctcagctgctgcaggattccttagagaagctgaagggtttgggtcctcagctcctggccggggcaagtctggccaagcagcatggcagcgatgaagtccacatgatcgaagggtggatgcttaccttagacagctgctcaccttagacatggtcacctatattacatttaggaaggaaacgccctaattggagactctgcatctcattaatggaatcagatgaaacgatgtatgtgaaagctcccagcagtgcctggcacacagtgggtgcacaggatgtaaatactgatggaaacctaaatgttctgtaaatatcagttcttcctaatttcgccttgccgtctctcttgagagtggctataccttctaggcctgatcaggaaggaagctgggttttggtgtgccagtcaggtgagacgcagagaagacagcacaatcaacacaggaagtaacagaagcagctagttactcacaggtcctagagaggtggggagcaccccttgcagggccaatgggaaggggaagcgcctgcagcatgagagagagagagaatgagagagagagacagagagagacctgtgggaccaaagcctttactggggtccagggtgttatccaggcaggtttcccgtgaggaattctaactggggggcttggagcaggcaggagttccctgaggtcatgcggtggcggatgggggtcacttctgcataggcctgcactatcgatgtaggtgtgagggtctttgggttgtatccagctgtcccataaggcaggggcccccaggaggtggtggtataaggcagtcctctgggtcaaccgccttaaggaactgggaggaggtggagaactggaacccgcagcaagggtgactgagccctgctctggtgtgggagttaaacgcacattcagaatgcgtgccgaggcaacataggatgagaagccggcacaacacccaggcttttccatgaaagtgaacttgacagccgctttcccacattgtctgtgctgagtcgtgggagcctctgagttttgccagtgtgtcaacgcgctcctgcagcactctcacccccacttaaagggaactaccacagtttatgttttgaaatcgcattttaaattccatctgtgggtgtataaggattattacccaatttcaagtttaccgtttgaaaaatagcaatggcgtgagtggccccttttaggcaaagtgtgattgggtctgtgtggccgcggcaaactgctctgggcttgcggctttgttctctgtttccagctgtgtgactttaggcaaatttcataacctgtctgagcctcagctttcttctcagtaaaattgccataataatatttgccctgcagggtaatagggactgaggtgtgtgcctgttttaacataagagtggtctagtctggaggataaatgagccgctgggaggaagaagtttggaaatggagggctggtgggagcccggagccttcttaggggacaacaggccagatcaaggatgatgggacagggccaggaccgtccagcccaaagtggctccaactgcccaggacctacttaataggcagatctcgcggcctgggctggtgaggccggcctggccggaagcaagtcagcaagcaggcctctcaagtcctatcatccttgaattatcttattcattcaacaagaacatcctggggtacttttctatgccaggccctgcactgggtactgcagaacaaatctacatccaagctacgcatcctgcttttaagaagctccccaccagcatccatagcatcctgccagagttcccacagctgaaagtgcttgtggtttaggggttggtgtcatcccagttcatgtctgagagagagagagaagtggcgtgtggcagggctgctatgtacagttggatgtgttgtgcactgcaaaatctaggcagcaccatccaccggtgagtctatttgcagtacacaacctgctcaactgtatgcagcagccccggtacaagggcttgtgaatggagatatctacctagctgtacctctccccctggccaggcaaggcctcagtcaaggcttgagaccgtccattgtcccagccagcagggcccagatcacctcgttaaaattattacctcttaaggggttaaatgtgcgccgctgaccgcgtcctgcagcccatgtggagagtttggcccgggatcagtacacattacaaatgagattcagaaattccacctaaaaacaacagcgcggccgtccctgcccaacgatgagtgattgccctgtcctggctttcacggcaaatcccagggatgacgcgctttctcttttctgggagacacagccctgtcaccccgggggccacaccctggctggcagccaagttctttcccagggtgctgggcccggcctcctctgggctgggatcagctgcggcctgactccatcttgagctgggggtgtcaccgagggttccaggaggtggagggcatggggacgagggtgtctcagagactgggagatggaaggagaacacacaccttttctgctccctatgtcgtgaccccatggggcagagatgggctctgaggcatcagagcctgtgccctgtgtgacggcgcgtagccccccgaaacagctgctgttatccctccttgaggttatcagcccccaattccccagataccaaaactctcagaagtcacccccgtcacaaagctggtgaccctccctgcagcagctcctgggctcaggccagacccctcagaaggcttggtagcattaatggggtacagtctctgcttttgagcctacttcagtgagacacacagggggccccagggaccagtcccggaaacctccctgctcagtgggtggcccctggacagcctgggctggacctgcagtaacgtggacagcattcattcggagctcaaggcctcagccccaggagacgccctgtccatgtgagtgccgcactgcacacccgagattggttttccagcccaggacctggctaggaagggtcggcggggtacagcccgctcagcaccccctgccgtggccgcctctgcaggaggagacagcatggtggggagaggggactgtcttgccctgctgaacccccaggggtcggctacacccctctctacaggcctttttggtgtagcgcaggtgagacaatgcagccagagaggttgggagattacacagctccacatctgcggtgtcaccgtggacgggaccgtcatggtcccagcgggagggtggaaggaagccaaacttgagacgtctgccttgcacaaaggcagtggtgctcgtcaaggtttgggctggaagacttagcacctggcgggcatctgaaaatttccatctcccgtgcctgcttggtccccacggacacatgcctgagccatcagggactgcaaatcacaggggtgggaagacagggacgcacactgagcaggtgaaaggtggtggggggtaagcaggtgtttcggaaggagtagaggagggcccggaatggggccacgtaggaaagggtcacatccattcaccctggagtcagcccgagggcccaggcagggtggggtcctagtgatgcctgtcggtgggtgacatcaggccatccacagcaccgggagccagcagaaagggctgggccaggccatgtggacagggtctacggacagtacagggccagaggtccctattctgggaccttgacatgctgccgttctcgtgagcttctgggggactcctgcgaggcatgtgggctgcttctcagacctgcgggtaccccacctcccagatgttgtcaatgggatgtgaggttcacgagcacgtcacggagcctctcccctcgtcatgtacgtgcgcatcatggcaaaatgtgcctggccactggttcctgacgctggaaggcacgaacccactccccacacccacagccggcgttgctgtgactgcagtgtctgtgttctaagccccacttttcacatccatccccgctgcccggccagagagacgtcctcagcccagagccccacttttcacatccatccccgctgcccggccagagacacgtcctcagcccagagccccacttttcacatccatccccgctgcccggccagagacacgtcctcagcccagagccccacttttcacatccatccccgctgcccggccagagagacatcctcagcccagagcttcctatctccctcgcctgctcctaccctccagaataaaatgtgtacgaggtagggaatctgtgcttgtctgccagttgtggtcactgctgtatctcttagagtggggcttacccctgggggcccagcgctcagggatgcgtgggctccaggctggagagaagcacccagatctaccaactggccttccggctctgcagagccgcttgcatcttactccttcctcttccctccgctctgcttcagccactccagcccatgcctcagaccccaaatattccatggcctctctcctctcctggactgtagccgtgacattcacttccttctccttttggtgaactcctattcatccctccaagccgatgtcagctgtcacctcctcttggatgccgtccacacgctccacatgcagagtgtgcagctccttcttttgtgctccagtggccccagatgagccccttttgcaactctcctcatactcattctcccaacgagtaatgtgtgtatccctgggggcaggtcctgctctgaggaatgcagcagtgactaaggcagacatgaacgcctctctcatacactttttatcccagagggtaggagtacacgagaaacaagcataatatatacacggtcagatggtagtgagggctgtgcagagcaggggaggggagtgggaggcggggtgcagcatggcggtacagctttaaatctggtggtcagtgacatttgtcaaagactcaggagctgaggaagtgacccacacagagatctggaggaagagggctccaggcagagggaatggcagagtgctggagtggccatgcctggggaactccttctggaaagtctgtcgtgaaccagagcagataaatgcttgtgctggggggaggggtgtcgtgaaaagggaaacaccaggagttgtggcattgggagtttcttcgcttgactttcaattccaccaaacaattcctagacagaagagcctccaggggtttattcgtgcaaggctaccctctgtcaccctgtttgtccttgcttcttatacacacacagaacagatgcacccactggggtcaccccaacccagcccccagcagttgcccataactggccgcaggatcccacacacctgctgacttccagagtcaccaaggggttaaaaggggctgggaacagcctcttagtctccagagcctcccgcaggaatgatttgtgaccctcttaggctgctggtctgcaccttctgaaaagcctttaatatcaccgggcacattcataaattattcttttttaaaaatgaaatgttttagccaaacagcagtagaggcatgttgtgcaaaattagcaaaaaaaaaaaaaaaggaatgacgatgatatgaatcttttggcggcctctcctaaccgtctttaaatctgcgaaaggatctcagtgcccgccattacctggccagcaccgggaggatgtcaggtgcttccaggcggactctgctaggaacattccatctgtggccaaggctatcacagtcctcaaattaacagcaaaccccgcgtggcccttgtggtgtgccaggcactcttctgggcatatatatgtattttttatatataaaaatattttttatatatataaaaaatatataaaaatatttttatatatataaaaaatatgtaaaaatatattttttatatataacttgctcctcatagcaaccctgtagatcattattcccattttccagatgaggaaactgaggcacacaggagcttccaggctcaggtgacatgaattaagaatgcacacatcatgctgggactctgtggggttcctgctgtcatgactttccccagcgaccttggggagggcagagttctactctttgaggcttgacccggtcctgaaatctcagttgtcacttctgcatcctgacaacatggagcacggtccatagcgtaggtgtatcgtaaatgttcagtccatggcagcgcagacagtcatctgcagattcgcgagcctctgggatgatggcctggaaaagggacattgaggacgtggccttgctccagcctgggggggctctgtgccatggccctgcagcagggggcccctttctgccctgaattggctcattcatggcgcctctcaggagtaaaggagaagaaagtgatggttctccaccaacttcacctgtcccctcctgctgaactccagcagcggctcccatggctccaggagagagaaggggcatgactggcctgccctctcatcagcctctcccctagccctccctcctttactctcatctgctcaggaaaactgagagcaccaagctgcctcatgtctccaccctccccgcagagcaccctccccgcagagcaccctcccatcgcccttttcttgttgggcacctcgttcttcaaagtcagttcaaggttaacccgttggggaagcttccatgacaccagttcccggtttggggtgtgtatttctccgaagctctcccaaaggagatttgcttacctttatcagcctctgctgccccaatcccctgtgcctgctctcccagtggctgagagccccatgaagagccagaccagggccaggtgatgttggtaaccccagcacccagcactgcagccacccacagcaagtgctctgtgcttgtcagatagagaagagagggctctgctctgacctgcaggcctggggctcaggaccccctctctgcactcaagggctgcccgccaggccagcctctcttcccccccatccctccagaccttcattgcatctgtagaaagaggcagagtagccttcactccggaaggcagagggcaggacttggcccctctggtgtgcccacgtctttgagtgaagttggcaagacttgaactcgtcctgcccttcgtggccccctcaccttgggggattgcaaggggttcagtgtggctggggcagtgtgctgagagctgggctggacggggccgtgggcctcagcaagatgcgtctcacctgctgtgagcccgggtgggggtagggtgagaagagccccctgcagagccacagtgggcccccacggttggatttacctcctggctctgagcacagtgggaagaggcatgggaggggtgaaaaggaaggtggtacacgtgttcaggtagatgcgacgaggccggaactgaggccaggtggggttgtggggagagaagggaggagagtctggagacctttaggaatagaatccattggcctcagtgatggtttaacctgagggatgggagtaaggggcctatcgagggcgactccaagttcctggcttgggggtacctgcctggagagtgaggggtaggggaggaagggaagtgggtttaagggaggagggtaggtcagtgtttggcgtgcttggatttgaattgtccatctgggaggggcgtctggagaaattggagtggactccgagtttgggtcgggggcccaggaggaccccacccagcaggtaggtgggtggaggctgaggtcggctcaggagacacacggagggaggggacatgatttcttatccctctagtctcagtcacaagttcacttctcctaaaaggaggtgcctcagacagcagatccttccagaactctcccagaccttgtcttcctttggcaaggccacagagcttggtggaaggggcagtggcccagggtctgggctccagttctggtttactgcttgctggccgtgtgattgtcagcaactcacgtaaccacacagagccaaattttctccccggtgagcccccactgcctgcgtttgcgatgagaggagagacagtcgatgtgagtgagctctgtgatgacgaagcactgcagaaatgttagttcccacgccacaggtgaaggctgaagggctttagtccaaagctgacatttcccttcatatttttccccaaggggaaaggtgcaccctgaaacgaagagctgtctctttcgttcagctaccttcagctgtcccctccaaactgtctgatttagctcacgggagacctgcggaaggagcacatttataaccatcaagaaatacggatgatgagttttgctgagacatgttgactgacacttagtattttaaatatgcagcccagacacctgtcccccttgcttcccggcttttatggcgtttctcagccaagcagagaagaccaggtttcgggagctcagtcccttcaactgcaccaccagcttctgatgcgattctctctaattgctttctgctgtttttgccgtgtgtttatgactcagctaagggcagtacagtcgggaagtgtcctgcgcgccattttgcagacaggagggaggaagtgtcctgcgcgccattttgcagacaggaggaaggaagtgtcctgcacgccattttgcagacaggagggaggaagtgtcctgcgcgccattttgcagacaggagggaggaagtgtcctgcgcgccattttgcagacaggagggaggaagtgtcctgcgcgccattttgcagacaggagggaggaagtgtcctgcgcgccattttgcagacaggaggaaggagatgtagtgggatgggaagatctgggctctgaggtcagtccccgctggacggaaacctgcggccctgttagctccgtgatctggaaggtgctactagtagcgcctcatttttctccccaggagaaggagggcgaccgtgtctcatccctaactgcgatgggggctgaatgcggctgtgggcacatagggtctctctgtctccacccatgtctcctgctgtgtggcctctttccagcccatccacactctagttggtggctttgtgagtgctgacaatacttccatgtgcttttttgttttttcttttttgagacagagtctcgctcagtcacccaggctggagtgtggtggcgtgatctcggctcactgcaacctctgcctcccatgttcaggtgattctccctgcctcagcctcccgagtagctgggattataggcgcctgccaccatgcccagctaatttttgtatttttagtagagacagggtttcgacatgttggccaggctggtctcgaactcctgacctcagatgatccacccaccttggcctcccaaagtgctgggatgacaggcgtgagtcaccacgcccggccgcacatattctcaacgtttcctctttgccattggtctgtgctgctcgtcctcgcctgcaggaactgtggagcctcttggggtgaatttactgaggcctggtgatggtttgcttcttcccagttgcctgcggtgcttgtgatgggcaagcctgcttgggtctcctctgagctcctggcctctctgtttcagcaccttgtccacacagccctacacttcccttcctttctgctcatggctggccccacatggtggccacagttaatttccactggtatgagatattgtgcagtctcttgattcatcatctggtttgctaaaatgctctttgacagccctgcacactccattacacgttgtcagctagaatcacaagcctcacgttggaggctgcactttagaagggaagatgacgtgcccaaggtcacacagctggtcgatgcagagccacctaggaactcgaggctgtaactctaggtctctttataaaccagtgtctagagtcagagacatgagactcaggcagagagaccccccccaccccccgccactgactttcatcatttgaaacaatggagagacaatcaagtgcaacatcaaatagcaggagctgaaagatggcttcgagatggggccgagaatgtggaccacagagcccaagaggcagcgaaggtctccccactgcacccgagcacttcgtgttcaggatcctggatccccagcacatcagctgcaacttacagagcagagccaagacatgaaagtgaagcgcccgaggggacctacatttttcaacagggagaaaaaaagtgcttaattatatctttaagaggcacagacacgccaagggataccagcagcgtctgagacctgaagcagaaatgccagggatgaggatttggaagattaacacaattgaactcagcactgtggccttttttttctttctggggcttcggaaaggtaggaggcaaacaccctggcaggtaagacagacaagccaggtgtgatggaaatgcacctctttgtcctgccttttactgctggggtggtccttccaaatgaaactgctctcacccggagccttcagtggctcccctttccttcaggacaaagtgttgtcttcgttcctagattgtgaggcttcagggactgattttccttcttccttctctccttccttcactctcttttcttcttcttctgccttcatcttacgacgtgttcatggcagaaggcctgccatgggcctgccagggcctgggttggggatggtggggcagaaatgagctgacactgtccctgaacaaggaggccgactgtgagcgtcccctgcaatgagcaggtgcagtgttgcagtggaaagagaccaggtgccaggtgacatagggggtccagggaagacttctgtgaagacttctatgaagcattccagctggtcccagtgtctggcacatgagacatggcaaatcagagtctgtaggatcaagtggatggatggaaccaggcccctggtggcagctctcatgtttgcgatgctgcatgtgggcagcgagtgttccttgctacttcttcctccttcccttgcctccctgtgttagagaagttggtggtggttctgaaagaacagtggtgtagaattcgtgatggggaggcagccaggaaatgacccagcttcttggttctctgagactgacgaagtgaggtcctggggcagtccccaccagatgaggcacgtggctcagcctcatctgcctgcctctccccaagattgacaccgttcccagaaccggcctgaaacttcatatttttgggctttgcacttgtccttcctgcttccttggctcatatttattcctcaaaacccaatttaaagcttcctgtttaaagctcctctgtgcagagtagcctctaatggatgggtgggtggattcatgggtgggtagcatctaatggatgggtgggtggatccatgggtgggtgtgtgggtggatggacagatgggttgattggtgggtgaatggatggatggttggatccatgggtaggtgagtggatggattggtggatagatggatggatggatggatggatggatggatggatagatggatgggtgagtggatagatggatggatggatgagcagatggttgggttgatgggtgggtgaatggatggatggttggatccatgggtaggtgagttgatggattgctgagtgggtgggtggatggatggatggacggatggatggatagatggattggtgagtggatggttgggttgatggatggttatgaagctatgaagaaaagtggtatcagaatcttgattctgcaggcatttatttggcatctattatgtgccaggaactgaggaccagctgaactgttaaggtcctctttcatgaagtcctccctagccactggcctgggttcagtcgaggtgagggcaaggaggtggaagtcatgcttgaactagcctggagatggaggaaacctgttccccaaaccagagcccaggaaaatgtggctaggctggaggagtgtgggcaggtccgctgacagggcatggcctgggaaagggggtcctgggttgagtggggttgtgcacagactgggagatgcagtgtggacttcaggtcagaggggagggatagagaagcggatttggaaggtcaggaaggggtgcacattccttgagcgcctgctgtgtgcagccgtacagtctgttgttcgaccctcgcagcatccctacttgttctaccttaataacttttcttgttaaatgcaaagaacctgagaaaatccaggccccgaatctgaccatcagtgattcagcctagcgcctcccttccccttcacagcacccttttccctagtgtggtccttcctttctagttgctcgtctcaccacgcagctgtttacaatcagcttggagctctggtcttcagccattgtagagaccaaacctcgtgaagtactctggtgcaatgtatttagggacaatcattttctatatgttcagggctttcctctctcataaatcagtccaagagaaatacttaacacctgctgtatgtttctaagaattcagccacgctttggctgggagtcagatcactttaaatattagaatgctttttgatagccagtggtcatttctcagtggaaagaaaaaggatgacatcgagtttgatttgtttctgattttgaaggttgctggggttttttttgttttatttttggttttgttttttgagacagagtcttgctctgtcgcccaggctggagtgcaatggcgcgatctcagctcactacaacctccgcctcctggattcaagtgattctcctgcctcagcctcctgagtagctgggactgcaggcgtgtcccaccacgctcggctaattttttgtatttttagtagagacggggtttcaccgtgttagccaggatggtcttgatctcctgaccttgtgatccgcccgcctcggcctcccaaagtgccgggatcacaggcgtgagccactacgcccggccaaaggttgctgtttttaatccctgttcatagaagaggaaattgagactcaggaaggtcaaataatccatctgggggtcctaccacggagccaggtcagtttgtatcctgcaggtctcaaagggcctacttagaacgtctgtggcaggtccctgtcccacatggagctcactgcatgagcactttcttctttctttctctgtccccagactgacccctgaggacagaccttcagtttctctacattcttatttagccagtgccaggcacacgtagcatgcgcagaccctctgtgcattggaactgttgataatattaatggtcccacatgcaccaggagtgtgtatttaaatatagacatttaagataaatatataaatatatcaacataagaatatgataattatatatacatatatcaacataagaatatgattactatatacatatatcaacataataatataattatatacatatatcaacataatataattatgtacatatagcaacataatatgataattatatatttatcatgtttatattttatatataaattttagagtaaatgtaaacattttatatgaacaaatatggatatttatatataattatatttacatataaatacacttatgtgtaaatataattatataataattatataaatttatatgtaaatttataaaatacactttaaactatttaaaatacagttatataaatttgacatactttataacatatatttttaatatattgttttatatgtataatagttatatatcatatatgaaactatataatatacagaaatataataataacagaaatagatctctttttttttgggacaggatcttgctctgtcacccaggctagaatgcagtggcacaatcttggctcattgcaaccttgaccttcccgggctcaaacaattctgccacctcagcctcctgagtagctgggactataagcacacaccaccatgcctggctaatttttgtattttttgtagagacagggttttgccacgttgcccacgctggtctcgaactcatgggcttgtgatctgcccgcctaagcctcccaaagtgctgggattacaagcgtgagccactgcacccagctgaaacaaagacatatctgactgttgcttgtggaggtgcctgccattcctccctacagtgattcacaggctcacccagcctctccttctccttcaagccccaaacctctgaatgccaggaagggtggtaagaagtgtctctgcgcctagtaccagtaaagttggcaggtcactgtggctagcgggggcaccattgttggcctcgggcctggggagagaaaaatatgacatacagggggcccacgggggtacgttaggttcagccctgtaagcccacactgaccctggtgggcagacccagcccagggaggggcaggcaggagtgaccccgtcatcaggttctgctggcgagcccagggtggtgacaggcgcacgtcttttgccgggagctgaagacgttcatgggctttcaagcaggacaaagcttcaatgtcatcaccaggtagcaggcagagcaagggtgctgacagcctgcagaagcctgtgcttatctctccatcggagctaaagcccatgtttgcttagggaacagcctgaaattccaccccagctgctgggcctttcacttttgaaacataagcccagagagcgaaaggggggaacgttgtgcccagattctctttctgagcgtgaacttgatgttcctgaccaggaaccagccactcgtaccgaaggccttcctgacccctcagttctcccctgagcctttgctgtgtcctgggcaccaagaggtggagataggctgtcaccgtgcacgtttcctaagcctgcagaggaactgttcacagaatccagcctggaatcagccgtttgtggcaaacagtcagtagctatttctcaacgtgtggttgtgaagctgcaggctccatattcgctcttcacagagcatccaagcaggtgtctcagtgccagctcacaccgttcacactgctcacaccagctctggagagctgcttgtacacatctctccacaagtccactttcagtgttgccacgtggtaccggaaatttgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccacctccattctcgcccccgctggacaatgcacaccctccatcagagcgtggtgcatacctttcatcctagatctcccaccagctttgaaaccagcatcctgttcatgatgtctggaaccctgggaactgtcccagcacctgtttagcacatgtgtgcatgcgaaggggatctgctgagtgctctgctctggtgggaaggccgctctgcacagctggagctgatgccttggcagatgctgggcatctgaatcgtgcagtgcaggagcacaggggcatggcaccgtttgttgctggggaacctaggcctcaaaagggcctcagcctctccgcagtgcagtgaggactgtcccatactctcactgcgtacagagtatgggagagtctctgtgaggctttgggtgccctgcagagggaaggcagtgccagctgggcctggtcgggggccatggagatggcgggcccaggctggggaggacttgtggcacccactcccttacccgctaacccggatcccctggaatctgcagaatgcctggggttgctcctcttctaccctgccgtggctgagctttgtctgtgccctgtcctctggccacggtctttgcctgatccctaccctggtacaggcagagctccctgcaacccccagctgtttccccagaactgacaccagtctccctgcaccacccatcctccttttgactgccctggggacgccactgctgctctgatcctctgtcactccagccacctcttgcttccctgttatcacaaacactgaacagtgagctcaggtgtcagcctccacagaggcatgcacagcaaggggtccggaggcatgccccatggagaactgggggtgctctgcttgcaggaggatccagggcccattgcagtcctcagatgttctgggggagaggatacgcctgcttcatttcttctcaggggtcagaactgggcacagggggttggaaggagggagaaagatgtctatcaggtacccactgcatgccaggccctcttctaggctcccttaaaacctttcaggtaggccagtcacggtcgctcatgcctgtaatcccagcactttgggaggccaaagcgggtggatcacctgaggtcaggagtttgagactagcctgatcaacatggagaaaccccgtctctactaaaaatataaaatgagccaggcatggtggcacatgcctgtaatcccagctactcgggaggctgaggcaggagaatggcttgaacccgggaggtggacgttgcaatgagccgagatcacgccattgcactccagcctgggcaacaagagtgaaactccgtcgcaaaaacaaaagacaaacaaaaaacacctgtcaggtaaatggtggtagagcagaaaacctgggctcagaagctggcattgatcccagagccatccagtttcaaagcccacacccacaactttcctccaggttgggcagtgcatgatggaaaggctgtcccagcaagtagtgagttcactttcaccagtccctggaggcaggagcagagcctgagctgaccacttggaaggagatgttattcaggggactcgagcatctggcgtaggatgggactccatgaggtctatgcctccttctagctctgaaactcctcaagggaaaccatttcccagatctctacgttgctgcagtcccttctaacttccagcacaccttctgctctctccgcaggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctgatggcctgtgcatgagagtctttcaagaagagggctctctgccagctcaggagtcttccgccagctaagggactggaaatctccccccgccgtccccctgcctcaccccacccaaggttgtctcagtgctcctcctgcccctcaaggttctggggcggggcccagcttgtgtattggaaaagcttcctacacacgtcgttttcaatgccatgcccaccctctgagaagtgtggctcgggtttgttccctgccccatgtccagtgctgctaggaaagcccagggctctggcttctgtgtgacttgcttccaatagcatccctcgtggcatcctgatcctctctagaaatccctgggggcaaataatgacccttccgcagccatgagtccctgccagacacaggcctgggccaggcatttgacatgaggtgcttcgctcattcctcctggtggcccagtgtggtgggtatgatcacacacaatcttgagatggacaaactgggctcagagagaggaacttggctgccaaaattcacacatttgagagacaaagagggaattcaaattccatttatctgaatttaagccctctctaaaccctgtgtcagcaatagatatggacagactgaatttgttgggggactgacaccccaattggcatcagtggcggggccaggggctccctgtgccccagggcccactccggcctccagggactcagcatccaggctctgtttccacacacgcctctcctccaaatccttccctaggttgatcccatcctcttaggtatggaccccatttgtggctcagaacctctctcatcctatgcctcatttcgcagcctggaccctagcactgggtgagatctcagccccacactcaagccaacaccactccaactctcaagaacatggtctccaccacctttaggaagacctttccaaggtcacttatttgggtcactggtccatcaaagccaagcctgggccagccaagtacaaggcctgctggagccttggccgctgtagctggtgggaaacaagaggccaggtgtggggctggacagtccaaggagccacatccggggacaaaacaagtgcaggggacatccatgcaggtcttgatgccagggagttagggaattggggtcctggcagggaagcagggctgggagctggctgcaagaatgaaaggaagactcagggggaggggcaggaaatagaaagggacatgtagggggagtgctgccgcccacttgcagcctgggggcaaatctgccagagccaggccgttctgggctcagcaaagctggtttctgggagccttcttcagtagggtggggtgggaagaccgaggtgcaggctgctttgggaaaagagtttcccatattcctaacgggagttagggcaggccaggtgcagtgcctcacacctgtaatcccagaactttggcaggccaaggcaggtagatcacttgaggtcaggcgttccagaccagcctggccaacatggtgaaacctcgtctctattaaaaatacaaaaattagct

SEQ ID NO: 17241 - DNA, 86213 bp, Human; identical to SEQ ID NO: 17240

SEQ ID NO: 17242 - DNA, 86213 bp, Human; identical to SEQ ID NO: 17240

SEQ ID NO: 17243 - DNA, 86213 bp, Human; identical to SEQ ID NO: 17240

SEQ ID NO: 17244 - DNA, 268449 bp, Human
  misc_feature (1)...(268449): n = A,T,C or G
caggaaagggaacctgactagagcgcgctgtgcttcccagcgctccaggggcccggcccccagctcggccccacctgggcgctctttcgctcttccgtgggtcggcgggccgtgcgggaggaactctggctgccgcgggctctgcgtcccacctgccatctcggtggctctcgcccgggccccgagtttcctgcggactagcactccagctgagccagccggaggggcggcggcggctccgcgcgcccagagcctcagcccatgaatgggactccaccctgagcgccccctcccgggcctggggaggcggcggcgcggcggcggggggcgcccgcaagcccgcggctctgagcggccacccgcgcacaatgttgggcgagttggcagccgcctgcacctgcctcctggccccggcccctgattccgcctccggccccaagcgcccgggttgcgccctcggctgcctcgcgaggtagccccaggaggcctaggggcccgcctgcgcccccggcgccagaccatggtgggcagctccggccaggagcctcagccgccgcgagccaacatcgcctgcagccagcccccgccccacccgagcggacgcgcgggtattcgcagcgcgcgggtcacttccttcctcggccgggatgggcggcgcgggactgagtgatcggccttgcgtccggcgggtaatccccatctgatctgctgcctgtgagctgctgactgccggggcgcgcgacctagggggcacgggcagcagcgcggcgatgacctgatcccgagcccgccaggggccccttccttccctcccttccctcgctccctctgagcctgtgcggagaccagctcggtgcggcggccccgggtggaccatggcggggagctccagttaaaggcgtgtgggcgccgagctggagaggacaccttcggcatcgctgccttttgagggggcttatttaaactactgagtcattccagatttaggattccctaaataatcaccaactgtgcccgtctcgtgccggaaagcaagcggaaagagaaagagcgcccactcttgggaccccgcagatcgcctctcgctggtttctccccgaggggtgcttggccctcgaggatctccctccctccctcgcgccctcccccctccctcgcctcccgctctctttgcagtgctgctggccgggagttgctctcaccgcagctggaaacagctgcccccgccccgcgcccctacccagactccgggtaaacgctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtgactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcggagaccaggtcagtagaagcccggagagtgggctccccagaggggacgccctccttctccctcctcaaagcacctcgggacccccgtggaagggaaccaggattcctcttttacattctgacccctcttctctcatttccagacttctttcaaccactctgtcagttaatagcttcttgccccatattcagcaaaaacactctactttgatcagtccggggtttgaccaggagaagaattacatgtatagatgcacttattccaaaagagcctgtagagtccttgaggggagtgaccacttcattcattcattcattcattcattcattcattcatctcttctctctctctcccgctctcccatccatccatccatgcatctatccgtccatgcatccatccgtctgtagagtacagtacttacgctgcccactgaggacctaaagattaatacagcccttcccttatccctcataatccatgatagacacctagtagacaccagatgaacttaaatttattatttttccaactcttcctccagcaacacttggcattgcatctttcagacgcccttgtcaatttctcacctcttcatttttccctcatgctctttcacttcctttacacagtcttcattttcctattattttcttccaacccctctcattgtttccaaggactctgctcattaacgtttctgtcctattaccatacttagcacactcacacttttgagacattgagggaacaagacagtatacacagtttggcctcaaggagtgtaaagaaaacttcagcttgatcagagattttcatggcgtgggctttctgaagctaattctcttctgcagccccgaccgcagatgattgcttttggatgtgtctctacttgcaaagggaaattggatacccaaagttttgacatgatgatttccaggtcaagccaggccagtgtacccagcttgagagaatggaagcagaattgcggagagatctgtgcttccatcagactgttggttttctgggttgtggctgcagagccatttgcattctgcagatactctacccctattgtggacaactggaaggaaatactgtctggaaagggagcctgccctgtaatctgttggctagtttgtctctttgcaactctgactgtggcgtgctgttggtttccagcaatgaagtacatggttgggtccattggatgaagggcgacacttgggaagtctggacaagtcgggctcagaattagctcagaaatttggggttaagccttgtgaagaagcgaccctgtttcattttccgttgggttttcatgacattgtccactccatactaggctcattttcttattttgtgatgatgataaagtggtaaatttcaggagtatacaaaaataattatgatcccaagacaggagctattagtctctattattttatgtccaattagtatagcatgttcattttataaagtgaagatttatgcaatagtttgaattacctctacaaagtaactcacctagtggaaaataaaataacctgttctgttgtggagggataatttggaggccttcttttcttagggcttatgtggtctacagaggacttcaaggttctgaactcaatgtgacttttatatctcaatctctgaagtacgtgcttgcactctagttgggaaaattatatgacgtttttgagttgatcctagtcagcctcttctaaaaaacaagataataagaatgataggtggatatatgtgaacgggtaacataaactgatcctgatctctggagttgacttggagatgatcaatgggttacttttgcatggcttcattttgcatgggaaggaaggactgtatttgctgcttcctgtgggctcttccttagcatctcattagaaaacagagatttgaggcagtttctgagtttattgttttcttcagtgttcgtttaatttgcctccctttttgttctacacagtgttcatcttatcagagaggatcctgactggtgacttcctttagctaaagtgtcaaaataacaatctggcagagagatggcaggacctattaagacattcccagtgcaagggcaacctgcgtgtatttgtataccatttcagtttgttctgaagcttagcttagaagaatgggcatgtggtgtgtgtaaaaacattttgggaagatgatagtgtgctattatcttcactaacaaagccaaataattaatctgttgatttgctgtcagcagccatgattcacatagcatggaataagtctatttatagagagatagcaccttccacatatcagttccagagaagaatctttagttggattgggaggaagttgctaaacaccaaaaagaaaaactattcgaatctgttttataatcactttgatgttgtattcacttaatatttgactgattcttgaaaccactagccttcctaagccatatcattgtgaactaacaaagtaactcacaaatggtaaagtggtgaagtggaataatttgtcctgataaagaatttccactctgaatttctgtcactgagacacatgttccattgaccagactttctaggggagtgaggcttaggaagtgaatctaaggcaagtgtttgatgggaaaggccacggttgtatttctgatttcagggctgacacattgagtatctctccttctcttttttcttagctaaccaagttctgatatgtgtagtattgaagctgtataaatacagtggggatcctgaaattatcatggcaaagggctcagatttaaaatgacagtaacacagaatgaaaacatgggaaatgactaggtatggcctcacatcacacagtttcagggccagggtgcacattggatcctttttgtgcagcaaaatctctgtctttgtagatgagaaatcctggagccattgcaagtttgtaatttatctaaggttacacaactaggttttgtcaaaattgagactagaactagattcagttgactttttttcctaccttccttgcaacacagcagaaagtaacatcaactagtgtaaataactggatgtcttctgtcaaagttttaaccattggtattattattatcattgtgatcgttattttataattagaacagagatagggtagagtagaagaggtaacttgtagaagaaggcataggctaaggaggccattggacttcagcaatgaccaccgtatagcattattgaagacctataggcagctagggttaatgggccccttagacactgtgtggactgtagatctttgaaaatgaaatattggagaccctgaactggaaagttggatgaggtcattgaaccatgaaaaagcctttagaacatttctgtttgtgcactttctaatgagaaaagagtgtacttatagtcattatttgagtcattatttatgtgtgaaaaggctgtattagtcaggcacactagaatatttgcctaaatgttgatgccacttaatttgttgtatctagactattagtacatccgtatgaattacacgcttattcatgtccaacctttagctttattttgagtagaaacaatagtacaaatgattgactacaaaatgatgtatgttttgactcggaagttattacagacaaagggtaacactcataatcaaggagggaaaggtgtttgtagaatctctgaatgtctgagtggccacgaaccttggaggtcatcaatattactctttcatttttcaaatgagaccctctctggaaagagcaaagcaattgattaagcctaaatctaggtattttaagtgatgtgggtgtttttattatatttctatataacttagtttcttacctcaaaccagaacatgaaaagaataatcaatcaggaaaaatctatcttaaaacctaaagatcttcagaatttttttacaatttaaagatttgatttcatacgccgatccctttaaaaagtaatggagtagaattacactacatggtaaaataaatcaaagtagtaattgtaatttacccgattttgttgattttcatttaccttatctttctgagtccctgtttctgctgttataaaaattatggttattcaaaatatttcagtattcttttacattgtttcggtagatgcacagtgtttaacagtatactcattcaacatttttattataaaacgtatccttttgcatagaggaagaaaatatcgtaggaaatagaaacttcaagaagaaagttgacagtaaaggtgaaataatgtttaatcatgtgatttatggaatatgagttagatttttataaattgaaatagttttggccaatatatgggtcaagaatagatttatatgacaggtgatattttacatttataggaagtactttgattacattttctcttttgaaagtatgactcatatctgaactacaaagtcagcctaattaaatgatatttggcttgatttttgttaaaaaaaaaaaaacagtaagacccctaacttttcagaaacccaccttagggtttaaactgatattttgaacatgtttttaaaattcggttctctctacagcagtgcattctcaacaacaaattatgtttccattgtaggaacattttaaaatagcagttattgtgatctcttgatttctttcatcccacagagatctcatcaagacgtaactcgagattaagtctttaaagttttaatgaatttgtttttcttgaacagaagtagaaaaacaatttataggaagtgaggcagtctctgcatttgaggaagcaataggaatattttggaagatctttagaaatgtaagctttgtctcataaaattgtattttaaaaagtcctgggcttactcatatggaaacacattgcttttattcttggtgagagaataaatttgctctggaaattttgtagatttgctttggaaatatgttaatagtgatcaattttttcttgtctcttctttgaatgcatgatcatcatgtatatttgcttttgatgtatagaattattatagattgtatgatgattccacaaaacagccttgttagacatagaggacacgcttgatatgctatattttcaattttatcttctggcttactcatggaattacagaacttttcctattttctaaagaaaggtgcaccacatctaaagggctgtgattccaagactacctcctaagcatctgtgagtgggagaaggcttagatgcaaaatgcctataaattaatcatctataataataaattttaataataataacttgacttcaggatttatagaatttctttataatttttgcttcttttactttttatagcagtctgctgagatagccccatcttagaaaaaagaaaactaagcctcaagtggcaatgagacttgttcagattcatggaatcagaagatgagtaagtgtcacatggctcccagttccacactgcagataatctgcttttatctcccaccacactgagggttaggaagctgggaaactattgttggagggaatctgatgaaaagttcaagaaatgtggaacgtgattacatggtttgttttgctgtgtgtgtggtctagagtccccagagtggaggagagaagtggaaagctgatggagatcttcagggcaggactgaagaagcagtcccatggctatgttgttatgtgctgggcttaggctcctggctcggatgttcctgcctgaatgccgggagccttgatgatatgaaggggtgccacatgggatacctaaggacccactgggagacttgggcccagagggccagactctcttaaccataaacataaatgattgcttcagatgttttggagagtaaagaggttaacaccaagttaaagagagctctgtaagatttaatctttttgtttgtttgtttaacttaagtgatagcatagcagaatgattaagtacctggacttcggagtgggatgtgaattcaaattatggtcttattatttgtaagaacattaggcaagtttcttaatatctttgcacctcagtttgctgatttgtaaaatgaagatattacctctagcttttggtcaagaaatgcttctttgaggaaaaatcatttaagctgagctccaaaagatgaaacaggcagacaggaatggaagaaccttcaaggcagaagagaacaacttgcatgaagattgatgtgagagggagctcggtgcttctgaagaaattgaagtatagctgaagcaataagaacaaggggagaggggtacagatgatgttggaaagtttggcaagaaccgcagggccttgagaagcctaagatgaattttgtattttaatctagggtccaaagaaagatcagcagtatggggtgatatcatgcgacttgtatttttaattgggcactttgcctttggagaagagaatggatagcaatggaagcagagtagaagcaagggaacagtaaggaggctagggcatcagtctggaccagcagttctcaaagtaccatacagtacagaggccctagaagcttcctgaaaatcttttagtggatccagaaggtcaaaacgattttcataaaaaatatttcctaataccactagttatttgccattttcactcattctgtcacaagtgtccagtggaattttccagagactgtgtgatatatccacaatcatctgtaaaaggtactaaaaatttcctcccttttcaaccacgtttctttgtgaggccaggttatcctcatgtacttcatccacaataagatatcaaaagagattgaatgcagaagcagacttgagaacaagctgacttctattaagctagacattaaaaagatttacaaaccagtcttttcattaattcctttttgtttgttttggaaaataaagataagttttattaaatcatgctatttatgttaacacagtggggcttattattgttttaataaacaaataattatttgaaaaatttcattgtaacttctaaatacagtaaatattgagagatataaactacataagcacaaagctcttcggggtactcaataatttctaggagtgtaaaggatcctgaaaacaaaaagtttgagaaccactggtctaggctatagatgatgttgaaatgaagttgatggccatggatataaaaagagtgggtaaaggtagaatgagcagaacttcataagaggtagactatgagtggagagtcgaaggtgcctggataatccctggctgaactattccatagtgaattgcatgtttgtggagatggaggaatgctggtgaaggagcagggttgatagaggtcaaataatgtaattacccaactacaaaacactatagaatgtgaaggtggggacggggtgcggtggttcacacccataatcccagcattttggaaggctgaggcaggtggatcacaacgtcaggagttcgagaccagcctggccaacatggtgaaaccccatctctattaaaaatacaaaaattagctcagtgtggtggtgggtgcctgtaatcccagctacttaggaggctgaggcaggagaatcatttgaacccgggaggcggaagttgcaatgagccaaggtcgtgtcattgcactccagcccgggccacatggcgagactcagtctcaaaaaaaaaaaaaaaaagaaaagaatgtgaaggtggaagattgggttttatttattgtttaatggttttacaatacccacatatataaggctgtttactttattcttgaactctcaagaaacactcattggccttcgaatcgtcaagtgattttacaaacacaaattttataaagttctatttttctgcctattgttagttatttgattcgtttgtagtatttataggcctcccagactccatgcttgtaaccacacttatgttaatgcctcataattgaaacttggactgatggttttgcatttgaagattcaccaaccatggatggaaatattcaagaagaaaaccatagtacaaccatgctatgcaaatactatgccattttatgtaaaggacttgaggatcctccggttgggtatcctgagggtggcggtcttgtaaccaccactcctcaccctgaacatagggagggatgactgtactctatacagtcttttcttcgttacttttcaggagtcagtagagagggccctaaggcctaagaccaaacttggttccctagaagtaaagaatgacatgggtcaaataggatctgtatgctgaatcacaaaatgttagcacttagagcttatataagccactggttctcagccctagctgcaaaatgaaatcacctgagagtttttaaacgtactaatgccaaacacctagaaagtctatgctaatatgcatcatatattgagagtccccaacctgttccaattcctttatttcataaattgtggcccttaaacaaaattaatgattttgttaatgtctttaggaacacatccattatgcctagaaattttatacactaatataatttataatgatgatctcttctgtctcagcccattctggttgttatgataaaataccatgcacaggtggcttaaacaacagaaatgtatttttcacagttcgagaggctggcattcccaagatcaaggtgccggaagattcggtgtctgtgagggcctgcttcctaagtcatagatggcagtctttgctgctttttcaaatggcagaaggggcaagggagctccctggggtctcttttgtaagaccactaatcccattcatgaggagagaggcttcatgacctaatcacttctcaaagtcttccacttcctaacatcatcttggaggttaggatttcaacattgggcagggggagggacacataaacgttctgtccaaggcaccactttttttttttttgcttatatttgaatctttcctgtgtttaatgatatcccaaaactgagctgcatcatcatatggaatgcttgcatgcctcgtcttcttgatgaaaacttcagttcctaagcacaggacctggtcagcactagatttctcagaacttagtatactgcctgtgtcactgcagttcttcagttgctgttaaatcaatgaggaaatgacatcctgactcactgagcaagcctcagaggaagaaggattctgaaggtagcatctctccttcccacctaaggatgctgaggtcctgcaaagcctggggcttctcagtttcacaggactggttagattctggatttagactcaggtttgtttttcctaatctacttttctttctactctgccagtcctggaaatggacctcagtttctgtctttgaaaaacaagggagctatatataagaatatataagagctggctcacacctgtaattccagcactttgggaagctgaggcgggcagatcacttgaggttaggagttcgagaccagtctggtcaacatggtgaaaccctgtctttactaaaatacaaaattagtcgggcgtggtggtgcatgcctgtaatcccagctacttgggaggctggggcaggaaaatcacctacctgggaggtgtaggttgcagtgtgccaagatcacaccactgcactccagtctgggtgacaaagcaagactctgtctcagaaaaaaaaaaaaaaagaaaatataagggcctctttagcctgaaaagctattaactgtagctcccctcaccccaggaaaaacatttgtgactgggaacatgaaacacagatcttttccctgcttcttacttgaaggacaaaactattttcttagtgtgctgttttggatgttcctaactgcatcccatggtttaattacttgcaaggcactaataaagaaatctgtctaaaatgtcagtctttctcttgacaccaatttaggcttattttgtctcttcaaggattagaaattaaatcagtgtgctgtgtgcagtgttttagatttttttttaaagggggtttgaagggaagagtgaaattcatgaaagaagaactataaacccggataagttgtataagttattataaagataaaatagactaaaaagttcataaagagtttttttttaaattgcactggtgatttaaatgttgtatattaatttgggaactcaaaagatgacccagatcaccttcacagtgtcctagaatcagataatgcattaaaaatcattaagaaacaggggcagaatttaaataagtgcccaaagtagggatctatattcaaattttctggttagaataggtgtcaggttctgttttcagccaaatagctctagctgtctacacaatataccttctacatacaatattacatttgagaaaggaaagtcacccagagtcacccacagaggccgcaacagaaaaggttcattcatatctgagtaattaatagaaaatgatggaacatatagaggatctcaaattctatggaaacccaagtttctcactgaggagcgagtcatgtatgtgttgctgtcatgctttgttgcttcaaaggatattgcagtgggtttttgcaactcgactctagctaggagaagaagagatggcatatgaggtgatagttcagaagctcagaattctaggaaaggaagtcacaatgatagaaacccagacatcctctgtagtcttcttataggatatttctctgagaaactggagatctattttcttttcgggaaagtagagaggattcctcattgcctccttgcctcacctgtctttccctgacaatccctgggccattatcctctgcagctttgctcaggaaaggagttggcagcattgtggccaggccgcctccacattctgcagctctggtttcccaggcattctatctactcctccctctccacctacaggtcatgagaaaagcaggaccaagaaggaaacttgctttgaaattatgcttttcctggtattgccacaaaactcccttctttgaaatgttcccgagtgcattttctgggttaccacatggctttatgatttagagttccattcattataattttgctaatggaactaccatcttggttgggagcctgccccttcagggtaagttttgatctggtgaagatggaggttccttggtcctgactcttgttattttcactgaaactgctggcctgcctgttgtctttttcatgctcagcaattacattcagtctgaagctggttttctttgtgattatgcagacacctgttagggctgaagagcagcaagctttatgcagctgggttcattatttgaattcaaagtctggttgaactggcaccttgattaagactttcgtcccaggccattatatatcttgcacttggggttgactaactgtgacattagccttgagatgtccacctggtaaggtatatatgaaaagtgttggtgggtttgaattggaaaacagagctcattacaatacacctgcccacctcatggaagaaagaaataagactcatagtgggtgttaggtcatacaactatgaaaggcagagcaaggactgaaatttgcgataagcctatgccttactgctacaccacagctgcctccttttagggcccattgcccaatgctggtagcaagagctatctgcctgttctgtgtctggagcaatataaatgttgggtagatgcgtttaaatatctacagtcaagttatattgctagacacccattgagtatttgtatatcatgtgcttgggaatggaatatagaaatactgagaaaatccttgccttcttttgtgtaaggcagtatataattaagatttattaactcttgctggatttgtgttactgtgttccaagttatagttttgctgtattattttggactgtttctcctttaatgtctatatttcaagaaaaacagtaatttcttaatttaaaaaacttagccacaatctgtcttttaaaaatacacgtgtgggctcaatacgtggttaagagcagacagtttattattgtatcatcaatatgaataggctccacaatcaaggttctttctccacccttccccacatactactctagccgacccaaaccttcttgacattcatagaacatttactgcatctatccatttcagttcttttagtttatagatgtttttatttctccacgagggatgccattaacctccacacctatccttcacttacccagagacaacccttcatttatccactctgctgcagtcctgcccattattcaaagcccagctcaactcccatctcttctgccagatcttctcagatccttccaggtagaatgaatcactgcctgccccaggctttataccctgcactgttgtctgcggttagtctgtcttgtcttataattactctataagtacctgtttgtctctgccgctggagagtgagttcctggagggcaagcgccctgtcatttcaatgctttctacatactaggtgatcagaaataattcatcaaaacgaaattaattccattggtgactaatgtgcttatggcatcagtatagtcaggctctgagggaatttctgcatatatatgaaaatgttgggaaagaaaataaatcagtatttttggctaatacaaatatctcttcatttgatattaaattccaaaaatattgttactccagtttaatttgatatgtagttgtttgataaatacttagaacttcatgtctttacttattccccaacccaactcctaatggccatcccttcttatacttagtatttactttgccgaacaccttcaaactttacctctttcttatcagagcacccactgatgcagggggcagtttctatgggaatgctgaaagaaggagcatctttatattcatttatgtctttgccccagaaacctagagggagtgggtggtgcagccaatatggaaaagggcccatttctattttgactggtttaggtttcttaacgttaggttaatgaggaataacctttgccattgatttcagatttagtcatgtctggtccttatatttacagctgagaccaacaagtcatcttagtgttaaatacccttgagggaacatattcactctgggttcactttctctggtgaagcgctaagtgatggggaaatacagtatcgattgggtttaatggaaaaggttctttctgtcaactcttgattacctcatttgtttttcttcttttctcttacttttaaagttattgatagcagcattaaataagtcttctgtgtatgctacagttctctgtatttattcttttgcttggtttgaaacccaacctttttaaaaggaagatataaataaaagaggtttttgattcagtctaaggtaaaatgatgtgatagaaaaaatactggactaggagtcagagtcctggtgaccttggggaagtcatttttcttctcttcggcttagtttccttattttcagcatgaaagggttactatcaatgatttccgaaattcctttcagctttattattcttgatgtatatttatggtgctaatactcatggaggacaggtgtatgtattccaagatatctgtatgtcagatataagaaaatggcttaatgatatgtttgatatgaagttctagaaggtttgacatgtatattaaatggaatatcacaaatttaacaaatatatttttattagcttctctgttgtatattctttatttgttcttagattcattcaactggacacaaattgactgtatttctaaattttccttgtttctagcattttgacaggccttcaaggtagaccattacataagtttggacctcagccccggaagaacttaataatatagtggaactagtatttgttttaatagaaaatacgtttatttactagtgtagtctcgaagataataaaacaatttttaaaaaacagacaggaaaggaaccacatgattttgagtgaaagctggagacttatttctgggtaggttaatgtgtaatgtcatactgcaggacagttttaagcaatagaaatgtagtaaagtataggatgccataggaactgattggaatggatgtggagaggcaagtcatgccttaattatcaagtttttagatttcccagacttgggatataccttttagatatgttttccaccaggacttcatcaattatgaaatttttttttaaaacaatgtttactaaatatcagccttgacattctcttagaatcatcacgtttaatattatggacagtttgtgaaattaatttatgctcattagtgataatagtagaagacttggtaaggaaggatatgattaaaatatatcctaaaatgatatcttaagagtttctgtgaattttattcatgtatattatccacattatctatttccataggtgtgattggtatttgacctttttcttttttttcccattttctttatctgtgcagtatgattacagtatacacaggaaaattcagttttatcttttgtgccattggtcatgttacttcaccaaaaataagcttggcctactccctgaatttgaagtataatacaaaatcagttttaaccatgagaagggctttttctttttgaggaaaatgtcataacagtcagttagaggccacctcatggtgtgtgtcaaacatgaggaaacttttacaaaaacaatttggagggctcctataggattatttctccctatttacaagtgagttgagagtcaatgtaggattctactgaatcactggctagtttactgtttgattagaacagggtgctaataaagtcatttcttgaggttagtcccttacgtagaacacggtaaagaacaaagcctagcatattgcttgacacgtagatgtcacataaaatatatttgttggatgagtcaccttaccaatgacataggcctaacaaaacaaggtgaatgcaaattattactcctggtggagagggagagtgaaagacctcagcaatgttctatgaatactcataaatagagccatcttcacatacactatgaacctttgggaaatttgagtttgttgggtgaaagtttttgattctgctctatcccgcatataggtagaattaaaaagcaaacctataccccattaacattgtaatcacagagtcttcatattgtagaaaactttaaaggtcatttaccttcatatttgaacccactgactccaacaccactgtacattcatttacatcttcaattatttgacagacatccattgtctacttataatctgtctagaactgaagtatgggtcaatagagaaaaaaacaaaggcctttatcttaaaaaggtcgtgggttagaggagatacagaacaccaaaaattacatgtgtagttcatcttcctttcttcctttcttccctccctccctccctcccttcctctctctctctctctctctctctctctctctctctctctcggagtttcacttttgttgcccaggctggagtgcaatggcgcaatcttggttcactgcaacctccacctcctgagttcaaacgattctcctgcctcagcctccccagtagctgggattacaggcatgcgccaccatgcccagctttatttatttatttatttatttatttatttatttatttattttttatttttagtagagacggggtttctccatgttggtcaggctggtctcgaactcccgacctcagggatcagcccaccttggcctcccaaagtgctgggattacaggcgtgagccactgctcacagccttagttcagctttctacttgaatcttatgatcttcagtggatgacatatgttgtcaactctgattataaaatgatgtttccccaatattaattcaaaatctgtcttttggaagcttcttaattcaagtcttctgagaaacaaaaatagaaacataggaaaaaatctgtaatcccttctctctataatagttcctcagatcagcacttctcaaacttgtgaaatgcagattctgattcagcaagtcgggagtggctttggaattctctcccaggtgataccattgctgctggcctggtgaccacacattgagtagcaaggctttagtaaacataaatctttgcttatgcaatacagcctctctcccactcctcaatctgtgtcttaccgtctccaatctaagtctcacttagtttcttagttcttcctgatacaaggtggctttaagctcatctatagaagtaatattgaaaaactgacatgtcagagaaacatggtcaggtattgaatttttctaatcctcacttttcttatctgaaaatcaggacaccaaacttacctatcctaaatatggaaagaatttatttgagatgaaggatttacagcacctattatgaaactgtatttcatataggagatttgttcacctccagtttatcaatatcattgtagagggtgttgcttggaatcaaatataataatccagatttggtctgataaacccagagtaaaataccttcagtccagattagaatttctgtgaggcctttacgagatcactttatccctctgcacagtaatatttggttaataatccttgcaactgctgtttataatgtgctttgagaaaagaacttcataatttcacagtagggattttattattttttaacgttaaccaaactcttaggattttcataagagatttttgcttgcattctaaattaaatcaccagttggtctagacgtcatctgaactgattcaggcacttttgcaggtagatttcacagcatgtaaactatatgctcaaaggcattcctgtgtttaattttaagagttctgagcatattgttgtccacaatttcactgttacagtctgaaaactatcataatgaagagatatacattttgctaatccccaagcggtgcatctttttgtcctccttcggctcatgcttttctctttgctcggctatggtttctccttggataaactcatttttattgacttcacttgtctcctctatatttttgagccacagattaacatctgagctcctcatccaaattttcaactacgtgctagatacctcctggtagttgttccactgggaacgcaaatgcaatttgccttaatttgaatgtattatcttcctccagaacccaatctgctttgtgtcttgagtttcccctttagtcaacagcactactaatgatacctagtagacacttagcaaatattggtagttttctgatactgaccatcttgtttgccacgttggggaccccacttatctttgactcatctcttcatatcagtcacacgcctcgttgactgtatctctgtaacgttttactctattgtttattcatcaggtactaactgaggactttctgggaactataagggacagtaagatgaattagcatggtcatggtcatcacatagctatcagcttctgtttcatataaccttttcttcatcccttctgccataattaaggggcttgttgttccaacctgaaatgttgtagaatctcctacctggtgtttcaacctcccttttcttgaatccctgattattcttcacacataatttttcaaaacatatttaatgtcacattactttcctatagaaacctttgcaaaggttcccagttccttacaagagcacctttaaatggctttaaaatgactgtactttggtgagatcttatctcttccaatctctccatcctctctcttagctgtatccacagcccccacactctgagtatggcatttgagccaggccggagaagatgagaagaatttcaataggcagtaagtgtaggcggtaaacacatcaacaaataaatgaatagagatgggaaactgtatggctgcatgtctcagcagttactgaaactcagaaatatatgacacaaaagggctttcccacatccctccattttgatatttttcacatagtgtgctagaatctaagcagccattttgtatgttctaaggaaggaaaacccatggacatttgaatgtttttcataaactaagtgaactaagtcagcgactatgagtcagcctacaggacagctttttctttatatacctgggttaccatagtgccattcttggtttagattaaacattttaaaattgaaaagagaaacttagagcatgatagttaagtaaaggaagttctttttgttgtccagatattatggatgatggtcttagtcagacatataatatttatttcaccatttgttcctcgaattgactttttgtgccatcatctagtctaactgtagtttatattggacacttctgattaatcaactcttgtagaaattatacattttgaaaagtgggtctaatacttaataactcataagagaatgcctttttattagcgttttgtatcaaataaagattttaaaataattttaagtagaatcaaaataaagttgagttgatctaaatttttgtttgctttttgcttctttttattttgctagatcaaacattaaagattaggaatgtttagtttctgttttaaaatctggaatagacaaatggaaatgctcatgctgaaaggatagcgttaaaatgcacgtatgctgttcccaactttccccttgaggaagtgtttgatctagattgtcccagacctcaggggaagattgcggaatatgtattgtcgttgtttgagatggagtctcactctgtagccaggctggagtgtggtggtgccatcttctctgctcactgcaacctccaactcctaggttcgtgtgattctcctgcctcagactcctgagtagctgggactataggcatgtgccaccatgcctggctaatttttgtatttttagtagagatggggtttcgccatgttgcccaggctggtctggaactcctgacatctggtgatccgcctgcctcggcctcccaaagtgctgggattacaggcgtgagccaccgcgcccggccatgtattaatttaagtcttttcacattggttagccattaattatgtttcgttgtaagagtatccttttattttttcttggttaccttagtttcctttttattttttggcttctttttttcagtaatttggtatcacaggcatcagtatcaggaaataagtgacaaaattttggcaccactttatatttcataagacatagtgaaagtttttgcttattttgttattcttcttttccatatgtttcatttttttttaaaattgaatatgttttaaaatatatttttcaaacttgaatacttatttatagaattccacagtctggcatcatatagcaagttgctttcaaaaatgtgaaatgtttttaaaatataatttatgatgactttaattttaagaaaatgacattaatttttaaattttaattttaccttctatattctatcttcaacttttattccatgtattactgtattgaatttatgtgattataagttatatatctttcttaatagtctgaattcttttagggcatgatacatatatgatttctaattgtgatctctacaacatctgagaaaatatctagcaaataattatatttctgtagacaaaaaataaataaaaagcacctaacatatgtcaacctctataacttcagaaattttaaataaaatgcaatataaattatgataccttcaatataatgactcatttactgtagctgatattacattgtattataacgatttggattgtctttgtctttgcttatttttatagacacttatgttttatgtattattgttatttttttagatagggtcttgctttgtcgcccaggctggtgtgcaacaacagtccgatcgcagctcacttcagccttgacctccagggctcaagtgatcctcctgcctcaacctcccaagtatctgggactacaggcacatgccaccatgcctggctatttggtttaattttctgtacagatgggggtgtctttatgttgcctatactggtcttgaactcttggtctctagcaatcctcctaccttgacctcccagagtgttgggattcaggtgtgagacacccctccggccttatgtatgttcaattatataaaataactaagagtggctataatcaaacttcaaagtcatgacatttctatcttgttactttttattttttggagacagtgtctcactgtgtcacccaggctggagtgcagtggcatgatcacacctcaccgcagcgtcaacctccttggctcaggtgatgctcccacatcagtcttctgagtagctgggaccacaggcacacaccaccacaaccagataatttatatatatatatatattgtgtgtgtgtgtattttttttttgtattttttttgtagagatggggttttgccatattgcccaggctgatcttcaactcctgggctcaagcatcttctggcctcagcctcctaaagtgctgggattacaggccttagccaccgcatccaaactgttttgttattgttttactgaaaataactatactactttattgaaagaatgaaattagtaataaaaagaaatcatttttagacatttactaaaaattattgaagcatacctggctttttgagttattttattaatacgctattttctttctcccaacttaaaaaatagaagacaggtttggatgtctattctataactagatggctagatatacttttggtttatctaaaccttaaaattttgagcttccgaatagccccttgtcacatctattctgtgaaatcataaaagggccaaccaggaggtgtcatttgaattcttcctgtgagatataatagaatattaaccagctcctcagtagggtgttcccagatgcaggcatgccagggaacattgtgattcactgatagtaacgggatctgattacgatcccaggatttgcagtgcagtgagacaggaataccatggttatttctctatattctttctcaaatacagtgcacagccatgctagcaattgcccctttttttgttcatattactgttatttatattgtacaatgtatagagatattcatattctaggtaagggagcaacagacaggtgaatgtcaaccttatcgaaggtttgacacttttaacaataaagtatataaaggcactagccctgtacctgaaacattgtaagtgttcaatgaattttagtttcttttttgcctccccagcttttgactctaattccagtgttctttatattaccagaggttacctctcccaattgcctttttattaggtaggtcagaaatagtttgatttcttcacctactcaattcatcattttcaatttgtgttcttcagacacgtctctgtttctattcatgcattgccttgtatgtagaaggaaaaatagaaaaataaatattatataaattactctaattattttatcagagccttcctttaactttcatactcatatttattcttctggattccagctgggagacagaactttaaattataatacttttttttaaagtgagaaaagtaatttttgatggaatttgaatgctgttttggatggtgaggtttataagtattgcattcctgagtcataaatcagccagaacttatgacagatgaaatttgtgtaggggaaatcaaataatgaaatgagacttaataatttctgcaagccatatttaagatttgttcccaagataagctgcagctagcatacagtgtgtgtatgtgtgcatacacatgtataattacacaccaacatagatataaatgtatgagtgaatgagctatcaagaagagagttcaagaccatgaaaaactagcatagcagtatgtattgaagtcagcgtggaactgtggaattagctctggagagagaaagagaagactgtgttcatgttggagacaatgtcactaattagatgtgtgtcatttattcctcgtttattcaccccatattgaaaacttaccatattctagcaattgggctaagtaacagttgcttaacctttctgagccccagttaccttcatgttaaaatagtttaatgagaatactaatgattgctttaattcttaggtaggggcctttgtcctggactctactcaggccttcctccaggcatgtccacgtctgtggtggcaaggagtccacgggaataagggggcatgtttacctggagcctgggcttccctattctgtaccacactctggcatcccagaagttcctacccagacattactgaggttgcttccaggagctgtgtgctcgtcttccttggctgtacttccaagggcaaattgcatggcagagagtattcgcccctggcctgaaggttcaccaaggctgttagacggaggtggatgttgcttggacatatggtttatatgtgaatccctatgggtccctggcagtgtcagttggctggagcccagagtgggaagagaagaggtctgaactatgagctggggggggtgaattctctcagtcctgctttgttttgtgaaagatcagatctgaggagcccaggagatctgtttgaattaggaaaacataattttcaagtagcagaactaaatatccaatatttgacagttaccttgatttataaatttaaatattaaacatatgatatgggagtctccatttgttctcttgctttaagccctacaaatattagggctgagtttgaatactacctaccttaaaagtgtgtgctgtggaacaaacaacatatatatgttaaaatttcatttaaattagaaaaaatctacataaatttaggatatgttgtaacatattattatttttatatataaataaatactaacagaactccacattaagagatacttggtacttcacgtagagcctcagcacaaagtgctcaggacatggtaggcactgccacagacacactgaaattcattcaaatatgacaagcaatttcataaccgagtctatgtacctgcttcctgaaaagccaggtcatctcccttttccctcaaatctatctatatatctgtatatctacttatttacctatctgttgctactgtatatacatgaggactttgtagaaacagatgtcacccaaatgagagtgacagagttaagaattgaggcaagttctcctgaccctcataacagtcacttttcaccctctctctacctaaggaatacagaggtaactgaccatccagtgtatctgtgcagatggtgcctgtacaattcttgggatgtgtcactcatgcaaacatcagtgaatgtcacccccggagcctgaaagtgggaaacctgtggtggctcaggaaaaaagtcatcctcagcagatattcagtgtagtcttagagagattgtatatgtgcgtgtgtatgtgtataagtatttttttctctttaagaattttcatatatgtattaaaaatcttgagtgagaattacctgttataaagagaagtcatcacatttgggagctcctcaacacttttgcatctgaataagcaaattaacatctgttctatccttctttccttctgttagaatgaagatgttatttcttccagctaagaccaatctcctgtgttctaaatctcatcctctctcaccttcttagggaagatacatcacctttcatcccctcttctctagcttcttgctgttttcaatttaatatgcttaaatctttatgaaatatcaatagtccccaatcctttttcaggactgaaagagtgcctacatttcttctttttgatttttaaccttttaacaaattctgtatattcactgttggcttttctttacctctcacttctacctcatctttttctaatctggcatttacactcaacactaacactaacaatcctgttcttgccaccattactaatgatgtctaatttaccaaatctaatggatacttttcagccctcatttatgtgacttcttgatagcactcaacattgctggttaattcctgtttttgaaacagtctttactcccatttttctggtttctccttagtctctttaagcagtttatactcttctgttccatctttagagatccaaggctgagtcctggatcttaaacactcacattgtactttcatggctttatttatcaaaacatcaacactgccacatttatatcttcaggcaagacctctctcctgagttctaaacctgtaaatccgacttccacttggtgcctccaactgaaaatatcctaaacctaatttgtaggtttctttctaaatctgttcctcttctaatatttccctcctcaaataatgtggttatcatgtttaaacaagcatgtacccactttgccaatggtgtagaacctcaaatatatagccataaaacctaaacacctttgcacaaatttagcctttgatttcatctacctttgtccaagaataatgtcctttctttcttttccaattattagtgtggtcttctctattacttatagcaataggttttttttttttaatcagatttttttttttttaaatcagaatccttggaaccatgtcattttaagggagttctgacctcaaaggtttatctgggttcaaagacttatgagaataacttgttttatttaagaccaccttgactgccttttccccctctgatttactgtcacaccagcacatgaatattataaagggtacacacaacagcaaggatacaatggactttattatagcatgtgcagcctccccattggctccataatatctcacagaggcatgctgagctcagtagtcaataaagctcacaaggagagaagtatgttcattagctcagaaaagtataaactctgggttttgtcttccatgccatgctggggtgtatatgttagtttgggggaaatagatcagtgaaggatctactttgctgtcttctaaggaaattctgtctgtgccatgattacatacttccactttctatttttactgtgctcccacacatttccctttctgcccacatgcaattaataactaagtcaagacaattttacatcttcacaaactagtcactggcatctcttgactggccgtgttgttactttctcacttgtctccctgctcatcctcctatctgttctctcgttatcagtctctactgagcttttaaaatacagattagatatcattcttatgcttaaaacttttcaatgacttgccattactcctcataaaagtgaaaaattttaaatataggcattcattttacagggtaatttacattcaaatttaataattatatattttggggtaatacaacttattaaagggaaatgatgaatataccttatataattatgaattatgactgtcacacaattttaatttatttagaaccaatctctttcgtttgattacttgctctatattatagcaaaggaaggaaaaaacatgttattgcttgggtaaaccagctgttttgtgtgactgactttgttttttataccaacgtattttttttttattgctataggtaatagagaagaccacactaagaattggtaagcgaagaaaggccattattctaggacaaaggtagataaaatcaaaggctacatttgtgcaatggtgtttaggttttatggctatatatttgaagttctacaccattggcaaaatgggtacagggtgatcagcctgagtgtagatggactatagcatagcatttgattgatgtacaagctcaataaaaagtgttatgctaggccgggcgcggtggctcacacctgtaatcccagtactttgagagtctgaggtgagtggatcacgtggtcgagatcgagaccatcctggctaacacggggaaaccacttctctacgaaaaatacaaaaaattagctgggcgtgttggcacatgcctgtagtcccagctactcaggaggctgaggcaggagaatggcttgaacccggaaggtggaggttgcagtgggctgagatcgcagcactgcactccagcttgtggtgacagagcgagactccatctcaaaaaagaaaaaaaaaaaaagtgttatgctagtctacataacactccctatatgtcctatgtgtctgactttttccattcagaatttcccaaatgacccttgctttcacactgcttcttccgccttgctctgtaacattctgaatgatctgaactcctctttgggccactgtccagactcttggtctctgaactccacactttcagttgtttaaattcaccaaaaaaattcaccaaaaagttgtttctgactttgaaccttttcttttacttctgtccttgtgtggagtgttattattttttactcctcattttttctgacacgtactcacttcctctagctaattccttctttttctttacactcatcttcaatgttctatcctgagggagccatttttgacgccctagggtttggtgaggtttatcctccatagcagccaggactccttcagaacacttctcatatttgtaattataataactgattgtggcattatttatttagtttctttctgacaagagggtcaatttcacgaggacactagccataccgccttgttcatagttgtgttccttggcgtggtatcaagaccagggtattggtggaaggaaagatcaaggttaggatggaaggaatgaaggcaggcaggcagtaggtttaggatataatttttgcttgcaccttatttggtgcgtatttttcagaatgtacgtggtctttgattacctgtaccttgttgttatcagtattaacaaagtcttcaagatcattgttgctttgtataatagatggtcgggtgctgtttggagaaatgtgtctgtcaagatgtccaaccacctaggtctgtgctgtataatatggtagccactagcaacatgtggcttttgagcacttgaaagtggctagttgaactgagatatactgtgattgcaaaatacacagtgtgttttgaagacttagcatgaagaaaatgaatgtatgatattgcaataatttctatattcactactaatttgggatacattatgttaaatagaacaagtcattaaatatatactatatataaatagaatactgtatataaatatatactctatataaatagaatatacactttcacctgtatattgtgcttgtttaaaaatgagtactagaaatgttttaaaatacttacgtggggtttgcattatattactgttggatagtactggcctaggcatgaaactcagcattctttcccttgctattagatccaagggagagaaagccattctggtgaaatgaggtgactattgtcaacaatgtgctatgaaatctaacaagttgtactctactttttattggacaatcaggggcaggtttttctgattttgccttactatcttgctatcagaaattagaatttctgtacataaacactatttctgaaataacataattgttaccatttgatagtgttttatggtgtagagcatttatttatagttagattattttttctctctcatgaacttatactctattagccaccatctatactttctttgctagattctagaatgtggtttgttatgttttcattcaggcaaatgaaagttggtaaggtttcaagctttgaaataagcctggaaatttttccaatgagatagaaaatgttgaaatcaaccataaattatctcacaaccaatattaagtctagaactctgaattttaagaagacaccagtccattaagcaaacagatgaaatatgctttgcctaaaggtttatctgcagtgcagtaaattgtaattcttaatgagacaaggaagggaaacttggacacctggaactgaaactagacatcatctatttaattattagtggatattaattattactgcctaaagttggatctgatttagtgttcttagagatttctggcatagcctttaatttaaatattgttattaatttcctgttatttatttccccaagcagtgagctataaaaagtgtgttatgtaacgctgtggtgtttgaatgtgttcaaatctgggtactttatggtatccaataactaaaacataataaaatcgtaagtcaatgtcttatcactaccaccattattgttttaaagccatagaacaaaagaggtaaaaaagatcttgatgatccaactcctttagaaagctgagtaatggagtgaatggcaaagctgggactgggacttaagtctcctgaatcctggagcagtgttctttctgtggacttctcctgagagtatattgcttccaaagtgtggtgacttattattgttaaattgagtaaataaggcagcatctttaggtatgttaaacttaataaaaatccacaattatctatttgtgtgcgaatgcattgcgtgtgtgcacgcgtatatgtgaaatttcgatgtcattctgggaaatagccactttgtaaatattattgctttgttaaagattccccaaaggattgagagctcttttagtgtccctcatgtctttatatatttttttccttttattgttgaagataacagagtacaaaaggacatttaaaaaagataggcttttttttttttttttttttagagcagtttcaggttcacgcaaaattgagtggaaggtgtagggatttcttatgtatcccttgccctatacacagtgacaatttgttaggttatctccagaatacatgattttatttgtatttattaatgtttttattaaatagtcatatacacatgtatttatcacacagtcatttgggaaatgtaggtatgaattatggaagctgaataactgcttttgcaattcacaatagcaaagtcatacaatcgacctaaatacccatcgatggtggattggataaagaaaatgtggtacatatacaccatggaatactatgcagccagaaaaaatttaaatcgtgtctttagcaggaacattgatagagctggaagccattatccttagactaatgcaggaacagaaaaccaaataccacatgttctcacttataagtgagagctaaatgatgagaaatcatggacacaaagaaaggaacaacagatgctagggccttcttgagggtggaggttcggaggagggagaggagcagaaaaaataactattgggtactaggcttagtacctgggtgacgaaataatctgtacaacagccccccaatccatgagtttacctgtataaaaaacctgcatatgtatccctgaacctaaaataaaagttaaaatatagatatagcccacaaccccacacctgcacccccggaccctaaaaaaaagtgcttttgattcttggagtttggagaaaaaggattaaaatggaacaagaaacaacaaataaatgtgattttcttaaatcagaatgtaaacttataccaaagaatattcttgaagagctgtttgctaaaatgacgaaaatgaatccctgttccgttacttttggaaatcttaaatttaagtttactaaaattatgtttatgaataatctaaggtttacctatttaaatttccagttacaaaagtagttgtgtctatatctttgcatttttgggaaagctattttaatagttagaggagaccaggcacagtggctcacacctgtaatcccagcactttgggaggctgaggtgggtggatggcatgagcccaggagttcaagaccagcctgggcaacatggcaaaaaccctgtctctacaaaaatgcaaaaattagctaggcatgatagcacacgcctgtagtcccagctactcaggaggctaaggcgggagaatctcctgagctcaggagttcgaagctgcagtgagctgtgatctcaccactacactccagcctggccgacagagtgagacactgagaaaaaaaaacagagaaagaaggaaagaaagaagaaagaaagaaagacagaaagaaagaaagaaagaaagaaagaaagaaagaaagaaagaaagaaagaaagaaagagagagaaagaaagagtcagaagaaagggatctcgtctaattttgatcaatgcgtaataccagaaaagacattttttcctgcactagggttctatttttctcttgtaaggagtggtaataagaacagctttcctcactggtggttttcaattctctagggaaaacatctgttcagatatattattctccttaaagcaatagaatgaactatttaaaaattatttttcctttaagatttaaaatttgggaacataaactaataagctgcctattgtatcccaagctccttgcatagtgtctggccctgggagactctcacctactaaatacctgacacttggaagggatcaggcagatgtgttcgtgactcagtcattcagagtgtttttatgtcctaattgcacagttctaaccacaatgataattttgaatattatagttttaatgttaccccccataatgttctacttgttagaggcataataaacattgacgctaaaataagactttgactattgtaatctgagctgttacgaaatgactctgcctcccacttaaaataggtgaatctgctggagaaaatataacagcaaaaattaaaatgcatagttgcgctcaaaaccaaaaaggggaaatctctatgtgccagaaaagaagagggaatttatatttatcgagatgagcaggaactgagtttctgtacttcaggtggcgattactagaatggcataggcatcaacaggtgagcatcaggcttaacctttatgtgggcacaggagactgggtgtcagacccgtgtgaggcaggcaggggcctgtacagagacagtgctccttctgagagatggtgatctagaaaaattttctatctgccaaggaaaactaaaaggaacttgatgtgtccacctagggcaatgggtggaaagtgttgtctatgaggaattagaaacccaaacggggaccacttcctgggtgaggttcaatatcaaactctccttgttaagttggaattccagtctgagaagttaacgtaagaacttctctctagctggggaaatccgtgaaatactacaagaggccaatacaaaagctttccatgtgtttcacagtccagggaaacacaaaacaactttctctgaggaaaatctcagtctgataattgaaaccatacaaggatataaaccatcaaaaagaagagtaaagctcaacaagttgaataattcatacccccaagttgtagatattaagatgaatctaaaataaattttaaaaataatgttttaaaagtttattaattaaatgaagcagaaatcacaagacaggaaaagggcagtataggaaaaaaggtgaattttgaagaaaatgattatatagcggtcaggcgcggtggctcacgcctgtaatcccagcactttgggaggccaaggcaggcagatcacctgaggccgggagtttgagaccagcctgaccaacatggagcaaccccgtctctactaaaaatacaaaattagccgggcgtggtgacacatgcctgtaatcccagctactcgggaggctgaggcaggagaattgtttgaacctgggaggcagaggttgcggtcagccaagatcacgccattgcactctagcctgggcaacaagagtgaaactcagtctcaaaaaaataaaaataaaaataaataaataaataaataaaattaaattaataattatatagcagtgacaatagtaagaaagaaagtttatgtgtgtgttcaaaaataagctctaaataatagaagagaaaatgattgaattggagatgaaagcagacaaatcaattcttctgagagattaatagatggaaaacactgagtgagattttaagagataggaaatatatataaagaagctccaacatgcatttcaatggagtcctgggaaagaagaaaagatacaatgtcagatcatctataatcaaagagattaagatagagaatttgcagaaccccaaaattcatatgggcttttcccatcatgtggattcttaaaacaatccacacctgggaatattatagtaatgttataaaatcacattatgatgaagatacaatattttaaaagaagtcagagagaaaagacagattaactacaaatgaaagatagattgcagacctgtcagcaataatagttgctagaagatgatgaattttttttccagaatgctgagggaaaataagcatctttttgatgttatgtgtccagttaattacaataagaaagagagagaaataaataaacaaatgtaatgccaaacactgagacatttttacactttaatagattggttccttattggttcacaaagagggggttgagtctggggggaaagaggggttataatgatgagcaaaaaagatggtaaacatgtttgtaaatctatcataataaacgaaaaaaatcttatgacgagcatttcttgggtttaaaaagaaaccagaactaaaatactagccagtaataggaatatgtggatttgagtttttagccgtttgcattatttgataaaagcttagtaattaacagttagacttggattttgttaaactacacctttatgttagatatgtaaggattactactaaaataatagagacagaactgtaatttccaattcaagataaagggaaaaattggagagagtataagggagactaaatcaatctaattgaaggaacataaggataaaataatgaagcaaagaaatgcataataaataaaaaccacaaacgaagatgatagaaataaaaacagctaaatcagaaaattaaagttaaagcaaaatgattatagccatctattatgggaatttcaaatcagatgaagattcaaaatccaaatatttggtgttaatacaatgttgaatgagataatcaaattgcttgataatatacatggcatatttttatgttaaaatgcacaacacacaaagggcagtaggtactttttgtggatatttacagagggagtacaggcacaaaaatatgaataggaaggctacctcccaaattcagaaatatgtctgcatctcgttagcaaagtaatggaatggaattaaagagatgactgtaatggtttgattctataaaacgatttgaagcaattatggaaaatgctagtatttgttaaatatgggtgatgagtacatggttgagaggcagtgagaatgataatctgttctatgggttctggagccaggctgcctgcgctcaaatctttacagcccttctgcttatgaaatttgggtgagccattgggcagtcacttcacttgcaccttagtattaacatctataaaatgagaaaaaaaatactaacttcatagagctaatgcaaagatggaatgagtaagtactagacatagaaatcatttgagtccctggctcatggtaagcactgttaaaaaggttattattagttttctgttttctgcatgtttgaaatatttcatgctaaaaagataattcaaattaataaaactgttaatggataggtaaaactataataaatcttcaaatcataatcaaggataatcttcatcaaagcaaattaaaattacgaataaaaattcctacgtggtacatatagatgttttcagagcctcaatatcagagttaaagaagaaaatcttatgaccattgtatctaatttgttttcccatttatgactacacaggtgatccatggaaagaatggattatgtgtggatacacacttgggaagagtttcaattttttcatcttatgtggtcactagaaagaaaacacagagattctaaaattaaaccagtttttataaaacaaagtgcaagattttgaagcatcaaataaaaaacccaatgtttttgtatttttgattctgtaacacctaaacaaaatgcaacatacattttaatgttaattgttctcccaaacgtgtgccctttaaaaattatttgttgacaaatcatgccttttcttaatacaatgtgtcacatgtaaatgggaaactgttttcaatttttaaaataggttataggtgttaaagtcaagctgaccgtctccataagtttgagagattccttagctaggggtagatcaatccttgctgtattgaatcctgaaatatgcttcttggagtcggccatgagagaagtaggcttttgatcatgtctacagtcagatcagccacccttgaaagtattgtcctggcactttgtctgaaaacactggttcatttctttattcatgagatcttagcctctatgtcacagtccatcattatcagtcacagtggcagttccctgtatctgtgtttcacttgtccctaagagcctcccaaaatgaatctaagttatagcacccaacccatgtttacatatttacagtgtatgtgttatccacatttgataaatattttcagtgctcttttgtgtgatgtaatatcaagtaataaattaattgtattaatatagtttgtctagattataatttaactgaaattttaataatcttcattgatttacagtggtaaaagatatatctattaaaaatgttttctccatttttaattctaacttattaaaaatagcttgtaagtatctatcttgacctgagagtccctcaggtttctgggacctagacttggagccacggaactcttccaatacagtcgttttatagatgaaacctgaagcccagagagaagaaactaggtcactgaaaaaaaaaaaaaaaatgtttgcttcctgtatgttaatgggcactatgctaagaactagatattctgtaataaataaaagttacatggcctcaccctcagggatgctacagtctagagtgggaaatagataataaacaacaaagagaaatagctatctagttacaaattcgactacgtgcaatgaagggaggtgaaaaaaaaaacagtgtgctgccagataatatctgtacaaacgtggcggcagatttaggttggaggcctagacaagacctctatgaaattgtatttatgcagtgacttgaatttatttcaggaagaaaatcaatccaggcagagggaaatgcaggtgcaaaaatccctaggtctgaatagaaagagggcacatgtgcctagagcttagtgagccagggagagagtcaattaagatgatgatgaaactgtgggcaggagccagatggtgcaaagcactcccggccatgctaagggtctgacgttttcttgtaaatgaaatgggaagctgttaaagagtttaagcagaagagtgacatgatccaatttatattgtaaaatattaccttgactgtagtgtggtttggaagagaaagagtgttagtgaggaggctgttagtggaatctagcccagagcactcgatggcctgaacaaaggtggaggcagtgcggatggagagaagcaaacaattggaattagaccccaaatgtccggatcccactgccctgcatatgcccctgcaccacggtgcctgaatttaccaggatcaaggctgatggatgtgttcttggagctctcaactgctcttttgccgaaagtattattacaccactagaactcactctggttgactctgcaaaggcaaagcattgtgtgtgtgtgtgtgtgtgtgtgtgtgtgtgtgatggtatgaaaagatgatagacaaaagtcacatttaacaaccataataatatacctgaaggtaatttacatttgggctgcatgagggaattcctcaggcttgccaacctgnnnnnnnnnnnnnnnnnnnncgaaaaagaggtccccgttttcccccttttttttgttgtgaaaaatattttcccccttccctttaaagttggggttttgaaaaaaaaaaaaaatgtttttttattgaagagggctttgtttagttggatttttaacccccaaggcctcttagattggccttaaaccaaagggtggaaggccaagtgcggatttgaaaaaaaacccaccccttttggaatttttggccccccaaatgtgccgggttccccatgtgccctggcattttgccccttgcaccccgggtgccttgaattttaccaggatcaaagggttaatgaattgttttcttgaagctttccaattgtttcttttgccgaaagtattattacaccactagaactcactctggttgactctgcaaaggcaaagcattgtgtgtgtgtgtgtgtgtgtgtgtgtgttatggtatgaaaagatgatagacaaaagtcacatttaacaaccataataatatacctgaaggtaatttacatttgggctgcatgagggaattcctcaggcttgccaacctggataaacagatctctgatatccaaggcagtttcaggacaagtccaacatttgtgcagctcccctgatgtcagggaactgtcatgcctgtgctcgcccaaataatgtgtcctgttcatttatttctggtgccaaaagatgtgtctgtgagaaaagagactcactgagaagatttttctatgccaaatgaggatgcttttattacagaacactttctgtgtgcatagaagtgtctacagccccgccacttttttttgtgacaggaggccaaaagctatgtctgcaactccagtttagtgtttgctttttattcctggcccctggctttatagatttccacagggtttgtgggctgatcacagttaaagaagtagagagatgtattagcatgttagagttcttcaaaagacaactgatgattaacaatgtggtgtaaagcaaaaaccttccaccctggctctggcatggattaactctgtaatttagcactagtgatttcacctctgtaagcctcagttccctaatatagatgtaaaaaaaaagcccaatgatagtacctgccttaaattatttcagtgaaaattcagagataatccacataaagtgcctggcatttgttaactgcttggcatttcctttctgtgaatgaacctcaggagaatttgcccattgctactgtttaactaaccgtggattttcctatctacattaattctgtctgaaagttaaatctaccatataagcgtggcttcctagtcatagagcacactataatgtgtcttcctaatttcttagaacaagctttagttcagtgggtcttagttatctaaacaatttcacaagaagcaaagtatggctatgcatgaagaaatgaaatggctttctggataccacgcagctcgtttgggataagatcaggaaacctctgggaggcacagaactggaagatcctggtatattaaagagctctgactccagggattggaagatgtgctgccacgcgactttcccctctccctggtgttttgtttcttcatatgtaacatgagctttgaattagattatcctgaatggcttgtctggctctgaaatcttaagattttaggattatcttcatgtttgaagtgtcttgtggtcggcattctccagcaatcatttttgagctgcctggaaagccatgttcattccaggtctacttctctgggtgatcatttgagaaagaccagggagttgtaacccagtgaggttgaccagtgtcaaactcccctccatgaacagagattcttaaaaggcaagaaggtatttggcttcatgggaatgcctgcgttaagctttcttcacccacactttcattaatattctacatttaaatagtgctcccttaggaagatgacgattgattcggattcggatttgggatttggatttacaactgaaatgagactttcattcttaaggtggctgaaacgttagcacaccaagcacagtcagtcctctggctgacagctttttccatccccattgccactgcctatctaaggtccttcttatatggaatagctccctaactggctcccataaccacagtatcctttgactttgtaaaatactaccctcataattttagccccagacttaaaatccttccaaattttcccattgcttaatgcattggcctctgaagcatgtggggcatgacagccattggcatatgaaaaaaaactattacaacttttttttagatacaggttctcactctgtctcccaggctggagtatagtgatgcaatcatagctcactgcagccttgaacttctgggatcaagcaatcctcccacctcagcctccccagcagctaggactgcgggtgtgcaccaccatgcctggcaattacaacttttgtttgtgtttttcattgatctcattttaaaattcctattttgtgttatattatacacaaaatttacagagtggcacatacacgtggcataaattatacatgtacatatatgaaggctgtagatttaaaatattttactgatagagatgtataattagaaaagtttggacatcattgacttaaagaataaagtaaaacttgttattagctttgcttaaagatcctcaagtgtcctggaccctgcttcttttctgctgtcgcctccagcccctgcatgcacccccatatttccttcaccctgaccacacccagctacatacctggtccctgcacatgctaagcacatgcatctgtctgtgcccttgctcctgctggtgctgctcaaagcaaaatcctcctgcctattctaggctaactataaaatggtacttcatctttaaagcttttttcaactgtttcttgtcccagaacctgccatcccaggtaaaattagcatccccattctgtgattccgtggcattttatttgttcatttatgacagcactttaaatgttcacggaaataatgattagttgtgtatgtgtctccttgatcaggccgtgggtgccttcaaggcaggaattgcatcttactcatctttgtacccagcacctagtgcatgttggaagtcaataaatggtgctggaactattttaaattttcatgagcatattacaaagaagaatctaggaggaagggggctaatgctatgaggaataaaactggctcagtacaaaaaccttgtccctattggcatttcacatcttagctcagttttcctgccctccgtctcatgtcttctacagctcagactgctttggtgaagaggaaactccaaaaatgaaggttattttctttccatgtagctttgagacaatatgaagattgaggattgcctgtctcaaggtcattcgattcctgttgaaatgtgaggcaactcagggctttggagactgtgcagtttatggaggaggctgctgtgcttgtcagactgtgttcagtgtgcaggacaaaattggaagaaacgcattagaggccagaggcattatattcaaaggctataagcagctctttgtacaaatgagaagctcctttgaaagtcacaggtgacaaaggaaaatgccaggtatatcttattactttcattccttcagcatacaaacactcctcatctaccttgtgcctggcactgtgttaggtgctgggatagagttgatgaataaggtctctgccctgagaggttcatagttcagcagcagagacaggggtgtaaacaagcacctctaaaatagtgcacagctctcctaacctatgcacaatggagctttgaagaggaagtgattaattttgcctcagggtgtcagggaagaccctgtggaagaaagctgtgcttagaaggctctggaggacccctgggcagaggaggaaggcaggggttgtgcttttcaggcagaggtgtctacagaagcaagagaaagcaagtagagaatgggctggcagactttctcattaaagggtctgttagtaaagatttcagtctttgcaggatatagggtatctgttgcaactacttacctttgttgttgtagcatgaaagcagaggcaatgcatgagtgaatgggcatggtcatgctctaatactgttcagattaaatgagcaagaaaatgaaaaaaaaaactttattaacaaaattggcagccacagggctatagtttgtggactcttggcatagaggaaggatcttcagagagcctctaatctgttggttattaatctttaccattattaggattgctttatacttgctgctccctgctcctggaatgtatttctgttagatatccttaacggtttccttcctctctttctttaggcttctgtgatgttatcttctattcgttctgtccacaatagcacatccatcccttgcatgctctatccttttatattgctttaatttttatcatagcacttatactaacattttattatatactttattgtttacatgtttattttccatcttcctactagaatgcacactttatgttttatcctcagttatattcattggtgagctggagctgatggtgctcacctctttccagcttcacatctatgttcagtgatgtcaagtagtagttttaaagcagtcatagttgaagtagttgcactgtggaaatcatcccatggaagtctggttttggattttcttttctgctctgtttttttttggaaggggagggaggtgggggagagttgatttactagcatgcaccgattatcccttttgcccagaagaataactgtcacaaaggctgttgctcaataaatattcatttttaaaaaataaaacgtgccattagtatctattgataactgaaatagaatgcacttagttacagaatcctcttggaatatcagcacttttggggttgattcatggccctcagcaaggtagctgctgatggtgtctctcgtcttcatttgaccaatggggagatcgaagatgagggacaggacatgactcactttactccacagagcagattctgccaggctagagtgacacgtcttcagccttatcctttcagttctggaaggtgttcctccaggtctgttcactgcagtctgttgagtgaatgaggggcctcaggcctgcttctcctttactaaatagcatatatttttactgaatccccatagatcagtagagttgcaatttttcagtgtgttcaaaagtccaggtaagttctgtcccttttcaaatgcttactgtagctcatttctgatttgcctgggactttgatttatggtatgtaaatatgccctagtctataccctttagttatgattggtcagaaatgtatttgcttatgaacattttctaaccctaatagtctaattttgaagtctgcatcaatgtaatgcccccgaagcccttgacaagaatcacatttaacagcttcttcaatctcatttcccttaagtggacaacattaaatgttaatacagaaggcacatttgtaaacccaaagaggctgattaaaagaacccgtcaaactactccacaatctatgtttaacatttataaagaaggttgcattttctggatgcctggtaaacagtctttttaattccctgtcttaagcaccgactaaggaaacagaaaagtgaaattgtatttagtggaccatctggcttatctcaaagctttccaggacatcagggttagaaaagacctttcattctcactcagagtgtctccgcctttggagacgtccacgtccttcacagctgctctgacctgtagtttttctgcttctttctggttatgtccagtgatagaaaactcactctttccttaggcgacctgttctgtctttgaatacaataaacagaaagttctttttaatctgcatattcctgtaactttcacccattggccctaggtctatctctgtggagccactcagaacaaattggctgcttcttatttctttggattttcaagaacgtggagacagctctccaaatcctccctcttctaggctctcacatccctccaaatgcttccttttctaggctgcacggccactgttaattcagccattcttcatatgacagtcatttataccctctttatttggctcctttcctctggacaggttcctgttttgccagtactcttttaaagtgactgaacagtactagggagtggctgtgactttgggtcaaagtggtgcagcttccttgaatctcaacaaaaaatgaaaaatgagaaaagagtacctcatacagttagttgttatgcataataaataaaacaacagtaaaagtatcagaagtgtgcctgccacgaaggagatgggttcaatatacagccattgttatcaaaagtactattaattctctagatatggcccccattacataattttcattattgttataatagttttcattttagattggagtttatatgcagaacctttctctaaagtttgggtatatgtgaatacgctggccctagaagattttagtatcaaaggttatatagatacatatttcttgcacaattttctgtaactgcttttctatcaacacgtactttaataactgattcacagctagatactctcccctccttattctctcctctcttctcccttcttgctccccaaccctcagttttggtaaggtaaggattttgctctttggaaaggaaaggatgatgtccattcagtatataggagctgagttcttgtctgaactcatcagtgtgttagctgtgtgaccttggataagacactgtctctccgagccagagttttgttttttgttgttgtttttttttttttttttttacctttgaagctaatgaagtaaagtgtcgatcctttccacgtctaaaattcatcctatttcctgtaattgaatattcatcctgagatttctgaccaggaccccttggctctgtctctgttctgggtttccatcgtgtacctaggaaatactccatagcactagatggactgtcaagccggcaggaatgtctagatagctccaacatgtgtcagcttttctgagtggctctgaattcaaacgttctgctgaaattgccatgtcatcctgatgggaagcagtattgaacccgaggtcccatcctttaccttccttgtcactcagcctctttgaggaaaacatttattacttgcttttttagctgtacttagtatttttaatataattattatcttagaattttttttaatttatagagatgtgaagatagtacagagttctcatataccctatatccaatttcccatagtaacagcttacattaatgtacaatatttgtcacaatgaagaatctatatcattacagtatgtttaactaaaatccatactttattcagatttccttcatttttacataatgttctttttcagctctaggatctcattcagaataccccattacatttagttgttatgtctttttagactccttttatctatgactttttcctagacattcgttttcttcaatgacattgatagtttttttttttttaattttttacttttaacttgtatgggtacatggtgggtgtatatatttgtagggtacaagtgatatttcgaaacaggcctatgatgcatagtaatcacatcaaggcaaataggttatctctcacctcaagcatttatcccttctttgtgtgatgaacaatccattttgaggagtactggtcaagtattttgtagaacattatttaacgggcatttgtctaatttttttttctcatgaatagactggggttgtgggttttttggaggaagatcacagaggtaaagtgctattctcatcacataatctcaagagaacatactatcagcatgttttataattgatgatattaaccttgattgcctgactgaggtagtgctttgtttgttaggtttctccaccataatattactctctccttccctttgcatactgtatgttttggaaggaagtccaaagcccattatgcacagccaatggaagtttatttcttattcagttcacggtccaaggtaggtatttcaatggcagtcatctttcctttacctgttattcagggacccaacattcttccattctgttgtttctatagcccctagggctatgttatcttaatctggccggtgttaaggaaaagagagtgtggaggagaatgtttgcttttaaaaaccttggcctgaaaatggcacacatcacttccacttacattccatatgacactcattcatctgccaaacctaactgcaagggaggctaggacatatggtctagctgggtgcccagaaaaaagaggaaatggatttcagtgaaatgcttgcagtatttgccacaccactttagagcacaaaagggagcaaaccaacccttcctcccctaccatctaataatatagtcatcatttcattaagaaaaagaaaaacagtaatggaagagcataattttaaaatcaaggagtcatataaactggaaaatattagcttcatagaaaacctattccattgaccctatttgtcttagtgtcactgttgtgctagaacatttgttgagaacaggtacttacttgtatgtctgcatttgagaacccttttctctattctgtctataccaggctgcatcattcccagagttgtgatgttttgtgtggaatgccctttctctggtttccttgcctatggcaatcctactcattctttaagtgacagatgaagtgccttatcccaaccttcaggcagaactggtcccttgctccttggtgacatcacatcactgtgattcacttccttatttatcagctctcccacactggtattatacacaaatatgtttcatgcattagactgggtgctccctgaggacagcaaaggttttcgttttcttcatatcttgggtccccaagcatagtctgataaataaacgtgtgttagttgaatgtacccaggatgctggatatgctgaaaagtggtctcattttatacctcctttctttaaaatagagcaaaacatgttctggttttcctcatcgtaaaggagattctcacttacgatagctgagtcttcatggagaaggtgatgttgagctgaacctggaaaggttggtaggacttgatcgatggtaatagacatacaagatgccactcaggctacacagctttctgtgccccatctatattatatatgttcagggtatttttttcaatagatgatcaagtctcctttgaaacttctgtaatgcaggatgttcattttcacatatcacaacatgattaaaacgcagactctgggcctgttctggcactgctctcagagatgggtgctcagagtctgatgctcattatcctgagcaggagttaccaacccgaattcccagggctccaacaggggatggctccaccagggcaaaagaagtgtttaattacaggtacagaaagaggagcacaaagaaaacaaacaatcattcacaggctttaatgactaaactggcatgcatctcattaccaataaaaacatgacttctttttttttttttaattatactttaagttttagggtacatgtgcacaacttgcaggtttgttacatatgtatacatgtgccatgttggtgtgctgcacccattaactcgtcatttacattagatatatctcctaatgctatccctcccccctccccctaccccacaacaggccccggtgtgtgatgttcgccttcctgtgtccaagtgttctcattgttcaattcccacttatgagtgagaacatgtggtgacttcttaaagtgactttatcaagcttattagaaatacagtgtgaattgtaagacagttgccctcttcctcccctctattgttttatatcctgtacttttagcccactgtttactttagtggctttacaagctcagttaatatttactaaagcagaagctggagacatactcttttctcagaatgcttcttttacctcccttataccgtgtccttgattttcatagttgaaacattagactttaattaggatgtatattttatgggttttctagtttgtactctgtcactattcatttgaaatttgcaaggattatagagtaggactttttaaaaatcttactatatagatacaaaaacttgaaactcagatgttagatgagttgatcggggccacacagcatttgaggttcaaatctataggtgagtctaccacatcagaagctgcctgtcagccaggtagccaaaggcagaggcacacagagagttgtttacagcaaggacagaaaaccaaacactgcgtgttctcactcataggtgggaattgaacaatgagaacatttggacacagggcggagaacatcacacacctgggactgtcgtggggtggaggggtgggggagggatagcattaggagaaatacctaatgtaaatgacgagttaatgggtgcagccaaccagcatggcacatgtatacatatgtaacaaacttgcacgttgtgctcatgtaccctagaactaaaagtataattttaaaaaaaagagagagttgtttgcagtgacgttagctagccaagtgtgtccctgacttgtccatagttgtgggattagatgagcctatggaggaaatgcattgaagacaaatccattcttctatttctgacaccattcaaggcagaggattctaatgtgctcaaagtgaatagagactcatatgaaggaacaaacaaccattcagcttaacttccagatttttattgatgaggacattgaggttcacaaatttaaaaaacggaatttatttaactcataaagataatacatatctattaattagaatacctaatttccagttcagttctttgctcattagtctgcttcctcattcccaattttcttgacatctcttttgctttgtaggactgctttgaaaaagatgtgttgatagaggcattgccccatattcccaaataatgtgaatgtgatcaagtcacatgtgcaaaagtcccaactgcagacacttgttatagggtgtaggccaattctcaaagaattaatcacattaaatgcttaactagaattcttttagacctaaatatcaataatgcattcagtgtaacacacagtgcctgccatattgcttggcagaaaaaagacattcttggtaaacattagttgaataaatggatgaaggatgaagttgactagcttaaattcagcgattgtccttctgaggataccatgttgttacttcagcaatcatatgatttccatctttgcctccatttttatcaccagaagcagcatttttctttttctcctcattttaatgaaataattagagctataagggcactagaatacttcatttttgctcaacaatagagacaaaaatggtgatgcggtggaaactagattgttgctggcagccagcactgcgatgagaaagctttaaatatttatattagctgatgcacaaaaattcaaatgtgttatacaaaggttagtttgaaagtatttgtgtttagagggtttttaaaagttgagcaattctggtttgaaatacttagataaatatgtatgacttgattttttttttttttttttttttttgtactggagaaatgaactttggaacactgaggctcctctctgatgaagtatttagtgaaggtgaaatttgcatttccacatatttgccagtgacatctcatggccgtggaagtttttgctgttgcctgtggttcttctccaaactattctttctggctgaacttgatcacaaattcaaaacccaggaacttctgatggagagctgacatcctgcagagatagaagtcttatggacctggttatggctactagaaacttagaaattacagaggcattttggcctaaacaataattctggaatgggactataaagttggtgaaatcttgcagtcagacaccagatgcacaaaggaggaaaataactcactttttagcatgtctctgtattttcccaatcataattagcttttatttatttgcatttagtttactgctaaaagtgttaaagctctacctctaaatggaaaaaaaaaagcatagatatgttactgaaacacccaactcccaaatacataattcaatatttaagctattggcatttacgtatttacttacaggatgtttttaacaatctgtaagtgtgcatttgtgtaagccaaataaaaatttgaataattattttgttttgcagaaccccagctcaaagggattgtgacaaggttattcagccagcagggatacttcctgcagatgcacccagatggtaccattgatgggaccaaggacgaaaacagcgactacagtaagaaacattagcttcttacaatctgattacaaatcaaatgtagggcccagtgtatcttatacttaaagcattgctaagctgccttaccaaactatgcctttcaaactatttaactattagtaagctagtgtcttttcctttatccttcttgctatgatttcctacagcaaagacagtataggagagaggttatgcacttaagagaaggtaagaggcttgtccatttggtcaatgggcaagaatatactcccatcacagtgtttttaggcagcatgatgatacacactcctaggaacaatacaagcacatcttccaacacaagatggtatttaaatcccggaaccaagtgatgaacaagttatagttcaataatgaacaagttctatatttcttagaacacaatttctgacagacaaaaattacctcttaaggtaaacactgagtacatgcatatatgtgtatgtatatatatatatatgttattttatgttaaaggcaaaattgctgattttaaaaggaaaatatatttaaatattataattacatatggtacatataataaatatatataatagtaagaagataatgaagactgatagacctgaaatggaatttaaaaattttggggggggaaataaaaatgctgggcattcaaagattaataataatttctctggatatagtttttaagtgatctaactttagagttgacaagttaaaaaattaaatgcaatcatcacggtatgacaaaatgaatttgcagtctagaaaaatgtcaaatacaagctccagaggcaagattgatagctgtcatatctttcaaattctgcataatcatatacagatacctgagggcaaattcatgtcattctaaaattatgtatggtgccatattgtttcctaatgtttgtctgtcttcactgctagatctttagtgttgagcacacaataaatgctcactgatatctgtcccaacaagttgtgattctgatggatataattttgtgatcaggctgataatctaccaaactgcataaagtaatttaggaagctagatattttgtagtgaaacgtcttttaaattattaagaactatttgaggaaaaatttaaaatccctaatgaatgaaaatgcccttgtccaccctttctaagttattctttgttcagttaatattacacatttaaaatataatttacaataaataaaagatcttattataaagaatttcatttcagttttcttgttctcagattttttgctaagttgttgattggctgattttggtttgcattgttggcttgtgtttttgtgaaagcattctttaaatgattaaagctttcaactcagtgtagaagaatcaggatacttttctctccatgtactttcatttattgcgtctgtaactgaatgtcgatttagtgaggctacaaatatagatgcaagaaccagggaaccacttatttgtgtcacttatctgcactaactccaagatattactagttctcaggttttatttctataaaatctaatggctggagatggtgatgatatatcaacatccctgtcagcatcgtccatctaactttaaaaaaaattgaaaaattataaattgatgaagatagaatcaatccccaagtaagacgattagccatattcaatctacaaaatgctacctttacccagccaactatcttgcaaatgcatgacatttatcatggggcagagacagaagggtagaagtgcaagtgtggggtcaagctaggacaaatccttccttcactctttctaggaaaataattgacaacgcttgctctgctgacgctgggtgaactgctagtgtaaatctacacccacgtgtacatttgtaccttcctccatgcatatatatatcttagcataatgtcattctgcataccacacacaaacccacatacacacacacacaccatagggcacacattgtgtcaaataagtacttttaaaaattctctgaactcccaaatttaaactaatattttattaagataaactatcttaatattttattaagataaatttaataaattgtgtttaaaatcatttaggtgtacaaaatatatagattaatacaagtttatctggatacctaccactagctttaaaattaattaaaaatatcaatatagtttaaccttcttgttgtgttttccctcatggaatcttacttttcatcattaccagatataataactccctggaattttgtatgtctcatatatatctaatttaagaaaaaattttaattcataatattgttttgcatattttaaaatattttataagttagaacattatcataaatatattttatgtactttaatccccaatattatggttgtgaggtttgtatatggtaatatatttatttgctttatttctttcatttttgtaaaatatcccactgtatgaatgtatacaaacatatttattcattttcctttttgtgtataatcattgtttctatgttaaggccattacaaatagtgctgctaagatctgtcttataggtgttgaagatgccttccttaacagtcctttaaaaattacacttctcaccttggaactctattttcatatcccactttctgaaatatgtattgttgctgtttatttatttttgatcttctttcccagaagaatgtatgttccatgagtgaaaagattttgattgatgcctcatgcatcattagaacctagaatgaatggtctgtaatacatagtaagcactcaatacaaagtgaatgatgaatgactaggtgcatgaacgtctccgtcaatatgtagaaaagttgtttgtttttttttttgagacggaatctcgctctgttgcccaggctggagttcagtggctgtaggtcattggctaaaatactgttacccacatttttttttttctttttgagatggagtctcactctgtcactaggctggagtatagtggtgtgatctcggctcagtacaaactctgactccctggttcaagtgattctcctgcctcagcctcccaagttgctggggttacaggcacatgccaccacacccagctaatttttgtatttttagtagagatggggtttcaccatgttggccaggatggtctcgatctcctgacctggtgatccacccgcctcggcctcccaaagtgctgggattacaggcgtgagtcaccgtgcctggccccacatattttttaacttaaaaaatcatttaagacttcagaaaaattacaaagtaataaaagtgaattcctttatactttttacccagcttctactaatggtaccatgttacgtaacaacatactgatcaacatcagaaaattgacactagtgaatattatttacagagtgctatagcttttattaaaatgttaccagtttttcaactaatgtgctttcttctgacactttccccacatattttaatgaagaatatcaaataaaaacaaataattttacatatactttgtcagagtggggattagaagtcaaaatatcgaagaaggatttaaattctactcatttgtttcatagaaaaattataaacctctaagttgttaaaatgtcttttctttctctactttgtgtgtgtaggagtagaagcagttgattgtttgaaaaaagaatcttgttactatgagcatctgtcagaaatgtgttgtttggttcactagacatcattaggtctaaccaaccttaccatggtatatttcacagaattgataaagacacctgttcttttgttcatgaagaaaagactaattatatgtaattgagtacaaaacacaaatggatttgtcggcaggaacagataagaatctctgcaaatgtaatgataaaaagcacaaaactgtgttggaacactggaacaaaaaagacaatggcagtttggagggtattaataggaatattttacataaaattaaaaagctaattattttgtttcctgagttaccataggacaagatacatttgaagaggtcaaaaatgctagggagaaaacaacaaagatattataaccaaaggtattgttctctttacctctgaacaataaaatattaagagcatttgatatggaatgggctgcctgacaagttagtacagtggaaagactggagatactgaagcagatgctgtcctggcacttgaggcaaagggagaggtttacaagaaaacccccttggtgtgggaggaggaagcagagtggtggtgggaggggcatggtttcagaactcagtgacttttaaggtctcatttagtcctgatattcttttaaaaattattttgaataggtaagataagtatgtggcaccaaattataaaggcacaaaagggcgtatagttgagaaatagcaaaacagtccctgacagccagcaggtggcttgacactcccaagaagacttggtctccttctgttgaatatagacaatttcacatttgcaattagacaaagccactgagacatgatgggtcaagataaaagcaagaccctgtaatcatgtctgaacacgacgaaaacaaaaatgtttcctaaattacaaaatgaacaaatatgtctctgtcctagattatgtgggtggctgctgcttctttaccaaacacagctttaaccttgctctgttcttcttgccttctagaaaagaattactaagatagtagccatagaattacacccacatccttagagcatccaatctggggcagattcacatatctttgagccctccttaaaaccacttgacacacacccaaatcctgtaaatcttttcttacatcctcttaccaagaaaccccagttctgctctggtgtgtatttttcctccttgccgagtgttattaaaacaaactttgttcaaccttgggtgtgtttatgatattcattggaagtcattgacacagtcaaaagcaattttcattcacaccctccattgccacctgggcacattcttgatattttcctgatatagtctatgcacttatcaacatgtacaatatctatccatccatccatctgtctttatctatctactatattgatctatcagcaccttcttttaacttaaaatgtatatctgcaagattttttcatataatacatatttaaatggataatttaaatacttaatttcctattaggtattttgctaatacaaacaatcctataaagaatatcctcctatataagtcatttttcatatatgcaaatgtatttataggatagttacctagaagtagaattgctgggtcaagggtatgtgctttcttcattctgaaagatgtcacctaattgctctccattatgcaaatttactctaaaattgtgtttccttatcatctagtcaacaaaatgtgttatcaaacttttggttttagttggttgcagtggctgacgcctgtaatcccagcactttgggaggcagaggtgggtggatcacctgacactgggagctctagaccagctatggccagcatggtgaaaacccgtctctactaaaaatacaagaaaaattagccaggcacggtggtgcatgcctgtaattccagctactcggaagcctgaggcacgtgaattgcttgaaccaggggaggtggaggttgcagtgagcagagattgtgccactgtattccagcctgggtgacacagtgagactctgtctcgaaaactaaaaacaaacaaacaagcaaacaaaaaacttggttctttgttaccttaaaatgtaaattttaattttttnnnnnnnnnnnnnnnnnnnnagaacaggaaggtcggagaacaaaagaagaaagaaatatttctatttggtgagtgtcttagtccattttgtgttgctataaaggaaaatctggggctgggtaatttattttaaaaataggtttattttggccagtcacagtggcacatgcctgtaatatcccagcatttcgggaggccgaggtagacagatcacttgaggtcaggagttcaagaccagctatggccagcatggtgaaactccatctctactaaaaatacaaaaattagccaggcgtggtggtgcatgcctgtaatcccagctactcggaagcctgaggcacgtgaattgcttgaacccaggaggcggaggctgcagtgagccagagattgtgctgctgcactccagcctgggtgacacagcgagactctgtctcgaaaactaaaaacaaacaaacaagcaaacaaaaaacttggttctttgttaccttaaaatgtaaattttaattttttttaaattatgagttaggttgaacacttgtttaagggtgatctttacttccttttctatgaactgtctgtctatatctgattctatgaaatgtcttttcttatttttaggaaatctgtatttaaaaaatcagttctttgttgtgatttaccttttttttctaattctgttgcctccgatatttttttttgccatgctttattcttttttgtttattttaaatgtgcttttctgccatcagcttttctttccaatttaaaaagcctttatttatccaaaattatttaaaaagtctcctatgttttgttttttgtaacgtattctttcttttcttatatttgatatttagttaatctggaatttatttcttaagattctctcagtctagacttctaatactttatgttcttatcagttatgaatacaaatacactttcattagattttatgaacgtactaaattcactgtgagtttagcaacaacaaacatttcaaaatgttctgtgtctgattttcagaaaaccaattggaaatgtaaaagtttagtcactcgttatgttttctatacaataccaaacatatgatgttttgataccaccagtcacaagtatatagacacagccaaagtcagcagaagcttttattgctaaactatgaacagaagtatgatccaaatggttagctgaggaaaattatgaaggaaatctatttcttatcacaagggcatgcaggtactacaaaaaattaaacagatgttctaaatttgttagaaatttgttttcattgactgtgttttaattttaaagatagtgcctccaaataatatttgtggaaaattttagcaaacactagttattttcttgaatggcttacccccttacataaaatcataaggggataactcctccagattcttcagccttggctcctcactttcttcttgatcttatatatatttttgatcataagacttctgctcccagccgggcacagtggctcatgcctgtaatcccagcactctgggaggccgaggctggcggatcacaaggtcaggtgatcgagaccatcctggctaacacagtgaaaccccgtctctactaaaaatataaaaaattaggcgggtgtggtggcgggcgcctgtagtcccggctactcgggaggctgaggcaggagaatggcttgaatccaggaggcagaggttgcagtgagctgggatcgtgccactgcactccagcctgggtgacagagcgagactccatctcaaaaaaaaaaaaaaaaaaaagacttctgctcccatgtatctttctggtcagtaaagcaaaacgagtcatttgaaatgatattctttcttatttactctgtgactttttatgggcatatttctaggcagaatacatagtatttaaaaatcttattggagctccttaaccaagtgtattcctagaaagagctgaggactgaggttgtctttgatctgtttttggctctgtgtgatgactagtgctttggccgtgggcaagtcacataaacattctctgatttatacaaattcagatagtacaacattagaggagccaagaatcactaagattttgatagtcttttatttacttctgatatagaagtaaaggtatgctcagaaaaactgattgacagcctccatttccctaaataccctttgttctgaaagatatgttaccagcaggcaggaaatcatcagtttgcaaatccctgtgtgatagtctcaaagtgtgtttaaagatctagagagttaaatacataaatgctaaaaccagaatttgggtccaagtaatctgacttgagattctttgcccttgaattagttatttaacccctctctgttaaatttcctcatttgttaaatgacaataataataatatttagatcatagggctgttgtgtagtttaaatggtttgattccttaaaagtacctagaacacagtaattcttaataaatgtcatctgctgtcattattttcatcaacagggatgagagaccccttgttttcaaggagctcatacacagtgaccattttaacagaaatagaattcttagcagtggcagctattattatatggaagaatttgaaggtgtttacactggtgggtattgaagaataagtcagtgattcataaaatatctagtccctagaccagcagcatctatgtatctgagaacttgttagaaatacacattttccagcatcacttcagacatgctgaatcagagactgtgaggctggggcccagcaatctgtgttttgacaagccatccagattattctgatgcactgcagcaagtacaactggcatctttcctctgcccccaggatttgaagtgctcacatttgctaatgaaagcaatctctgttctgggactgtgaagcctatttctatggggatctgactcctaatataatagggaaagcagaggtctgtagacactgaaattcaaactttctatcatcttaaacaatgtgtgaaatctgttacattttgattaattacttgaagagagtcaaggctcaattctggacagatatatgatcaaatataagtttggaggattacaaaaaaaaagaaaaaaatatgaaaaatatgtagcgatataggtaagcctgtatcacagatttgtatgtcttggagcttttacatatgcaaatttattttgcttgcgatgtctttgccaatcttatccaggaggcaagccactctcacccttcaaaaccctcctcaactcttgtttcttttgtccatgtgaggtcttctttagccatcttgtctcaactgtcacccccatacagaaccccacgctcactcacttcactctgctgtatttgagggttatgcatttgtttacagctgcgcaagtcacattatatactgcaattccttatctgcttttgtgttttccctattagagtatgacttccttatttgcccttctgcttagccaagcaatggagattttccaaaatccaaagagctacaaatgtgtttcatttagctggcatgcttgggaagggggaatgattgtatgtaagcaacagatgcatctacttttttccccacattttcttcctacctgcctagggcctgaagacttttcagtttgagatacctgtggctttcactcaatgtttgttaaatcaaaataacagaacagaactttaaacgaacagtacaaaccccttaaatatcaccgattgtaagacaaagtagcttgggctgtgagtcagacagcctggtttccagtccaggttctttctctaaatagctgagtgaacttatttaagtcccacaaactttctgttccttggtttacttcccccgcccctcatttctcctctgaggaatgaatcctttgttttctactctgtaaaatgaagcgtttagaaaagataatatccagtatctctgatagatctgaaattttgcaagcctacaagatgacaatgatttttgttttcacctttgaaaaatgggaaactttttattttaaacacattacaaaagaaggcaaaattgtaagagcaaatagtacaatagcttttgcattgaattggaacacagtagtgaattcactgctactttcagtgtatacatatacagatttccagcaattctcaatacccctattgccactccctagtccaagctactatcctctttgtatggactcttgcaataactctctaactggtctctttacttaaagcttccccgcatcagcctattttccacacagcagccagagtgacccagttaaaagataaaatgaaataaactcacttctttgctcaatccctttcatcacatatcattcggggtaaaagccaatgacctttttcctatgaccaataacgttttatataatctcacccgttgtctccttcatccctcctcacatattatctctcctctttctttccactggccatcttgctgttcctcaaacacaccaaccatgttcttgcctgaaggcattgggaccagctatccccctctttctggaatgtccttccaaatatctaaatagctcaatccctcataatcttcatactccactcaaaagggaagccttttctcaaaaagatcttttctagttaatctatatacatctcagtccctatcctcaatatttcagtctcctttgcctacttgaattttgttttcatctttagaatccttaccactatctaatatacctacttgttttattatgtcttcttactactaaaatattacttatatataccatactttttttattctatcctatacttgcttatgttatttctttcactaattatgccatcctctaaaagccttttgtctttgaagcctgtttctgatttaactgtacattctactttttctctgaacaaactgtacatctcttatgattttatgctgtttcatctgtatgtatttattgtgtatatgactggctgacttctttttggttatgaactacttaagggcattgacaatacctgctttatctctgtgttggcctgtaataaattcttaataatgagtaacgccttgataatggatatggataagttcattgatagtagcaatagtataatcattataccattgaaaccaaaagatttaattagaatataagcttcatgggggcaatgagctttatctgcattttgtactgctatgtctccagcacctaaaagaatacctggcacatattaggtattcagtatttgttgaataaatgaatgaaagtgaattcacagaacaaccccatcaaaaatgaatatgactttgcgtgacaatgcccagcttgaaaaattaatgctaatgggaccatgcttgcattttgtcttgagaatgacagatgatttaagagaattcaagggatgagtaaggaaattatttccattttgaaaataggaagaaaattgagtatgcttagtctggaaaagtgaattctatagcaataatagtaaaagaagacactttcgcagtgttacatatattctcaaagtgttacatgaatatatatattcatgttgacaattatagagacatcattttcttaaaataagcaaatggtatatttgcccataagagagagagtcattgcttttattattcatctaagggcagcagtataaatttaaacatatgttgcaggaaaaagaaaatacacactcaggtgttttaagaataagaaactaaaaagagagggtttcttgaagtagtggaaaagggtattaaaattttgatgagtgagaattagagatcactttaaaattcctgaaattcattaccttactttgaggctctgaagtgagagttgatttgctctaagtacagtaagtagaattcatttctactatatccatatcctgtgctccgtcttcaacataagttactgattgcaaggttgtatagatttgtccatattcttaatgaattgcagtggagtttcttatatgtctctggtttgattaagcactgtttttagccaccagctaaataaggtataaattataaatgtatactcatatggattagcattttctagggcatactaccatgaagcataaagaagaactacatatttggaatgaaggatttggaaaataaaatggtcacctacgtgtcaagcattatttcttaatctatgacttggggacatatcagataatagtaactgtttactgaacaccttctaaatgttcagtacagctatgaaaattttcaaaattgtactcagttaagtcttgtgataaccctataaaaggtactgtaatcatttctattttgaagatgagtaaattgaggcacaggaaggttaaataattagtccatggccttaaagatattaaataatagacccaggatttgaattcagcaagtttagttccaatgttaataccttcacccagtttacactgtatctcgaatttatctttcctggttaatatttcccagtgtataataaacaatctcttaaatcatacctctgcattcttctgacaacactttcaaaaggcattaagaaggcaacgtggtttagttctaaaatattatggaggtttactttagacaggctaaacagtgaacttgcaaggatttttcttcaatgtgtttgacgtatttaaaatatatattaaaacattttttagagataataaaccattatacaataattttaaagattttaaataacctggttgcctatttcatatatctgatttgagaagtttgaggtgtgtaggatgtgtgtgtctttatgtggatatatattttcatgtattattcagcagcctagatagagtggtactgaacaggcatccagccaagatctagcgaggttgcacttagtacatctgcttcccttgacattgagaccgaatctggaacacatacctatgtgagactatgtatgcacagcattattaagcccactccacagtattacagttgaatttttacaaatatcctaaagagaactccttgctccttcctacttaggtacgagcagaaaacatcacttttattgtttctatagtatataccagggatcatttcccatacttgaggaagcaggatagtgttataaatagtccatttgattttagggacagacaatcatggatattaatatgagtatctccacttgccagctggataaacttgggcaattagtttaacactttgaaaccagagttcctcatccgcaaaatgggaataatatgtaggagatttaagttaataatatcaaaatgtactcttatggaaggaagtgccttggaaagtctcaacaggggaaatcaatgctgactgaagagtgatcaagagccatttcagaaaaaatgaaggacttgagcagagctttgacaaattgggtaagaagccatttttgaaccacatctgtagtttcagcactcttttaggccttagaccaaccttcttttctttggaagaattgatcgaagtctaatttagataagattaacatctagtgcacttggagtttccctctgaaggggttggaatatacagttacatatggtctcttcccagtctttgacactgatgatctgggcagaaaagccctactgagacgtaaaggaagacagcagccgctcctcatagatccaggttctcaacaatggctccaaaatctttgtttttgaatcaggaagtctgcaggaggaccacactttgagaaccaagcacacagcacttctcaaaactttaactgcattgtaattgtgttaaaatgcaaattttgattcaataattcttggatacagcctgagattctgcctttccaacaagctccagatgatggtgatgctgttcacactttgagcagcaaggtttggttcattgactggtaagatttgggaagaatcagtatcgcatgtgagcttgctagaactatcccagactattgaatattaaattgttttcaacaatgaagcatactggaataatctggggagttaaaaagtacttgtcttcaattccaggcaattttatttaattattatgagtgtagtctggacatcagaattttcaaacttttcagaaggttttaatatgcagcaaagtctgtgaaccattaagctaaattacctctggagagttggtttttttcttcaatttttaaagtttgcattccaaatttgtattattataactttgagtcaaagttatacaataagatattgattttaaagtacggtgcaaatcatcgctgtttttatggaatgtttcatgctattttattataaaaggaggccctcaagtgggaaatgacaaatcaatggctgaagtaccccttcctgtgttcactgcagacatcactaaattctcacaacattcattgttgcctggcttcaaatgtctccttaagacattgtttcaggcagctaccacaaaatgattgagttttcacatatgcctgccatatgcatgctttattttcattaataccaacatattgaaggccaactgcgttctagttactggattacaaaaatgaatctgatacaattcctgccttctagcttttcccagagcataaaaggttttacattttaatgtaaaacaaaaggtgtcactggtactaccaagtgattagaagaatcaccagatttcagagatctaacagatcctcaaaagccatagtgatcaacaagtttggttttaacccaattcttgaagaatgggaacaaaataaataaattaagattaggacagttgtatttcaggtaaggaggcacaaaatcaggaagtggagaaagctcccaccatgtaagggaaaaattaacccactagcttgcatgaagcaaagagattatttggaagtatcatggggccatattttagagtgtcttaactgacacttaagggagtgtaagctttatgttgtaggaaatggggaaccaatgaaagttattgagcaatgagtaaaatgcaatactttagaaaaattttctaactggagtttatagtagacatgggctgaatgagagattttgaagtagagaatagtaaggacaaaataatcattttatttttcaagtccttttttatcccttaatttctaaaaaaaaaaaatctttccacattatgtttatttctatagatccacttaatatttttggaattaggcagtcatattttcttatttaggtattaatgataacaacgtgcaaagctttgagcatatctaaatcaactcaaataagtgtgcttgtgttgcctgtgtgtaattttatctaagaaaaactaaagattttttaccttttgagcaggatggttctacttggctaaaacattccttgtaaggttttcacattttcttattatagtctgtttttcctactttcttcacaactacttgaattgttatcattagaattttatgttatatcttaagagcaacaatattttacagctttgtagccaccagaatctaggttcacagcttagctttttcactagctgactttataaccttgggaaaacagtatctttgagtatcagtttcctggtctgtaaagatggatacatattacacatgtggttacttttatctattttagactttaactactatgatggcaggtaccatctctgtcctttctaccactgtattgcaagtgcctggcacaatgtctggaatatatgtgatgaattaatgaataaacctagtaggccatagtattgattttggcaacatagtttttgatgaaaggtttatagaggatgcaaatctaaaagcttcaaaacatgcaaagatttcttggaagatgtttctgcccattgatcttatggaccgtcacctgtgctgttcactgaattcttcagaccagacgggctccaagacaagtctgtgtaagacaaatggctccagagaatgagtaatgacaggcatttgctttcattatcaatagtgatatgcctcatttttcatcttaatgaaaaaataatcacgtttaattgacttgttaattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcaagttacatctttcctttaatgtctgtaagaaatgctgttttagagggttaaattcagtaacaacaattgtttaggctttattttgaaatgcaatctggatgcaaaacaacaacaaaaacatgttatattctatgaatccctagttttcagggaaactcagacaaacatataaatattaataagcactgtgataagtgctatgtatggaatgctgtggaattagggtaagggaatgaataattaatttgcctgggtgaacattccattgtaccataatttatataaccacttttgtattggaagatttaagagctcactcctttgctgtatattcaataatagcattttcctgttgagaatggggagggtgaataattgacttaagtaaactataaataacagaagtaaatattaatttcataactgaggaaaaaccaattgagtggcctgcaaatattatgaatattataattatagatattattgtgagagactataggatttattgtaggagaaaataacctggtactaacttaactttttatttaagattttgtaggatatgatcttattcacactctaataaaatatcttgattgagaacattgtgagatgtgggaaatgatattgaattttcaaggaaatctaacattgaaaatgcacagattataaacccaaatatctccattctctctcagtatgttccacatgggtttttaatgggtcacaggatgaatcttttttattggccatttgacaaaatagatctagaatttctaaatacaactgtactcttttatacctttcttcgttacaagcaatgagtctgtccttagaagttacttggaaagatactggatttacatgttccaaagacaatttgtaatgagcttttttttctccttccttccctcccttcttcctccctctctccctctctccctctcttcctcttcttctctttctttgaaactttcttggttgtcacattgttttcctatgtgttttggattgactgttacctttttcttactggaataatatggtgtgtacaggtagaaattaagctgagtaaaacatagcacttttagaaagtacattttttggtgcagtatcattggacaggatgtttattttttattttattttgttgagacagaggcatgccctgccccgttacccaggcaggagtggagtggtgcaatcatggcttaactgcagccttgaattcctgggtgcaggctatcctccgacctcagcctcccaagtagctgggaccacaggcacacacacatacctgactaaattatttttgtttttatttttacagagatggagtctccctgtgtttcccaggctagtcgcaaactcctgggctcaagtgattctcctgccttagcctcccaaagtgctgagattacaggcatgagccaccacgccttgctgacaagatgtttaatatctcaattgtaacagattccccaaactctttccttcctcttaattccctccaaccttgcatcactctacacacacacatactcctacccttaccaggcctatgcatcccatgattctgccatttcagactttgtaccatgtaggttttttggctttcctttagtctatgtgtaatacatattatcttccatttttttcttacatgcttaattataaaaatatgactgagaaaagttatgaataaacatgtgtaaggagaaactactcctaattcatttatttattcagcagatattgaataacagcttctaaaaccaagatatcatgctaggcattggggatcataataaaagtttctggtaccttcaacttgcccttaaagtagtggaaacctcggaaagattcacagataaaagtcttttcactggagaccacaactgttatgttcgtcactctttttttagcctaggcatggtatttggcatacagtaagtcctaataaatatttatggtaagaataaatgacttctaagtcaggtttttacaagtgctgtatgcgagttcaactttctaaggccaaggtcctactccaaatgttaggatggtgctttacattttctcaatttttttcactttgtacccctcaaagaagttaggacttttatatactgttcaatgaagctattttaagtagtcaaatactgagtttataataaaatgacatttcgcatatcaaaatgcctacctagcaggatgcctgaaaaaatagacagtcaatgaatattatctatttagtttttcttttctcatttgttactttctctcatcttctccttccacttaaatttcaatatgagaatgatttaggttttgtaggtcctaaagcttatcttatgtggggttctccctcgaaaaaataaatataatgaaatgaaaattagatgcaaaattgagtatttagactgagaaaatataccacaacagtttaaattttgaaaagctgagaactatcaaagatgatacaactcaggaaaataatacaacattttaattaattgcctgatagcagcaagtctataaatttccttcccattattatggatatataatttttgaatgtctttccatatgacaacaattttattatacatttcttgtagagagaaatataattcagtctttcctgtagcatgattaatcaaagtgatcctttaatattttataacttggaagtgtttattttaggttaacagctcataattatctgatgattagtgatgttgagtatattttcatatacctgttggccatttgtttgttgttcttgagaaatgtctgttcaagccctgtgtccattttttaattggcttatttgttttgtttttccttttgagtcataggagtttcttatgtattctggatattgaacccccaccagatatacaatttgcaaatattttctcccattccataagttgccttttcattctgttgattgtttcctttgctctgcagaagctttttagtttaatgtaatcccacttgtctagtttttgctttcatttgcctgtgcttttcgttatccaagaaataaatcattgctaaggccaatgttgactttttcccctatgtttttttcctatgggttttacagttttaggtctcacatttaattatttaatccattttgaatgaattttatgtatggtataacataagggcccaatttcattctttcatgtgtgaatacccagttttttcagcatcatttgttgaagagactatactttctcttcattaccttttccattaccttttttctgtgaagttttatgaatgagcttggtttatggaagccaagagtaccagctccattatttcatttttcaaaatacaagagtcaactttacaaaaagatgtagaacaagatactccttttggaaaggacaagtttaagaagatctttgaatgtcagattaaatacttggactctatttggcatataattgtagtattatttagtctgcaaatgtttactgggattgctaatatacacagaatatatactaccctgcatattctccctcttgttttctctgtctctatctgtctcctcccttccttgtattatacaagtgtagttttgatgtgagttttgttttggagagcttacaatctggttgtggttggcagaggaaacagattttttagaagaataaaactataaattgtgataaatatagtctggatccaggaatagggcagctaagaagtgaaagaaagcacttggcatttggtgtgtcatttcacgcatgtcagggatttcagtgtgaagatgtagggagagtgacattccaagcagagggagctaagttagcaaaaagatggagtttagaaggtaggaggaggaagatcaaattactagaagcactcagtattggagtgaaagtgccatgtagcacaaatgtatgttgtagattaactttgagtatcaggctgagatgctttaagtttctaatttcatttttatcttaaaaagaactttcattctaacaagaaaacctacattcctggaaataacgtgtttttgtcataacccatataataacatttatttaataaagctatgtacatgtacctgggctagacattacagcaactaccctcaagagtcttgcattgtagggatggagacagagatataaacaaagaactctaaaaccatgttctaaatatcattaccgaaatatacacaagaaataagccatctggaaaagggaagtattatttctgaagggttttgggcaagattcatgggggagttcaacaaggtaggccttaaatgatgaaaagagttggccaaatttagaagtgggaagataagctttccaaaaagagatagaggacaaaagaggacaaactccagcctagttaaagatcgagggggaacttaggaaatggcaaaaagctctgtgaagccggttacagcagatggaaagggtgacaggtgataagctggaaatgtgggttggagccaggttgtaaaggacattggagacagggaggaatcactgcaggttgtaagcaggaaaatggcataagaggatgcaagggacttaaagagtgggtggagtcaagcagcccagttactatgagttaggacagtggctttgaggagtagtgaaaggagtagcaaagggctcctgtgagctggagccacagtatgctactctgaagataattaatagataacagtaagtcatttgccaccttttgggacttttaggaggcagatgaggacctttccagagaaactatgtttagcttttaccaataaagtctcgtttcaaatcgtttactgatttttaaaaatgggcttagtaagtctcacaaagcaaaccagctaaaggccattatcatgttgtggttcatataaaactttcaaacaggtttcttgtttttgtccctgcctagcattatcagttttctctcattccatgtaggaaaaactttatagttgcttttccttctatggtcagctacataaaccagtgttcttagcatttatcctgggaagtcttttctccttctcacagtaattatcagtgaacttaatcgttttccagtatctgcttttatttaaaatgaagtaccttgcatctagttcatatcttgcatattaattctgctttcattagcatctctatcagttaggattagagttggctctgcatcgcacagactaagagaacaaggacttattttctcacgtaaaagccagacctgggtaattgaatgttggacttgtgccactgctccacaaagctctcagggacccagctccttccagctcacctgccaacacccgctggggagtagtccttgtttttttggtttgagatgatccagctaccatatccccattcaaacagcaataggcaaaggttgagaaggggcacaaaggacacctttatgctgtctttaaggaaggattcctcaagcttataatgatgtgatgacttacatctcattggccagtagtgggtccataggacctacatctggttgcaggatatgttagaaggtgtagctgaataatctatttatttgcaagaaggcaaaaatggatattagaggaaattaaaagaacaaaaaggggaggccgagacaggtggatcacaaggtcaggagttcgagaccagcctggccaacacagtgaaaccccgtctctactaaaaatacaaaaattagctgggttgtggtggcaggcgcctataatagcagctactctggaggctgaggcaggagaattgcttgcactccagctggatgacagagctagactctgtcaaaaaagaaaaataaagaacaaaaagatgaaatatgatgttttgaacaggtaaccacattagggagcctgaaagcctttgtttagatgcattttcccctgggttaactctaaatctttttgtacttctataaattaaggtaatcattctgtcctaaattcttcatagcatttatggttgaggatcaaatacaattaatgaatgtatcagcactttgaaaattaatcttgcacaaatataaggtattagattttaaagctttaaagcaatctgctgaatataaactaaaaaatattactgaggtaatatgtcagtttttacaatagtcttatggtaactttatctgacaaacagaagaattaggtattcatgacaaatagctcttagagaggatacatctctgtgaatcactttcagaaacatgacaatgcatttggttctatcaactctgtgcaataagcattatcatgtccattttacagataggaaaactaaggcagagaagttaaatgaatagctcaaagccaagtgactgagtggagggtttagaaactatgtgtctgcaaatctcataatctgtgttgttgctctagttttcatatgtcacacgtcttgttgcctatttggtaaagtccagatatctaagattagagtgacagactcggttatttatccttattttatttacatgctgttctttctcatttccccccaatataaatcaaatccaccaatctgccagtccctttctgcatacacacattactctgcaaaaccacctaacttccacctcactaaaatgttttctgttcttggctttctcaacttccgcttctttaggtgtcaactcaggttccattttctgtgtaaggcattccatgaatacttcaggccacacagagcttccattttcctgaacttctgtaacatagggaatatatatatagaatgcatatattacatttaattatagaagtaaattatacactgtatcatattattccatatgtcttagctttttctccccaactagactttgtctagttcttgtatttcttaagttgtttcagtaacacaaggacactggtaagaatatagcaagaaataaaaccagttcaaatctaaattgagccaacaattaatctataagaaactacttacagtttcttatctagtctcagttttcgtaaaaaatgtggaaatggattcaaagaggcaaaaggactgatccgatgtcgacagctaagaatggaatcctgttctactaaacttgtggtctaagacttgatcctctacaactgtcaattgaacatttgactgaaagccaaatactgtgagtgtgtgtgtctgcatgtgtgtgtgtttagcttactattgtaggttgagagaagccgagaaaaatagaggcatccctaaataatggtagcccttgggttaatttatgtgtatcttgtattaaaaactaagaagacgagaactgataggaattttatcaacagaaaaagtggataagaacttctaattaagccaggatactgaaatgaactgcagagatattctcttatgcatacagccgtgagatacttaattcatctccatgttgccatctatagagcctaactatatgattgcttttcttccatatgcaatgtgaattgtttcagggtgggggcagtgttttctgtttatgctcatttcgtgatctcaaaagtaactgaaataatcccaaggacagaaaaatattgttggaagaaaaatagaaggttctcttaggtatctttttttctgatctacgaattccttctctaagtggacatatagactattgagtattttgagtgatgagcaactcgaatatgtaaagactgcaagcatgtttccatttcatcttaggatgttgaattacttttgtcaaattaattcttaatggttttgagtatatgtgtgtgtgtgtgcatatatatatgtgtatatatatttgtatatatatagtatgtatatatgtgtgtatatgtgtgtgtgtgtgtgtgtgtgtgtgtgatttcccacctggatataaaatatatccattacagcttaagctatctatcaatcatctgtccatctgtttatctctgtttatttacatgtaaaaaattgagatatcaagaaaaaagttttgtctgaatgttatcaccaataagtcagtaatttttgcattcttcttctgtgttcaatataatgtttggaacaacaaggaaaatactaaaaacaagaagctttggcctgttttaaagatagtattttgttatttcttgtgactacagataggttttctcctgttgagaatttttcggtccatattatttgtttgttagaaaaaattatcttatattacactgtttgaggatcattttaaggatcagggatcctgaaatctcagatccagctgggcctttagagaccttctaatccaacccctttagtacagagtttatgtaatttacctgaagttacataggtaattaatgctggtgcagggtcaagaagtcaatttctctcgtttttagacctctctttatttctctctccatttttctaccaagttcaattaataggttttaattctcaaaagaatgattataagaaggattatttattcaaaaggtcactgatcctttccgcccttctttttctccccccagctctcttcaatctaattcccgtgggcctgcgtgtagtggccatccaaggagtgaaggctagcctctatgtggccatgaatggtgaaggctatctctacagttcagtaagtacattgtagtgtgtatttgtgtgtatgtgtgtgaactaccactgagaggtaatggagtaaccatcatgttaggcaagaaaattggaagttgaagtcattttatattttgtgatcctgtttttcgggattattttgaggttttgtaatttagagtgttaaggaccatgtcttgttgaatgagtatattgcagttactctccatgcgatataaattctttgtgtctagcttccatttctgcaggatactctccttttggaattttacctttctgtttaattcaaagagcaagacatttttcttttctcttgttatctctcctttaagcatggaggatggctcagggaggaaaattcttcaatttgtctggaaatagtctctgtcctaccatggagaaaaaaacgttcataatttgtgaaagattgtggctttgtttgtatttagtaggtctatgttttatctaatatgtcagattctcagaataactttaatttaaaggcaatatgaatttatggaatgagctctggattacgagcaaggatatttgagttttatttgcatttcatttactatcttgatatccctttgggcaaattatctaccttcattggcttaattttggacttttcaaatgagcatgttggacacaatgttgtatcatgtctttcaaatcccaaactggcaaaattaggtagccatcagtggctacattatcagcactgacatattttaaagtagcaaacacaattatgatgcttgtctcactctcaggataataatttatgcgttgagagaatgtggctgcactgaatggggtgtgtgtgtatatgtgtgtatttccgctttcttgtaagagagttggctatttgtagttcatgaaaaaaattccttgaaaatcatgattacagatttccacccttactttttatgatctcagtaaatagcacaaggttattttggaagtttccatatgtctgctggattctaaattagttattgactaattttcattaggctcttccaatgttcaattaaacaaaactctggtaccttggagctcagaaattgatactctcaaatatggtgtttttacatgctgcacagaagaagcagcctcaagtctcctctgaactccgtctgcctcctgtgtcttaatcctgtctctcccaaagcacaggatgaagttgttctctggagttcccttatctgcctaagctcggacctgccaaagaagaaaacaattacctttggtctcttccctgagttttcattaactgaactcgtatcacaggaagaaagacagaagtccatcaatacacctagacagcattttgtcacaaaccatggtttactctgcagacccaaaagactttgtcccagctcattgtatgttctttaagttcattgaactcccccccaaaatcatttgctgtcgctgtaaaatcatccacacatccccatctccctttcctctaaaaagaagggtatataaccatgtgtaccacatttcgcatggtggggtaatcaccctgtaattctccccagtgcacattaataaatttgtatttcttttctcctcttaatcagccttttgtccatcgattttcacttaagctacagagagtgaagggaaaattttcctttagctccaacaggtacatcatacttgcttattagtaatacatctgtcatttgtattacaattattttttttactcctgaaaatattcagatcaaaatatacactatattttgtatttacactataaatatgctatatgtgtacatataccttttttcaaagtttctgcttaaaataacaattaaatacattttcagtcaaaataatgggctctcttagtgtgtcacagctctaacaattcttaatgtccagttattgtgagtctattttaaatgtaagaattaaaattaaaaaaggcaagaggatgttattttgaatatttctagttagtcttactttaaagatttaatcagtcattaaataagcagctaaatgtagactatattatgtatatttaaaaagtcataattcaggttataattccacagaagctatagagttcagtttattagactagaattgatccccaaaggtccatgaagaagaaaaacacagaaagtttgacaacagtattgtaagcaggagacaattgtataagggaaggagggagtttggagggattgctgggttgtggtttcatcctctgaagcttttcagagatgcattccttctgtccttcttgcttagttctgaggttacgagggggtgggaatcttgagccaaaagagggagtttcttttgtaatggagtttacctttgtaaacctattggggtatctgtattttcagttcttctctcgacttaagtcaaacttgcctcacatctagaatcacaatgctttcgcctcgtgagttaaaagtcatctgttaactttgactttcctgaggtgtttctggtatgcattaaggctagaatttctttgaaaagcaattttctatgtcgtaggcaacactgtagttgggcaaccaataagggtcataactgcagtttatggagagagaggagagtgctgaagcaaactaagaggacctacataagctaatttagaacccaaaagattcacaagcagtatcatttatctagtgtcatttacctggcttctatttatttttaagctaggaattaataggaagtaattcccttgttacttttgatttctatttcttcaccaggaagcaggaggagagagtgtcaaagacggagtgagtgttaggtagcacagagctatagttttaagagttgttctgaaattttgtgttttaatagatgagtttaatccatatatatatttgatgagattattgatgtatctggatatgtttttaccataatagtttgtatttttttaaatttccttttgtttctcttttcttttttaaaaaattctgttgctttattcacatttttttattttattaaattcttctgcaagtttgtaacctcaggctgtatttttattcctgtagtggttagtcttattttttttaatcatacataaatcacgacatactttgctaaatattttttagtgtttctgtcttcctttccaacagcttatggaggttacagtgttttcttgctagtaaatatcacaacctttcttgctgccagtttgattagttgcactttaaaataaaatcatatgcacaattagttatgttatagctaatcgttaaattaatgaatgttttgaataattttatgcatagaacttttgtttgtgtgtgtatatcaaatttggtctctgatttcacttttcttctaaactaaacctttaattgttttgtgtgtgaaggtgtgcggatggtgaacttgcttttggtttccatgaaaatgtcttcctttcactttcattcttgaattgcagttaaggtagttatacaattctgagtagaccaatatttttctcagcatttggaaaataatattacattggtttctggtatctgttgttaattatgagaagtttctcatcagtttaatattctttcccttgtaggtaatctctacagaccctttattccatcctggaaaactaaaattctgtatacccattgaacaatagctctctttcctctcctcccccagcccctagcaaccactattttttacttatagttacaaagaggttgactactttagatatctcatataggcgggaaaatgcagtatttgtgcattttgtaactggcttatttcacttagcgtaatgttctcaacattcatctgtgttgtagaatatgacaggatttccttctttttaatgtttaaaaatattccattgtatgttatacgcattctgcattctgtttatctattcatctactgatggacatttaggttactttggcctcttggatatgagattactgctgcaatgaacatgagcgtacaaatgtcaagatcttgttggattatatggtaattctgtttttgtttttgtttttttttttttttttttttgagaaaactccatactgttttccctatcagcagcatcattttaccttcccaccaacagtgcacgaaagttccaatttcttcacatccttgctaacacttgatactttttgtttcttttgatagtggccatcctaacaggtgtgagatgataacccattttgttttgatttgcatttctctaataactagtagtaatgggcatcttttaacatacctgctagtcatttgtaaatcttctttggtgacatgtctattcaattcctttgcctactttttaattgagttgttttgtgttgttgttgttactgagttgtaggagttctttatagattctggctattaaagcccttatcagatatatgatttgcaaatattttctcccattctgtaggctaccttctcactctgttagttgtttctgttgatacatagaatttttaaagttgcatgtagtcctatttgtctatttttgcttttgctgcttattgttttggtgtcatatccaagatatagttgccaaatccagtgtcatgaaggttttttcctatgtttattctaggaggttttttgtttgtttgtttgtttgttgttgttttgttttttgtttcttgagatggagtcttgctttgttgccaggctggagtgcagtggtgtgatctcagctcactgcaatctccacctcctgggttcaagcgattctcctgcctcagcctcctcttatgcagagatttgtaatccattttgaattaatgttacatgtggtgtaaggtaagggtccagtttcattcttttgcatgtggatatacagtttttccaacaccacttgttgagaggctaacctttctccattgtgtaatcttgttgaagatgatttgaccacatattaaagggtttatttctgggcctctctattgtgttccattggtgtttgtgtctctttgtgccagtaccatactgttcgattaccatagttttccactacattttgaagtcagaaggtgtgcgacctacagctttatttatttattttttcttaagatggttttggctatttgaggttccttgagattttatataaattttggaatggagttttctattagtgcaaaaaacgacattgagattttgataggaattgtattgaatatgtagattgtctccggtagtatggacatttgaagaatattaggttttctgattcataaacatgggatttcttttgacaatgtttagtagttttcagtatacaagtttttcaactccttgattaaatttaatctcacagtgccttttagaaaggaagaccaaaataattttaatggtattaaataacatttaaaaaatagagtaaataaaaagttcttaatgcatctctttctcaaacaaaagaaggttaagcatgttggaaacttatgtttctgaaacacctttttcgatagttcaggaaataccattctgtgttacaatctgttgaaacagatttttctacaaattttaccttatacatagacagtgccttttaaaaattttgctgtttaaccagttttgatttaaaatgtaatatcctttaatgttttattctttttgagttttaaaagtttttgacaaaacttgtaagaccacctaaattttctcaaatgatcacagtgcttaaaggcatttcggttgggagtggtgaaggagaggtatattttcattttatacaggaaagacaaaacccaagtaagccctcgaccatcctctgtaaattgactcacatctttttatatttgagttgtttgaactgaaccttgtataaataaagcaaatgtagataaacatcatttggtatgatattataaagctagattttcaaattgtggttagaacactagtgatataatattttaggtaacttgatagaatgatacatgtgataaaatatgtaaagagtaaaaataagacttactaaagtgctatcactgatactgttatatttgcctttttctcttctgtacctatgtaattcataattttccttaaagctcagctcaaatcttacctgatatgtcacctgtctccattgtccatcctctatgagaattagatgctacttctgctgtaatatctgagcacttgacttttattttgctggtgggcaggaattacatcgtattcatctttgctatctgggccatctgggccacatatttggcccaaccacagcattaaacacattccctggtaaaggaagattctcagtaaagacttgttgaattttgaagaattgcctatttcaagtatagacggaacaaatttcatacaattgttgcacaattaactatgattacattgatcaaagtttaattggtagtcttacaaaccactgcacaaatgctggtttgtcctcaaagcaatctcagtaaacctaaaatttgttcaatacatactgattgaaagtctaccacatctcaggcaccagactgcatactgagcatataaagatgaatgaaatagatacaattcttatcttgttatagtttgctcttataatcataattagttagctgtcataaggagtttaggccaactactaagttagagggcatagtcctcaagaccaccctcacttctggcaccaactgcaagtttatggcctcacagaatcatctttagattgataactttccagaaggactcacagacctcactgaaaaccatggttatactcacggttacagtttatctttgagagagggacagattaaaatctgccatgggaagaaatacctaaagcaggattcagtagaagtaccaaatactgagcttctattgtcgtcttcctgttgagtcaggacatgttactcttcaggtaccaacatgtgataatacacatgaagtgtcgccaagcaggaagctcacctgagcctctatgtcaagagatgtcattggcgtctgttacgtaggcaggattcattcattgcgcatgtgcttgatcccagcctctgactccacagatattgtgtgacccaaagcccctaccctaaatcatagtgttattctctatttagccgaaggctctcaggaaaacacaaattaccttccagaaaccaagggcaatggctgcacctctttttggacaagttctttatgtgtccaatgtccaagtgaagtgaatgccatagtccataaatacgtacctgtgactctgcttccagtcccacgccctcactcatctgactaccgtctattttcttaccccagctcagaagaagaaaataatgaaagaaaagaaatttatgggtgtaatatctggcatatcagcacttgggaaataaaaatataacttactgctttgtataacttaggagccttgacattcgcatctaggagaatagcacttaaaaataatgcagtttgaacctggacaagaggtgagaatctgtctctacaaaaaatttaaaaattagctggggatggtagcatgcacctctgttcccagctacataggaggctgaggtgagaggattgcttcagcttaggacatcgaggctgcagtaagccacgtttgtgccactgaactccagcctgggcaatagagcaaaacccttcctcaaaaaaagcaatttgtataatttgaaacatgtctagaacgcataactaggcaaacattggaccttttttaatgaatagtttgatgtgcttagcacacttatcgctggcattttagtggttaatattggttataatgtttttaaaaggtttatttttttcaaactatagcgatgatttgtttactttttataaacttagactatttattgtccaaatctgaattaggtagtttatgaactaaatgagaattttttttaactaaaggataaactaaagtcaaattgtgcgaacacagttttttgtttaaacagggccttaacctgtaccaattatatttgaagctgaaatagtgataaagacgcttattttagtcagtctatattctaataaataagtaatattataagttcttatcagagtagctgtaaccatgagaatcatggtaacaatattaatggctgtgctagtgcaaataatacagtgtacttttagtttttgttgtttctgaaggacttttagatttgtatttaatttcaccgcaactctgtgaggagggatggaaatgaaccagtagatattgatgaagagctgaggcttagtgaggtgcttgacttaaataagcccactctggtgactaatagaactagagttgaaatctaggtcttcacgtccacaaccatgagcttttcataataccatactgctcttggccttatgtgcaataaaacctttccattggaatgcttctcatattttcccatgtgctttcacataaactgtcacatttgagccttgcaataactctattattgctgagtgacaaaagtatgcctgggaaacagagaagtcatgtgactaaaatgaggtcactcagcattgtgaggcaggttaagaaaaagcaacttctagttcaatattcatttctttaatcaatattgcttctcctatttgctgttgcaattaaggatgtgccatactacagtgttccaacataatataaaaagcataattctttgaaaaccggggcagcctatcaccttgtttgtgatggctttattacagtgataacaccaacaacaaaaatgaaagagagactgcttgattgatgcatgtcctctgcaccattgggaatttctcccttaaagtattgccttggtgcaagcagacaatgttaagattgtgagatgacgatactgattttatattgaaaagctgtgtcaggagttattgagaaacatgagttgggggtggtgatctctaaggaagaaaaatgaaagggccgctattggtaactataaggagaggactattttatgtccacaaggtagatgatgggagaaagtggttgttattccctcctctaatttcttttacttcctcactatcatagatatccaaatttctcccatcatttaggacccagtaaacattttcccaatttctgcagccccaaataacttccacattttatactttgatgggacatttatctctgtatttcctttcttttgttagaatttgttcttaatgctttttatatcttatcagatgcaaattccttgaggttagggatcatatctaatatagattaatatctctcatggcactgaaaactgtaattccaatgttcagacatctgctgaagtctagttgaatcggttgatagaggcatcatacagtttaattttggcaataattcactggctgtctggactcaatgggctttataataattttcctgagtatgaccctacacactttccagttcagtgactagttcacttttgagtagtctgtttctattctactgaagcatgtaaagtttactcgaggaatcttagtgttcatgcttccctattgaggctgatatggtgctgtagttttaagagctgatattgccatgtttttctttctgtactaaatactgtttataaaaggtaagggagaggtaaagattagccatgatatcttcctgggaagccacctggtttttacagttaatctctcagtgaaagaattctgttccatcctaaaaagatacgcaggctttataaaacaagcatatctggagtagaggtacaaagcagttgcccactctggaatttgagtttccttatcaacgtactttctcatggaaagttctgaaatctgaggcatattcacaactctttcttgggacagcaagtgagtgacgtctcagaaaagtgaaagacgagagagagagagaaacaagaaccttaactattaatgtcaaatgaatcatagaatttgaacttaatgatgcctaaatagagaaaagtcaaaggccaaatcttaggggcttgttcaacaggtagattgttaaatattcagtttagatcatttacataattttttcttctcatatgctcgtgatttccttgacctttgtcacattcctttaaaaaaattggggggtatagcacttggaaaaggattatctattttgcctatttcttttttcaccccatatatatttattaaatgaactggaaattttttcagttaaaaaaagaaagaaaatatggaattctgtcaacccaagaacctggcaattatcgcttgcaaacatgtgacatgggttattttttgttgggattaggttgtcttttttcagaaacaacagattattagttatactttcagtaaggattaacagtaagcatccatttttaacttacaatgtattcatagtaaatagtgttggttttttttctaagagtttataacttatggaaaatgttaatactttagctccagggctaaccttaattggaaaattagcatatatgtttctagaaacatttttcattagaaaataaaagcaaggctcagcttttgagagcagcactaatgaggacctttggttaaattatttgaatatgatgccagattttatatttttcttttccatcttgtcattagccacattaggccaacaagtagtcatatttccaaagtttctagattgtatttctttagtcatcagtgaatcagggaatattaagtagtaatttaaaatgtaagctttagaaataaaactgtgtttgaatcatagccctgtaacttacttcctttgtgaaaaaattggaaagttttttaactttctagattgttttcttatgtgtaaaacaggggtaataatgaggatatggagctgtatagaattgtgtaaggattaaatggaaagatgcacgtaaagccctagggcagtgtatattatgtactcaacactcagtgttagccataagcagtaacagtagcagcagtagatatattttaaaaagatgcttggtgtaccctcaaacagctcctgagcatcaatccataaagtttctgtaggattaatctcactgctagttttagtgctggttcctgctttgcctaatcaaatatctttagtcactctggtcttgggggattgcttgaagagtatttctcatctaattagggcaaattagcttcaggctcaagactttatctgttgaaagagagttgcattttattattattattttttaattttaagttttgtgggcacgtggtaggcatatatatttatggggtacatatgatattttatttaattaattaattaattaatttttttgagacagtctcgctctgtcgcccaggctggcatgcggtggcttgatctcggctcactgcaacctctgcctcctgggttcaggcaattctgcagcctcagcctcccaagtagcagggactacaggtgcacaccaccacacccagccaatttttttgtattttagtagagatggtatttcactgtgttgcgcaggctggtctcaatctcctgagctcaggcgatctgcctgcctcagcctcccaaagcgctaagattacgggcatgagccaccatgccctgccacatgagatattttagtacaggcatataatgataaataatcacatcagagtaaatgaagtatccattacctcaaacacttaccctttctttgtgttacaaacaattcaattatactcttttaggtaatttaaaatgtacattagcttattgttcactgtgttgggctatcaaacgtttgatctgaaacattctatctaactatatgtttgtacccatcaaccaaccctactccccatgtccccctttcctggcctctggtaagcatcattctactctctaactccatgtgtgcaattgctttaatttttaactcctgcaaataagaacatatgatgcttgtctttctgtgcctgttttatttcacttaacgtaacatcttccagttctatcaatgttgttgcagatgacaggatctcattcttttctgtggctggataatattccattgggcatatataccatatcttctttatctattcatcggttgatggataggttgtttccaaatcctggtattgtgaatagtgatgtggtaaacataggagtgcaaatatctctttgatatacctatttcctttcttttggatatacctagcagtgggattgctggatcatatggtcattctatttttagtttcttgaggaacctccatactgttttccataggtgtactaattcacactcctatcaacagtgttgaagttttccctttcttcacatctttgccaggctttgaagttgcctgtcttttggataacagccattttaactagagtgacatgatatcccatcatagctttgatttgcatttctctgatgatcaatgatgatgagcacctttttatatacctgtctgccatttgtaagtcttcttctgagaaatgcctactcagatcttttgccagatttcagtagtttcatactttgaggtcttagatttaagtctttaatctattttgatttgatttttgtccatgacaagagatagaggtctagtttcatttttctgcatgtggatatccagttttccaagcaccatttatcaaagagactcctttccccaatgtatgttcttggaaactttgtcgaaaatgagttctctgtagaggtacgaatttatttctgggttctctattctgttcatacattggtctgcatgtctgtttttatgccactaccatgttgttttggttactatatctctacagtataatttgaagtcaggtaatgcgattctctcagtttttaatttttttgcccaggatagctttggccattctggggtgtgtgtgtgtgtgtgtgtctgcgtgtggtttaatataaattataaattttaggattatttttttctatttctgtaaagaatgttgttagtattatgataaagattgcattgaatctgtagattgctttgggtagtatggacattttaacaatattgattcttccaatccatgaacatggaatatttcccatttttttgtgcccccttcaatttattgaatcaatattttatagtttttattgtagagttctttcacttctttggttaaggtaattcctaggtattacatttcatttgttgctattgtaaattgatttttttaaatttctttttctgattgttcactgttggcatatagaatgccaccgatttttgtatgttgattttgtaccctgaaacttaactgaatttgtttatcagctcgaagagttgtgtgtttttttttgtccttaggtttttcaaatatactatcatatcatctgcaaacaaagataattttacttcttccattccaatttggatgctttttatttctttctcttgtctgattgttctagctaggacttccaggattatgttgaataacagcagtgaaaagtgggcatccttgtcttgttccctaatcttagagaaagactttctgcttttccttgttcagtatgataccagctgtgggtctgcgatgtatggcttttattttgtcaagatatgatccttctatacccatcatttttagggttttgatcatgaaaggatgttgaattttatcaagagatttttcagcatcaattacaaagattatatgatttctgttcttcattctgctgatatgacatatcacattggttgatttatgaatgttgaaccattcttgcatacctgggataaatccctcttgcttatgatgaatggtttttttaatgtgttgtggaatttggtttgctgtattttgttgtgtgtttttgcatcagtattcaacagagacactagcctatagtttttttgtgtggttttttttttttttttgaatgtctttatcaggttttggtatcaggggtagtactggcctcacagagtgagtattattccctcctcttctattttttgaaattgttacagtaggtattagttcttcattaaatgtttaataaaattattcagcagtgaatccactaagtcctggaactaagtttcttttttgggagactttttgttacagcttcaatctcattacttgttactggtctgttcgggttttggactctttcagggttcaatcatggtatgctgtatgtgtctgagaagttatctttgtcttccaggtattgtattggtgtgtagttgcttatagtagccactggtgatcctttgaatttctgtggtagcagttgtaatgtctcctttttttgtctctgattttacttatgtgggtcttctctcttttgttgttcattggtctggcttaaaagtgtgttgattttgtttatcttttcaaaaaaccaacattttatttcattgatttctgtatttttttaaatttcaaattcctttactactgctctggtctttattatttattttcttctcctaattttgggtttgatttgctcttgtttttttagttctttacaatgcatcgttaggtttattagaaatgttttacttttttatgtaggcacttatacctatcagctttcctcttaatattgctttcactgtatcctatagatttgggtatattgtgctttcattttcttttgtttcaagaaatttttacatttatttcttaatttctttattgagtaagaaatattcaggagcatattatttaattagttttcatatgtttgtagagttttcaaaattcccctttttattgattcctagtttttattccactgtggtcagagaagatacttgatactatctcagtttttttgaattttccaagacttgttttgtgacctagcatatggtctatccttgagaataatccatgtgctgagaagaatgtatattctgcagccatttaatggaatgctctgtatttattaagcctatttgatctatagtgcagattaagtttatttctttgttgattttctgtctggatgatctgtccaatgcagaaagtggggcattgaagtctccggttattattttattggggtctctctctgtagctctgataatatttgctcagtgttgggtgcatttatatttacaatttttatatcctcttgctgaattgactcctttatcattatatgatttttttgtctctttatggtttttgtcttgaaatctattttgtctgatctatgtagagctactcctcttttctggtttccatttgcatggaatatctttttccatctttgtatctgtctatgtgtgtctttctaggtaaagtgtatttcttataggcaagacattattggctctagttttgaaatctatgcaggcactctacgtcttttgattggatagttatttcatttacattctgtgttattattgataaagaaggaattttgttctggccactttgttatttgtttaatggttgttttgtagtcttctcttccttttttccttctttcttatctttcttttagtggaggtgattttctctgctagcatattttaatttcttgctatttttttgtgtgtatctgttgtatgatttttgtcttgaggttaccgtgagacttgcaaataatataacccaccattttaaactgatgacaacacaggctgcataaacaaactaacaaagaagcaaagagacaactaataaaaactctacatgttagattcatccccttgcctttaaactttttctgtttctattaatatcttattatactatccatgtcttgaaaggtttttgtagttattttatttatttatttatttatttatttgagacagtcttactctgtcacccaggctagagtgcagtggtgcgatctcagctcactgcaacctccgcctcccaggttcaagttcttctcgtgcctcagtctcctgagtagctgggattacaggcatgcaccaccacacccgcctaatttttgtatttttagtagaggcgaagtttcaccatgttggccaggatggtcttgaactcctgacctcaagtgatcctcctgccttggcctcccaaagtgctgggattacagacgtgagccactgcgcccagcccagtagttattatttttgataggttcatgttttagtcttccttttcaggatatgaatagtttatacaccacaattacagtattataatattctgtgttttctgtgtgtttactattaccagtgaattttttgccctcagatggtttcttattgctcattcacattattttctttcagattgaagaactccctttagcatttttggaggagagttctggtgttgatataatccctcagcttttgtttatctgagaaggtcttcatttttccttcctttatgtaggaaattttccctggataattctattctaggatacaagttttgttttgttttgttttgttttgtttttcccccttcaggactttaaatatgtcatgccattcactcctcttggcctgtaaagtttccactgagaagtctgctgccagatgtgtgggagctccattgtatgttttttgtatttcttttttcctcttcctgcttttacgatcctttctttagcttgacctttaaaattttaattattaaatgtcttcatataatcttttttggggttaaatctgcttgatgtttataaccttcttatgcttgaatattgacatctttctctaggtttgtgaagttctctgttattattcttttgaataaactttctactctgatctctctctctacttcctccttaaggccaacaactcttagatttgtacttttgatgttattttctagatcttgtaggcatgcttcattttttaaaattcttttttctattgtcttctctgatcgtgaattttcaaataggctgtcttcaagttcaccaagtctttattctgcttgattaattctgctgttaagagatgttaatgcattcttcactatgtcagttgcgttttccaactctagaacttatccttgattcttctaaattatttcagtctcttcatttatctgataggattctcaattatttctctgtgttatcttgaattttgttgaccttcctcaaaacaattattttgaattctgtctatctctctgggattggtccctggggtcttatttagttcatttgttgaggccatgttttcctggatggtcttgatgcttgcggctgttcatcagtgtctgggcattgaagttaagtatttcttgtagtctttgcagtctgagcttgttttacctgtcctccttcggaggactttgcaagcattcaaaaggacttgggtgttgtgatctaagtttttggctattgcagccatacctgcattagggggcaccccaagcctagtaatgttgtgggtcttgtagactcacaagaggtaccatcttggtgttttgggtaagattgggagaattttgtggatcaccacgcagacacccttgttcctttctcttacttttccccaagcaaatgcagtctctctctctctctctgtgctaagctgcctggagctggaggtagatgacacaagcacccctgtggccaccaccactgggactgcactaggtcatacctaaagccagcacagcactgtgtctcctttatggtctgtggtgagcactgtctggttactacctatgttcactcaaggcccaagggctctgtaatcagcaggtggtgaaaccagccaggcttgctcccttcaaggcagcgagttcccttttcccccatgtaggttcagatataccatctgggagccagggcctggagttgagaaccttatgaatcttgctggtgttctattctactgtggttgagctagcacccaagctgcaaaacaagtctttcctactcttcctttttccctttccttaagcaggagagtctcttcctgtggccactaccatccctggcccacagcacacattgcctggctactgccaatgttcattcaatgtccaagggctcctcagtcagcttgtggtgaacgttgccagggctgggtctcgctctttaggacagtgggctcacttctgccccaggactggtccagaaataccatccaggagccaaggcctggagctggctaccctgggaacctgcttgatgctgtactccactgtggtcaaggtggtgcctaagctgcaagagaagccccccttactctttcctctccttttctcaagcagaaggagtctcttcctatagccactacatgtgggaatatgctgggacacccttgaagccagcacagctttaagtctcacccaaggcctgtggcctccactgctaattattcacaatccaagggctctttagttagctggtgatggatcctgccagaactgggtccttcccttcaaggcattgggttcctttctggcccagggtgtgtctaaaaatttcatctgggagctagggcctggaatgcaggcctcatgactggtgctctattctatagtggttgagctggtatcccaattgtaagggaaagttttctttactctcccctgttctttccttaagcagaaggaagatgtctctcccgtagctgctagctgcactgcctggggttgggggaggggtgatgcaagcatccccttagccacctgggctggtgtctcactaggtcacatgcaccacaagtccactcagagcccagcccagcagcaggacttgtccaggaattgcaggctttgttgtctaggctgcctttcaagttcatttaggacctcagtggcaaggcttggcagaactcaagttctgaccactaggacagacaattcacctctggctagggctggtctaggtgccccctatctgggcaccggcaagttcttcactttgctgttttccactgtaacagggaagcactgagtcctaatgcagagccccacaaccactgtactctccttaccccaaacacacaggttctgtctccatgccatgcagccactaatgggggatgggaaagtggtgatataggtgattcataactgtctttcctaccctcttcagtgcctctttcagtgatatgaagttaaaactagatactgtgataattcatctgatgtttggttattatgaaggatttttttttgtgtaggtagttattcattcttgcgttttagcagagggaggacagctgctggagtgttatctatttgccatcttgctccacctcaatgatctattattattttttaaactggatttggagcagaaaagataaagggactctaaccatcttaataccacagagggagatcccttctgctaatgattccaacattcagaggacaggaggtctggttcaaaacatggggagcaacaagttctcattcttatccttaaagccagccctacctccaaaactctcagttacctgagccaataattgccctttttacataaatcggtttgggttacatttttatgaactgctaaactgataaagcagtgaaccaatttttgagagtagtaacatgttctgaaaaagctgaagctccatttagtccatgtcctccttgttgttcctgccaaagcatcacacaatggccttctgaagagttatggccttgctgtagcttatggccttgctgtaggaaatcagttcaccctgatttccaaaagatctcctgtctttattagttctgctttctcttgctgttctataccccagtctgcaaaatgtaaaaacattagtagttttcatatttgaatgtttattgggtttttaacaagaaaatcctaaaaaagtattggctacttattttttccccctaggatgacctggtttttcaacttctgggcattttccttctcggaactatctccttatataactcacttggagggaagtatacaacataaaataaagctacagtccaggactttcataaccttcagggagaggaaaagagaaagaatttatgtgtcctaaatgcaaaggggaaatcagtggatttttcagtagaaatttgaaaggaatagagatctggcaaagcagagaagcagaaacaagtcattcttatgaacaagtctgtagagaagttggctctttgaacatatagcactgagaaaaaagacataaaacaacaacaacaacaacgacgaaacaaattttaaacacctgtgatggggtcaaataagaacaatgatagacagagatagatcacggagtgcagcatgctccacaagcccacagtctgctgtatttatggtatacctactggttatttctgcaccaaacaaaaaacctagtagttatgttaggggaatatatagaatttaagtgacatacctttcagccagctacaactgaaatgaaagaactttattttgaggccactgtgaacatcattctcccatggggtaactctatgtcctggttcatccagaagagttctagtttatgcctagtatcttagtataattattggtggcacctatttaaccttctaaagaatcctggattcagattttggcaataattatgcagtcaccttacacatgccttccacataattctacatgtaactcagtgggtaatttgaggtgtcaatatgtgcacaaaacctcactaagaagaaagtttcctcttctgattttatttcctaagaccaattattaataacaaatttcttatgtttactttcctgtatcaatgaggaattgagtctagctgtgaggaaagtgatgcccataacaatggtttaaagggatcagaggtttggatttcctcatacacccagaagtctaaagatagacatttatcggtattggttcattgattgactcaacgggcccattatgtccaaggcctctttacatttgcttggacttctcttcctggcatggatggctcttaaatccccagataacatgggagctttctaggcagtagaaagaggcacagaggaagagatggtgcctttatcaggaaagctaacatcttcccagaagttccagtagattttacttatgaatccttggataaaactacatcacgtggtgaaccttaagttaaaaacagaaacaaaaacagggtaatgcctcttttagcttttattttgttttttttttaattttaatttttaattttaagcaatatactttaccatgtgtatcaaaccagagttgccttagtttgggctgctttgacaaattatcacagactggttggcttaaataatggacattcatttctcacagttctggaggctggtgagcccaagattaggggggcagcatggccaagtttcttgtaagggccctcttcctgtttgcacttggccatcttcttgctgtgcactcacgtggtggtgggcagagaaagaggaggcatgctcttccctgtctcttcttacaaggacactgatcctatttatgaggactttactcttatgacctgattacttctctaagtctccacctccagattgcatcacattgagcattaggcttcaatatatgaatctgagggtaatagagacttacagtccatagcacctggcagcagccacacctctctagaccaaaaacttaactgtgcataatataagactttagggcaagaaagagagagagaaaaagggagtagactgaagcatagatatgcatacatagtctcttcattagattgcatattatctttctaatcaccataactattagttgacaggtttatgaacctctactgggaagccaaatattgaactgtagagactacaaggaagagagattacctctaattttattcaggtctaaataaattagaactcatctgggatttggaaacagaagcttattgcttgatgagtgttcattgcagattgctagatattacctctaaaatttctgtagcaagggcaaggatgaataagcattactacttcaacctttattcttcgatttcaatagatgggaaaaggttttctcttcagggaagtgtgaaaggttgtgtgggaactgaaagctctaccatgaaaaaggacatagcaatgacattgtgcctgtggtttcaatatagctattcctgaaaatccagggatcagcaggttgtctatgatcccatttacactatcatttaccacctatttatttaaaattattaatgtgtcacacattgtcttaggcattggaagtaaaatgaaaaaccttccatctcccatattgggagaacacaataacatgtaaaaaaaataaatgtaaacatttactgtttaggattagtgctatgaaagaatgaaatgtatttctgtaatagagaataatagaggaaactaatttcgacagaatttctctggaaatttctttaaggatgtaatacttaagctaaaacataaaggatgaaaaggagagaaaattatgcatcaaaacagggaaaaagtgccaattctagaattcattcattttaatttgttcacctattcaattttgaatatttttacttatcatgtaccaagttatattatagatgctttaatcatggtagaagacaaaggcaaacactatacgttaatactataataaaatatttaaattgttaggtgccataagagagagaagcagggttatagaaacattaaatattttgtgtcttggcataatttttttttttttttgagaccgagtctcactctgttgcccaggctggagtgcagttgtgcgatctcggctcacggcaagctccacggcataacattttaagttttcattagctctcatgaatttccttgttttgtatttgtattatctttgcgttttgactaattgtacatataatccaagaataagatgtttaatttctaaaaatttatgtactacttattgaaatgctttcttttttatttatatgcttatgggttttccacaaactttcttagttatttcaatgaaaagatcttgttgccattgtctgaagaccttaagaaatctgaatggtagcagaaaaaaaaaaaaaattaaaggctaagttttcacatgacatatgaaaaagtaacccaaaatggatcacagacctaaatgaaaaagtaacccaaaatggattagagccctaaaacctatggcttttagagctaagaccataaaactcatggaagaaagcataggagtaaacttttatgaccttggattaagcagtggtttcatggatataacatctaaagcacaaccaacaaaagaagaatcgatatgttgaatttcatcataattaaaaacttttgtgcttcaaaggacacaatcaagtgaaaaatcaatccacagaatgggagaaaattttgaaaaccacatatctgataagaaatttgtatctagaatatataaagaactcttataactcagtaataaaaagacatataacctaattgaaagggtgcaaatgatctgaaaacagatagatagatagatagatagatagatagatagatagatagatagatagacagacagtcaatagcaatgtgaaatgtactcaacaccattagccatcaaggaaatgcaaattaaaatcacaagaagataccacctcccacccgctgcaaaggctatattaaaaaagactgataataacacacgtaggtgagaaatgggaactcttatacactgctagtgagaatgtaaaatggtgcaggcattttgtaagacagtctggcagtttctcaaaagattaaacacagagttattatatgacccaacagttccacggctagatgtgtacccaagaaaatttgcaatatatgtctacacaaagactcttgtatatgcatacccatagtagcattattcataacagcctaaaagtagaaacaattcaaatgtccatcaactgatgaatggataaataaagtttggtatattcatacaatggaatattatttggcaacaaaaagcagtaaagtactgatgcatgctacgataagattgaaccatgaaaatattatgtgatatggaagaagctagtcacaaaagatatactttatcatttcatttatgtaaaatatccagaaaaagcaactctattgagacataaagcagttgtatagcactgaatggggatgggaggaatggaaggggttcacagctaaagggtgtggggttgctttgtgaggtgaagaaaaatattctaaaattaattggggtgatggttttacaactctgtgaatatattaaataccatttagttgtacactttgaatgagtgaactgtattgtatgggaattatgtcttaatagttctgttatttagaaagataatttgtccaaacaaaagctaaaatgtcaatttaatcattatttaattgagattaaacaggaaataaaatcattgttctttatgtattcaatacacattaattgaattacattttttaaagtaatacagaggtgtgaatttcttcacgattggagaggtgagacaacattttaacactctggtgatggaccaaaaaagtggaagaagtagtggaaacagagtggaatccatgttttcgttgtgaagctgtgtcttacaactgtaaacacaatgattttgaccacagaagactactatgcaagaagagttttcctgattaagagttttcctaggactggtatttaactgtacttactgagcttgggcttccaaatgattattgtcagcacttaaaaaaattatacatatctcttaatgaggtggtacatttgagtaggtattaaattgcaaaacagatttttactttctgtccttagatcaatttaaacatgtattgtgagatattttataatattttgtaccttaaaatgacacctttgagctatttaatgaaaaccagatatagaaatgtatgtatcaattctgcaatgtacatttttggtgccttgcatcagagagaatattacttcctcataagtatttgcaaattgcaatttatggtgcagttttaagtataaatattttaaaagggctctaactgaagtttgaagcccatagaaatctttatagaaagacacatgaagacatactttctataattaaatatttatctttagttcatacattttatgataaatcacttaatgatcatctctacgatatcaaaatagcacacagttgaggggcaacatgtgtcttccactctcagtttagtttgtttcaccttcttcatcgttagacataataagcacatctaaagtcatagaagtctattttgtgaagtgtgactgttaatccaggttgtagctcttggcattgcgacaaatactttaccagcacttttttgtgtttattacagtattcttatgtctgttactcaaggtcagtggctgggttaatcaatattactttcactcattgaatcagatgagatttcatgctcgataatttaccattttaaatattctatatctacttcaccttgtgtagtttaattcagcccatctcttaaaaagaagaaaaaagagtaaaagaagaagtactctaaaataaatactgagaagtacagagttttaagaaggatgaaagattttcaacatagtttagcctagaataacattttctgatgggttccctctagaagccagcataattctctggcttcatctccattttcatttacttttatgacatgttttcctttccttttcagtcatttcatatatctcaactttccatgcactcagtcagtgctcatgtctctctgtcatcgttatttatcaatgtcctgtttcttctttaagacccagtatacctccaccatgaaatcctcactgtgtttcctgttgaaactgaagaagtagtctgcctttctttattcttccatagctttctgcttgtacctctctcccaccttaggttgagtttgtacttttgtctccagaaatgaattatcagcatcttgaaggcaaaggctgtgtccgacttatcttccagttcccatcttccagtttcctgcaaactctctcacccccatcacccacccaacagtacctccacagagatgatggagttttttgttgccacagtttcttcaaatgtgtggaaaagctttgtgtcctcactgtagccacttaggaaaccatagcagatgggatatttgtgaatttaatcttaatgagactgacacaagctatggtttctgctttggttttccctgaatggtctaaatcatagcagcagtctttctttccactaatggctgtgttgtgctcttcattttattctcttcctttgcactctgcatgttattttttatagtcaatttagcatgtttatggttacatctttgctttaaaattatgtgatacccagaaatggagttgctcctgcatgatacattgagggtgattctttaatttacaaaaagcaagtaatatttctgtagatgaaatacaatatttacattgtattttatattttacattgtatatttacaaaacatgtttgtacttattgtctcataggaaaagtaagtgggtacagaccttgaactaatttttcaatgcctactctaagacaatttcttttatataattctagaatatttaacattcacctaatttaattccttaaaataacttatctgtaatctttcccctacccaatgctccgtcaagtaaaatggattgctgtaggtcagtggtttaaaggaccttatttggtttggacttttatttttttaaatttatttgtttattaatttcttttttttttttgagatggagtttcgttcttgttggccaggctggagtgcaatggtgcaatctcggctcactgcaacctctgcctcccaggttcaagcgattctcctgcctcagcctcctgagtagctgcgattagaggcacacgccaccatgcccggctaatttttttgtatttttagtagagatggggtttctccatgttggtcaggctggtctcaaattcccaacctcaagtgatctgcccgcctcggcctcccaaaatgctgggattacaggcgtgagccactgtgcctggcctctttgatattttaaattttaaatatatttgatattttgtttgttttgccattagatctgccaatgtcatttgccctccaaacggtttaacaacctattacttttgagtgctctagtaatactgaggttaaatgtgattgagacagttgcatattgggttctggttatttccacatttacttgtttgttcttttactgtctggtttttcacgtgaatatcgttggagagtggttttcattcttaaaagcttttaatggtctgctaatttatcatctcaacagtgatttttttcattagtattataatttaaaatataagtatggagcatagagctgtagataattatagtaaaaattcatttcttaagatttctaacgtgcgtttcttggtctttattctcaaatctatatttacaaacagactatatttttggtgtcttattcttcacaaaatgaagtccctactatctaagatgtatggtgtgaaaatgtaaaatggagttgtacagcctaagtctcagatgaaaaatgcagagggaagtaattggccacattccaaactcttctgagagactgatccagtagtccaaaatgggaaatgaaatttcagaaaaagcattccccaaagaggcatgattcatcttgcgtggcagtaaatataactctttgagcactgttatttatttgaccacttcactggggtccaagcttgcctatctttgcaaatcagcttctcagcaaactcttaaagcccaacctcagtgcttcccctaacagtaaactgttattattgttgtttggtttgttttaaaaaaattctgcctgtagaattgagagatcttccaaatatgccagttctgtctctgctatctagcattgtgcccactctagctttatttatttattttttaactttcagttgataaaagtgatcatagaggtcggctagactacatcagtggcttcttttctaatattcaccacaattagcatcctgtcgttgctgctatctctgatattagaacttcattacctaaagcgtaccctggaggtgacgataaggaacattttctatttattgtgccttttttatctggcatcatagataacatgttaattacttaacacatggttaatgttctaaagctgttggttgttgtaatgattaaaagaatttttctgtctctgtctccattgtatttcttacctcaatcattatccatatccatgtctatctatatatttgtcttccatcacatgaaatgatgcctaagatatggtaagtgctgtaaaagtgtttgcgaaaattattatttttcacataacacattttcaactatttgttgatcacatttaaatactacatgatgtgtgatcatagtgtccatgagaatattaaacaaatctaattctttcacaggtacttttctcattttaagtaaataaatatttttaaataaataaaggaacaagtaaataatattattaaattttggaagtggaaggaaacataaattattgggttcaaccccattttatgagattagaaaattgatttggacaggctggaccttttaaatccattcattatccagaggtccctcttatttatactgcctctcctgaaatgtggtgttatttaatctgtgcaagtgatattttattagcttctgccctggataagcccttgatgacaaaccattgtcgactctctggggccaccagaaaaccattcatggtcaacatatatcaatcagcaatacagggttgagaactagaattcattcatttgccccttagaaatatatgtcaagaaactctctttaggttgtccaggctgattttgaactcctggactcaagcaatcctcctgcctcagcctcccaaaactctgggattacaagtgtgagccaccatgccccgcttctttgaccaattttttggtagtgattatgatgccacccagaaaaatgatgcccctttttgccttctcagagtattccatcattggagaatcataacctgcaactcacctgaactgggggttaaggcacgtttttatgtatacctggttgcagtagtgggaattagtggcttagagcgtccataatggatggatttgtgtaagaatttccaacttgttgtgtcccctaacatataattgaaatcatataaacaaaaatgtgcattcagaaaaggtaatccaactgtgtgtttttgtgtacatttttaaaatttaaaattttcatatttgtaatgacactggatccacataaaaaccttagagacaggtggatcacgaggtcaggagatcgaggccatcctggctaacacagtgaaaccccgtctctattgaaaatacaaaaaattagccgggtgtgttggcaggcgcctgtagtcccagctacttgggaggctgaggcaggagaatggcgtgaacctgggaggtggagcttgcagtgagctgagatcatgccactgcactccagcctgggcgacagagtgagactccatctcaaaaaaaaaaaaaaaaaaaaaaaaccagagagatggattgagcagtgtcattattgctatcttagaaaaatagaaagtttctcaaaggaaataggggtcactaatatcagtgtccgacacaaaaactaagactcttaactctagatcttttcacacagtttttcataggatttatatatatttatatatatatatattttttttttttttttcctaagccacctttctctcccttattagaaaagtaaatgttctatcatgtgcaggagtttagaatttctatttaagacttttatttcttcatttgtgtttcactggaagccagaatattggctgaggtgtgtgtctggaagagagacggcgatggtttgaggacgtgagagctggggactcgagcaaactgacgtgtagaatctggctgggaggcagagaaggagtgggaggtatatagagaaagggcagctcgacgtgtatttctgggaagaaaagtaaaacacaaacaaaggtattatatctctgtttaaaaatttgtttttttttacatttagctttttgagtttgtatgaaaatgaagcctgttaaaattccatttttttgacaccctgtagtagcatcagtcatcctaaggactaagaggtgacatacaagagtggcaatgagaaacagtgttatactgtatctgaaaaatggtctaagagttgtatttaaagtagtcaaacatctttgatatctctcctcatgcatttataacaatttagttttctttcttctgtttccatctttcctttctccttatttccctccttcctctcccttctctgttaatctctcttgtttctgctccattcctccaatcctcctcctctttctccatccctttcttttttgtttttatgagtatttctttaatagctatttgttaagcatgtactactgtgtacaaagtgagctagatgctttgggtgtgtgtgctacaaacaatgaaacaaaaattctgctctcaaaggagcttatacagcaagaaagctaaacagtacaaaaattaagacattcaaagtgggatctactaaagttctgagtatggaataagcattatgaagcagagaggatattttaaaattgtagcttaaaactgtagttcttgtcagtaagtcttactgatttgggtccagcagaatactggccattgtgacctgttcttaactgtataacagattcacgtgttataacatgtaaagtatggtatatgcgataattatattatacctttttaatattaaatattaccgcaagcaagtggagttgagtgagaattgagaaactgactactgtaggtcctttaaaaaaatttcctggtctttcctttctatgcaggagagaattttgataataagataaaaagtagatactctgtttagacagacctgtgaggaactataagcttggtagcacttgcttaatcaaataaaccatggactatcccaagtttttagttatatgtagagcaggagaatagtaatttcatggaatggagaggtcatcaggaggagacagcaaaagtaaagcgctcggtgcccaacaggggaagtagatgtcttggaaataatctctagcatgcatgaatgtgttaaaaagctgtggagggttaagagagttttgtgcaagatcccttggatacatgtgtttttgggttctatagaatattgctttgggggtcatttagtaggaataaaaactgtctccaatttagcaacacctcaagttctcgcagcattaaatgatggaatgataataattgttagttaacatttttgagtgcttactacagtcttcacagccagtccctgaatcacgtcctagcattatcttccttgggcaggtgaggaaataaagatgaaatggcttactggagattacccagatgggagctgaagctattagctatattaaatgctgtttctctaatagtaggaaaatgtcagttagtatttatttacatgaagcttgacagtttcaaagggctttgagatctgctatattttgtgattagcacaacactgctgtgagatatgttaggccaggcaatgtatgtatcttattttaagagatggaaaaattaaaactcagggaaactatcatgcctcagaacacatgggcagtaagtgataaaactaacagtcacctttaggtgtctttaaaacctaagcgtaatccaccacactctgatacctgttcataatttaaacacacagacatctaattttaggcaaaattccaatcatgctgttgaaattctaatagtccctggtgcatgggaatgtaaatttcagtctcttagtaattatcttgtgcactatacagtcttcactggagttgccagataaatgagatgtcattgcacttaacagcaaggatcactgctgctggcttttgattggctccatctgttgctaggaggagttgctatctctcagcagctgccaaccaagcaggcatttctgactggagctgagtctaggttgacattagctagaaaagggacgtatcctaacctggcaaggacatccttcaagtcgatgtttttgtctactaacgtgacaaaatctctgatgttgatgcatttcattgctttttgtgaagcccattttttttccatacttaaatttgtgtaatggctgacagaccatattcatgcaccttacaaaagaaaaagtacattgcaattaacatatgaaatgcagaatttggttccagctctattggaaaattgatatattgtttgatttaaaaaataaggactgttttttctaaataaggactctgggcacacatcattttcctagcaattacaaaagagatttaaaaatgttccctttaggattttgataaaagaatgagaattgtctgatttggatgacttcccatgtttaaaatcctgtttatctgcaatgtgactgaaatagatgctggggaaggaaaagcattatgttcattctttcccttcttgcctttacttatcatagtctgtctgcctggaatgttcttcaccttgtttagctaactcctgttcactccttaagatcaggcaccaatgcaagacttgtgacaaaactttccacatgtacctctcccattaacacttacttccttcttagtggtctcagagttcttcctttgtatgtccaggttgatacagcagtaaactctttatgctcactgttttctgcatggccatttccattctgagcccgttgaatgactaatatgcaaggaccacattttatgcaatttggaattcctgggacctagtcccgtgcctggtcttagtaaacacccctccttaaatccccaacatcaacatctagacatttagtgaattagtaagtgcacattatgatatattagtcttcatctctgaacagctcaattcaggttccagtttctcaaaagtgagacttaaaagggggagaaatcccaccccaacaacaaaatcttaattatatgtctgactccttaaatatattaactgcctccaatcctacacaaactcagatgtatttgagcattttctaataacagtctgaaaaatggagcagagtctgtttaacctggcaggaacttcacaaagtcagttgcctacaagctctatgacagatgtgaaaggaaggctcccagaggagacatgacctgcctaaggccacccagagggctggtggctctacttcaacacctagcaggcgttctgttagatttttttctccctgtcacttgattgttctgcaaagcaagtgttgtgctcacttttatattctccataacaccgtctcagttgtacattttggattcttggtaaatattaaaatgaaatagggtttctcttattctcttcatcatattcttttcatggcaaaaggtgtaagagagaaaagatggctctgatttggagagtaaataaaagaagaggtggttgctcgggctccagtcaaaggattagatggcgaaagtttgcctcctcctccttgtttctttccctgctcccttccttacctgacttctactcccatactctcttttcttcttctcaaggtggagaatctacccaatttctgcagtgtgttgaagagtgtcataattcaaaatactaagcagcagtaccctctttttctacatgctcctcccttcatctggaacaccctccctccactctgcctggccaatttgtgctcatcttacaggtcaaaacttcaattccactgaccacgagactatgcatgcctttgttgccacagtactcttttcctccgtagagcttatcataattttttgggttcttactcacttaactaatgcctgtctctccaagtcaactgtaagcttcacaaggtcaaagaccatttgtggtgtttctataccattggatatctatcacctagcatgtggtacctgacacataataagtgttcaatacatttttacttactggatgaattgagtaactaaacaataattagtagctcttggctatttctcccaagtgactatttagtgggaccctgtttctttaagacactacttgcaagataaagagagtattcggttttctccctgatgcttgtcttggaatgatttctccatgcccggtgattcgtttatcttcacctagtcttaacccatccccttccagatattgcaaactcctttctattgccctttttttttcacagtaatattttaagtccatgtttctttggactttcaatacctcattgtgttttccttatggaaagtgacctctctactcttctttgtcccatgcatttgctatgcttgcacattaactgatttctggacaatctttcgggaattttcttttcctttgaggcagaatcttactctgtcctccaggctggagtgcagtggggtgatctcgactcccggattcaagcaattctcatgcctcagcctcccaagtagctggggtaacaggtatgtgccaccacacccaactaatttttgtatttcttaggagagatggggtttcaccatgttgtccagggtggtctcaaactcctagttgcaagtgctcagccccccttggcctcccaagtgctgggattacagatgtgagccactgcgccaggtgagccttcagggattcttaaccgttttgtgccatggatcaacttggcagtcttgtgaagtctagggattccctttttagaataatactttttaatttatatataaaaaaatacataacattataaagaaaatgaattattatgaaatataattatctacaactcttcactcttacttctcatgaccgcccccaagaaagacctgacttgaccaaaattggcacctaccatgcttcccccaggacctggccccaggcatttggaaggtaatagattggtagtccaggattgtaatattgggctgtctctgtttaagctaaaaattaaggtaaactattaggtcccatctggacagccccattgttaagttttatataacctttcataatcggcctcaatgacagatatgtccagcaaatatccaaattggttttaaagtcagttgcaccatcatttactgatatttaaagtagatcattataatttagtaagtaccactggtggctagctctgggaggagggctgccatgtgacagagtaggtaagattttccaacccaggacacctggtaggtgctattagcagcgataccagtgtcttcctgagcatgccctaggggtggcagaagggattgcctgtgctcccctatgttttgccagagtttctattggcttttgtgggagatgaacacaatccatagagaaaataggccccagtgggacaggtggagcatcacatgagcacaggggaagaaaaataaaatgcataaatacctgaggcagctttgtaatttcagtactgaaatgaagtccttctaatgaggaaatatctaatagaatcaatgtatctgtggaaagactatcttagactgggatcgggaagacttgagttcaatgactggctcagtgttttgtgccttactcattgcacagagagcactgtctacgacttcatgtggcattccagtcgttctcctcatagtctggagtcactcgtcctcccttcaaattgtaaactcatcaggtaatatttaattaacaagaatttatagaacatttttaatgtatcagcactgttaagacattcttttgggaacaacactatatcctccataatgcctagaacaaagttaaatgtgtatttgaggagtttctgtagacttattgtatgtttgcatataagtaattatggtgtagtatgccatagaagtctttcagccttttattcaaaagagacttacattttctcattttttaaatacaatatacattaggagaggaaacaatctgaggaatatttcagatatatgaaagaataagtcatgtcctcaaacactatagaagcacatatttacatacaaccaatttgtatggtaatcacaggccaatctcatccagaatttctcagcaacacaaatcaaatttgaatttacagagtgtagtcaaaagtgatataatttcagctacaaatttctccaaattggtggtggcaggaaagctatttctacttcttggccttccctcagtctgcaacaatcttctccaatttcttctgcctatcaaaatcatgcaaaacccaagtaaaactacatcttttgtgaagcattgttttgaatcctcactgatattgattggatatttgtccccttcaaatcaggtgttgaaatttgatctgcactgttggaggcggggcctggtgggaggtgttcaggtcgtggaagcacatcctttatgaattgcctggtgccattcttgaggaattgaatgagttctcactcttagttccaatgagatctgtgtgttaaaaagaacctgacatgttctgtttgttctcttgctccctctctcaccatgtgatatgcagactccacctcccacatctccttccaccatgaccagaagtttcctgagtcctcaccagaagcagaggctggtgccatgcttcttgtaaagtctgtagaaccatcagtaaaataaacctcttttttttttctttgagacagagacttgcttgtcacccaggctggagtgcagtggcacgatagctcactgcaacctccacctcctgggttcaagtgattctgcctcagcctcctgagtaactgggattacagacatgcaccacacctggctaatttttgtatttttagtagagatggagtttcaccattttggcccggctggtcttgaactcctgacctcaagtgatctgtctacctcggcctcccgaaatgctgggatattacaggcatgtgccactgtgactggccaaaataaacctatttttaaaataaattacccagccccagattttcctttatagcaacacaaaatggactaagacactcaccaaatagaaatatttctttcttcttttgttctccgaccttcctgttcttctattgttgtctttaatcatcttcatttttcacttacctatatatctctagttaattgtaaactctatgagatcaagggacagataacatttttctcatcttcttgctaaatcattcagtgatttgcagatagcagagctcaacaaatgatgattgattgactggttaaatgaatgaacaaataaagatatgagttaatgaagctgagagaacattagctttttatgttgggatgactagtgattgctgtgtgccatgcactgtgttcagtctcgggtatacaatagtgaacttgtgcttgccaccacagcgctaatggtctaatattgtaatagcggttacaaatgccttctcagtgttatattcagaaatatagacattctaccatttttgagaatgtatggaaaaacctgtggctcttaaaaactgcacacacgttggagtacagaagtgagctttcgagaaatatagagagcataaagaaacctatgggttcaacttatcagtgcctaaaaatattaaagatgttaaccatatcaaaacagcactgctaactttggggatgttagagattctatttcaaatagagattctatttcaaaatgagattcctttttgaacttatccaaaccatttcttgcttgaaatcctcagttttataatcaattgctcattcccctgacaaatgagtattctggggattaattattttaaagcactttgcaaatgaagggcctatataaattctaagtggtattgttatgttgtgggtgatgtgccagggaaatattgacaaaagcccttatttgctaaagcctgcattgacgtattaaactcctgctatagaacagtgcctctgggagtcttatatattcttttctttagatatgtgaattggcaattaaaaataattatattgcatactctgtcatgccaatcaagaaatctgcatttaacaacacaggatgtggtctttgagttccaattaccaaacagtatacttttctcttcccttttcaaacaaagtattgcgactgaaccagtctagcaatccagaagacgtttttaatttttaaaatttttgcttcatagcatatttccagaaaagtgaatgaatcggtcttgtttgtgggctatgacgcaaatcgtgggaaattctaaccaaataggtttttctcttattattatttttttgagcagacatacctatatattgaccctagtacttttattgttcttcacaacatgtgctggtagaagggatagtaaagggtgagcaataaccatgttgtgccaaaaacaagtctagataatgaaacttgaacaaagcaatttagaagaatttcggttctcatttgtgggcactttgctgactacctggattttattccttttgtaaacttgcatgtaagcctatcttccctgggtttgggctaaaatgtgttcaggaataatgttatcagtgcaaatgatagaacagagttaggctgtataaactaagtactccacatgtttttttctgaaatctaaagtttggaccttaaaagtattttatttttaaatttgatattatcaaatttgcaggacatttcttaagggattgtaaaagtttcatacagaattatagattacttatgtgcattaaactcataaagagcaatatttcatttcttatgaagacctaataatgttctttacaaagaaataaagaatctgtacaactaaagatggtaaatattaatatcatgttttaggatgttgtattttcttattaaatcaggacaatttttgaagattttgtttaaaaataaaatgaggctgggcacagtgtctcacacatgtaatcccaccccttttagaggccaaggcggggctatcacttgagctcaggagtttgagaccagcctgggtaacatggcaaaaccttgactctacaaaaaatatggaaataagctgggcatgatggtgtgcacctgtggtcccagctactgggaaggctgaggtggggggaccacttgagcctgggaggtcaaggctgcagtgagccatgattgtgccactgcactccagcctgggtgacagagtgagaccctgtctcaaaaaaaaaaaaataaaataaaatgaaaacattgtaggccaggcatggtggcttacgcctgtaatcccagcactttgggaggccgagtcaggtagattggttgaggtcaggaatttaagaccagcctgggcaacatggtgaaaccctgtctccacaaaaaaaaaaaaaaaaaaaaaaaagaaagaaaaacaaagttagtcagcatggtggtgtgtgcctgtggttccagctacttgggaggctgaggtgggaggatcgcttgagcctggtagatggaggttgcagtgagctgtgatagtgctactgcactcagcctgggcaacagagcaagaccttgtctcaaaaaaaataaaataaaatttaaaaataaattaattaaattaaatatttctattgcagtttttaaatcagagttgtattggaatagctatgaaaaatgggagtgtttgtgataaaaatagtctataccaatttgattttgacagatatttcagggaagagatttgattttatttgagattcagtattctttaaagagaaaatctagatttacctttaagacagtctatcaaaacaatcactctaggttgatatactttaatattgcttcctgttgaaacatttcattaggattcctgctgtgattatatttagctcttattccttggatagaaaattaagagagaaatgtagacattaatttgatatatccacacttggatattctgtcttcgaattcttcttaaatataacacattattttgaggttttatatatgtcgaacagttatccaggagagaaggcatctgaagtccatactgccatgggcaatgactctagttaggtgaggcataaggagattcctggtatataattggtgccagtggttatattcaaaggtcatgatgacctagtggtataaatatttccaaaattaacatgctgttttgtagtggatagataagtgaactgggagtgcggaaatccaattactagttccaatcctgccactgacccacaccaaaaagtacaatgtattgccagaaggctctaggcagttctcttagataggtcggcttttgtaagccagagagagtaggaggtggggaggtgactgaatgctagcaagagaatgaggcaagattcataccgtttcttctccatcactctgagtcttaaagcctcatcattttttgtcactagaaacaatatgtttacatctgcatagaactgtctttgattggtaggataattaacctgctagagtccactggtattattttaagttagggtcttatgggcaaaattctgagagtttgtgtttcaagaaaccaaacctcttgatgacttcttagttttatatactcaagggagccctcttagtgttaaacaatatgtctttatagagagatattatatttttctaaaagtagttacctaatctaattaaagtttatttacccctatcaatttagaagattgctgttgcttatcttttattttatgttatagttgcaaaacttttccctataagccaaaatatgttggaagatcaggaagaaagcaaaaaagcatgttaaacattaaaaagacaaattgtgatgcctttctatacaatctcatgcactttatttgtaagagtagaaattattctgcttttatatgatctgatatctgtgcttcttccaacctaggttgttttgtttctttgcctaaggagacaggaagctacacttaaaaaggagaaaaagaaaagagtgacagcgatgacagggaacagtgctatgactgaatgtttgtgcccccctacattcatatgttgaaatcctaactcctaaggtggtagttttaggaaatggggcctttgggagattaagtcataagggctctcaaaaatgtcataaatgtccttataaaagagaccctggagatctagttagccccttcctccaagtaaggactctgagaattagtctgtttcacactgctgataaagacatacccgagtctgggaagaaaaaaggtttaatgaactcacagttccacatggctggggaggcctcatgatcatggtggaaggcaaggaggaacaagtcccatcttacagggatggcagcaggcaaagagagaatgagagaaaagtgaaagcggaaaccccttataaaaccatcagatctcatgagatttattcactaccatgagaacagtatgggggaaaccacccccatgattcaattatctcccaccaggtgcctcccacaacttgagtgaataatgggagtacaattcaagatgagatttgggtagggacacagacagacagcctcatctatcgaccagaagagcaagcacttaccagacactaaatctgccatcacctggatattggacttcccatcctctggaactgtaagaaataaagttatattgtttataagccattggctacaactacccaaacagatgaagataagcaagaactaggagaaacaaccctgaatcaaaagaaaaggcaggcaaatgttgaatatatattagaaaatgttccacacaaaaagaaggaacgtttgaaaggtacagaatctctaaatctttaattaattataaatggcagtcagtgctacattcctgagaagcccagtatactgaggctttattcacctgcattattctcttaagaacctcacaaaatttggcacttctttttgatacaaaggctctcaaactgatagcaaatcgaaacactagaataatccctaaatcaaattagccttgaggacatgaggatgtgacgatggaaaggtatgttaagttttattttagaaaacccttgagaatgaggttcaaatttagcactggaaagatgattggaaatctccagatacatacacttcattttctcttctgttaacgaattgtaacaggtaaattttcatatgattttcttttatttcccaagagaaagtgtttttcttcctctaaattccaccatttttttttcagtaaacatcactaaggcacagaattagattaaccagagaaaactttgattgaattaaatgaaatctctctctttccttctttaatatctctttctcagatgtctatgaaagaaatttaaatgaaattctgagagatcatatgatcaaaattacctctcaagaagtcagttgttggcttatgcctataatcccagcacgttggtaggatgaagtgggaggactgcttgaggccaggagttcgagatcagcctgagcaacttagcatgacccccatcttaaaaaaataaaaaaagcctagctggacatagtggtacatgcctgtagtcctgtagctactcaggaggctgaagtgggaggatcgtttgagctcaggaggtcgaggctgtagtgagccatgatcataccactgcacttcagcctgggtgaccaagcgagactttgtctcaaaaaattgaaaataaataagaagtcccttgttcaactggtatgtttgtattgaagtgtgttgtttgttgtttcagataggtatgttttagatagaaagtgagccagtcagagagagagactgactttacaagccagaaaattgtatagaccgttaaaatatttttaacggtgccatgtttatttcaatatcttagacttaaagcaattgtatgcatatttgaataaatgaatgatttttcctttaatatcctctcattattttattattttataagtaagacaatgtagaaatagaattgactcagatgtttccattttcctttaagatgagaaattagcactgattaaaggcattttaaagcaatcaaggtcactgtcctaaagtaaattatcacgaattctctttataaaacttagaaaaggatgctgactcattgcaacatattattttatgtttgtactgtataatattctgcaaacactaaaaaaaaaaaaattgtttggtattcctgacacaatgaccaataaaatgccacaaacacaaagcatttgaaaagaaaccacgtgatttgtcaatagctacttggtccatatgtgaacaaagtaacttgcccttagaaagtcgcttataacacgctgaacaaacttctgattctgagcaatattagtgagtagttttaaatttactatgagtgtaatcaaaatttggtgtgaatgttagccattttcatattttggttgagtgtcaacacatgttttgagctttgattgtggaattattatgatttgccttcctatttctacttaaatggcatttcaaattgggttagctgcatgatcccaatgccaatttgatacacgtattgttgaatatagcacactttgcttttatgaggactttgggaaaatagttcttttttccttttagttaagattcacaatcttttgctccacaagttgtgtcaaaggttacataactttagtatttcccttaaaacatagaaagaatgtatttctatgactcatttgtttccatatatttatttcccctacttatttccataggtttctcacatttattctattaatatataccttttgctctgtattagtaagccagtacttcccagagtattcatttgaggaatatttttgggtgatattctggaacaaacctctggccatggtaatttttttttttcttttttttaagacagggttttgttcttttgccctggcaggaatgcattggtgcaaccttggctcactgcaacctcgacctcccaggcccaagcaattcttccacctcagcttcctgagtagctagaaccacaggtgtgtgccaccacacccagctaattttgtttatttttttatggagatgagatctcactgtgttgcccaggttggtcttaaactcctggtttcaagtgatccttctcccttgccctcccaaagtgctgggattacaggtataagccaccatgcctggcctgtagtgataattttttaaaaagtaacatccataagattctcaaactgttatgtccatagaataattaataaatgaaaagtgttttataaaaatatatacacatatatcagatgttcttcgtatacaagaagctctcctactcaatagtagtaaatcaccagaagataataagaaaagcaatttatttatgcacaaatacatgtacagtccatgaactggagacatggtaatttaatgttatttaataaacaagggatagtgacattgtatatgtagatagatagataaatacacacacatatatgcatagaggtgaaaaatacacacttgtatgtatagatgtttttcgatgtatgtgtgtatatacatgtatgttatatacatattttttgtatgtgtccttttttttgaagtaaataactttatagcttaccagaccagaattgattctaagattcctatattgttattaacaaggatacaacctgcatgtaactattgggatatttttgtgttttaacaaagagtcactttaatacaatataatttaagaacctgtcttttctgtgtagcaagtgaatttcccagctagttacatgaagaaataagtatcatgatgtgttggaaacttgagaggtcaagtcccatccctgctactcacgagcagcacaacttgggcaaatgaatactctgttagtgtcaggtagcatgctaggtgtttcgcatgtatgactaataaatggcacaccacagggctgggcttagctgtcttcagtaggcttgcccttaaccattgtaacttggaattgtactctatagacagattgtaactcctacaacttccccttctttcactactttatgaaaagctcctacgcctttatctgaagctgtgacttatgtattactttatcatagggatacgatcagtaggcagtgtagtgcagccaaatctttttaaaaattgttatttttaattgagaaatcataattgcacacacttatgaggtacagactgatgttttgatatatatgtacaaagtggaataagtcaaactaattaacatatttatcatctcacataattttctgtggtaagaaattggaagtttactatcgtagtaattttgcattacacaatatattattattgattataatcaccctgctgtgcaattgatctcaaaacttattctcatctaactaaaactttgtaccctttgaccaacaactttgtctttccatccccagccaagaggagatattagttgggtctaactccaagctcccatgcaaagcaatcatcttgcaaatgtcacttgatctctttgagcttcagttttctcatccataagagaaagatgataaaaccttttctgaagggttactggaaggttgaatgaggcactgtcagctgtgttataaaataaattattataactgggtttcatatctccttgtaatccctattttgtaaattctacttattcccctgataaagagagaactggcatttattggacatctaatatgtaccaagtgctttatttacactaattaatattaactacaaacttagaaatttgatgttgttcctctaattttgtagtgaataaacaaaagttaaaagtggttaactctcccacataatgaaaataagagatgcagtcgataatcccactctggattgtttgctcttctcttctgtaggctggagccaggtctgtgcagtacccagcaagattccagtctcttcctcacacatatcgacttagaatggtcattgtattttcgcatttgaatcctctacttatttttttcttcatatcttccagtgagtgttccttctcgttttattcttaccttccttttggcacaaaagctgagacgctatcctgttgctccaaatcaccagtcacgttacctattttgttgtcattacagcacttgccactgtctgaaattattgatgtatttagctaggcactgatggactcattcaaaggaatgtaagttccatgagaccagggaccttgtctaccttgttgggtcctgcatcccagcacttagaatggagcctggcattgtgaatacataatcaataactgttgaataaatgaatgaaagatgctcagctatttccccaaatctatttcctatcgtcagaggctgatcaaatcatttaaaatataaccttcaggttcctgcatgattatcagtgttttccttgaatgtcatctaatttcctggaaagatttcttggtgataatagacttgagtatcagtgagtggtttcctcttgtagcaggatgtcaagggcactcggacatgaggccttttttggtatcatgaatggtagttctgtgataaaagttaagcataaaaggcatggtgcacatgagagcttaggtaatgttgaagacatttaaaatggaaatatagtgtttatatcttgagtgcacagtttgcagccaatctttaaagtgtcatttcaaatagaaaaatggatttataaccaggtcccatgttccttggtaaccagcacaaactagttttgggatagactaaaattttgtctactttgatactgaaaagccattaaataagaattagtttgagctccattgcttaagtacatttatcattgccaaaatcctaattatgaacactttatagttgatgattcaagaaaataggatggccatggatgaactttcaggctgttaagtggaaacgtggaatcatcaattaagatacaagtatcatttgtattttaaatataaatttcatctggatatcagctataacaaaagagcataccataatttagtaaaaattaaaaaaattaatcacaggtataaatctaattttgaaggaagattcatgaatccttcgggagaatagatactatgttttgtctttctcttaaacgatacctagatggtttatgtaattgtgcttcagctttgatagtatttcttgatgtctgtgttaagtgtattctgcattaattgctataaatcactcttgttcctgctgtgaatttatttttctgttaggtaattgtttgtattttgtgaatgacgcatctttgtcacacagagtagcattgcaattcacaaactaagtttttccctgcccacacatcgcttgaaaacttgtcacttctacccaaagttatgcctatagtgaacaccccaaatcctgaagcacttttggaagattttttttattctaaagcctttccttcaacttatttctaggagtgattagtgattagtgccttattaaacaataacagacaataactacattttcttggcaactgagtttatcaagggaagttactacaccaggaagccctttttggcttaggctgggttaaagaagtatcttttgtctgcgcttctgctctaatgtgtttgtgtttgtcatcgcatttgccactttttcttttttttgaaaataagataatgtatccctttccaccagtagacagtgagcatctcaaaagcaaatgatccagatgccgtgtcaacctttgtaaactcaaattctggcatagttcttggcacacaataagtattaaataaatagttgttgaacttggaatctagatgaatacccttttcatttacattctcagagtcactgaaggttttgcaatcatttgcccctccactgaaggaccccagtctactttggggttagtggttttactattttggctggctttttaaatgtaatctcttctcatctgtgctagctttcggagcttttctcatggttgctgcttctagtctgctttgatgcaacagaccagatagctaaacacattaaaacaataagctaaatttcacggactgttaacctctgaacaactgctgaataaaggtatatgcatagagttgtgttaagtatcattaagatacaaagaaagtacaagacacggttcctccctgatttacttggagagacaataggcaaaaagggaatacaactggagaatgagataatatatccagcagtgaattgttaagtgcagatgagggttaaggaagtaacactaagggaattagtaaataaaggatggttcataaattattatggtagtcgatgtgattagatctaaacattgaacgttaatcaaaaagaaacagggagattgacaaaatttatttggagaaaaaaggttagtatagtcaaatgctatatttttcttattttaggcctggtagtctttaatttattctgagtcattcagacaattccatttatgtttgatcattaattttctattttggcttttttataagtttgtaaattgccttattatcttagaattgcataggatgtaaaccctgaagaaaacattttgaaaggctgacatattttacagcaacacttctgtacattgtaagtgtgcatgccatggcttagcagcagatatatagtgtcttaaagtttcccataagtggtcaaaaccctctgctatcatggaactgttgtgttatttgatcacttgttgataaaaatgaagataattaaacaaaaatcaatctcaagagtatactcagaacaacaataaaccattgtcttaaaagttttgtgaatattaattaacacaatagataaaaggatttctttttcattcagttatttcttcattaagaatcagttcattccattctctcttttgtgcctttttgggagacgatttaacatttccttgttgaaaacctctgtatctaccatttgtaagcatatgtgaaacaaccaaaactggtcatgatcccagaaatcaatcaattcagtcagattgcagatcattctaagcaactgaaaaagagggtacagatttctggctgctttaaattctccataactcagtaacaccacagtactcagcactagtaacagtgaatgcaaacagtgagtgggaacgcttccaaacagagtctaccatggatgcatatttgagttggagggttttctgatttggtaaggacctttgggaggcttcatagctccatcagaaaattaacctctctctgatgggcgccaacagcacatgtaatggaaaacttaaccagaaatccgatgatatacaattcagagctctaggattgatccttttactccttagctttttaaagttcatattgtagcaaaagtatgtctgttacttcaaggttcagttatcacctccttattggaattttcacttgcatcacatgaatgaatgactggccttctctaagcctgccattctttgcttatatgactaagtttgataaatttttgtttaattgattgtgtatccatctctcctaaactgcagtctcgtcagggacaggcaccaggttgtgctaatttttgtatctccagcacattgtaaatatgcaaacatttgctgtcatagttaaggagcacactattcgttcactcaattatctttggttatttccaccaaaaacaagataaccttgaaatagtctagaatactctcacaataggatgttatttcttttacttcatgcaagaagttttaattactaaaggcagccatgaaaataattttagtttgacctaaaaggtggttcacagcataaacaccaaaaatgaaagtataattagttttttggacatttcagttttattacagagggtagaaagtgaaacgagagcttcagaatttaaaagaatttcaagttataataagaaaatgacagtaactgaactacactcacatgagagattcttagaaaaatgcttatttacataggccatttttgaaaaaaaaatacaggagcaaactatatgaatgatatttaatttactcatgttgcattccctgtaataagctgatattcttcataagtcattgatctagaaaatcagttcttgatgtgaagatatttgcttgagattgtagtgaaaagagcataaggtttagactcaggaggcttgaattttagtactggcttggccaattagaaataatgtggttatggccaagttactttatttctttgaggcttatatagctcatctgtaaaatggagataataattccactgtcacaggtattgcttatcaactactaagggtcatggggattaaactggcagaacatgatttatattacatttcatttcatagggcagcagtatactcaagacttgaacactgcatttgtcaggtcatggtaaatcccaaatagtacttagtatactacaatagcttgttatacgtctctgtaatgtgtatccgaataaaggctatgtctgtacttgtaccttggtggaacctaactaaagtagctcctgggcagtccaatcagcttgttgtaaatcccagtaacattcataacttcagagtcaccagcaatctgataagagcctagtgcttgctgcataacaccagggccaatgagttaaaatccagcttccccagtagttttctaggtgactccaggaacttatttcaacacttccagcctgttgattctatgactttatgaaagccagtgcattacattagagcttgtctagatttcattgctttctgagttaattgggaacttgagatttggagttttgttctttttattctctagctctattgatttgccttgagaatcatgacaaacattactctctccctgtggaatgctagataaaaggctgttctgcagtgtgacctgcttctcaaaaatcaaatagatcaatacattttgttcttcctatttttttgaaaatctcctctcccttctgtccccatatcctgcatttagctagagtctcatatcattgggaagccaaattgcaaaggtaatactatgttttttacatttgtgttggaaacttctggtgtaaagattatttgaaggacagagtagaatatagcagcaattggggcatattttagcagatatctcaaagaattatattaaccagatttacatttaagaatattaattgaacatccacaatgggcagggtgccctgtgatcatcagcatgtcaccaaaggtaaaatgcgaatattccatgatcctcctcatcaagaactttccagtgtagaaagaacgttgaggtttggagtaatgattttctaggttctaactagtagaaaatagggacaagagtgcaaatggggagcaaagtacagttttattattagtggcaagtgtctagtagctggaaaagctgcaatgcagaattcagtgttgctctaagacagagtgtgggattatttctgagtatctgaattagacctcagagcctacctgtggagaaagctgtgtctgtaagtgatcccaaatgttcttatgcattcagctttgtggaatttctctggtagagcaggaaagaaggagaatttcaggcttttatgtgtgcactgagattgagagaacctgggctctgttttagaagtgctgaccacgtggaaataggagaggaattctttgtcactattcaggcagtgatataaaatagtgcttccccgactgaccactctcccaccaccttttaaacctaaatagccctattcattttttacatggcccagtgcatcaagttttgactaatgagattacctacatctcatatggaataaagatgtaggaggagtgactgaaaatcggcttctctgttgtggcaaataaaggggtgacaatttacccttctaaggtaaaatgatattctctcccaaccaggagtgataacatgtgtacacaaataactattctaactaaaatctcctaaaaactgaaatcctatagctatttaattatatgtgtgtggaaattattttcaatccttttatgaatagagctgaatataaatgatcaaataaatgcctgtgctcaaccttatcctttaacgaagagtttagttgcctctctgatgtcaaaaaattattaaagataataatgtttttgtttggaaagaaaacaaggtgaatcacaatgtcctacccagagtgaatcacaactgacaaagaacttttcatactgttattactattataaataacataaatagtaatagttcttctagactgtggttccatatgttctagccccagactatggtggttacattcatctaatattttagataacattcaaaaatatgtgttatgccattcatgtcacgaaaatttttctcatacctgttgtacctttacattatttttcaaaggccagtccaagagccacttcatctgggaagtccctcccggttttccctcacatacagcatttcttgattctaggaaacactgtaatactgcctgcaaaacatggtcatccctttttcaacagtacaaggcatccattttatctgtttatgtgtatatctctcacgtccacttacctcatgggcagaaattaagctctacatgtctcttcgctcttcctgagtaatcacatctggtgccttatttatagtatatactctctgcactctctgtgcaatttctgtagacctgaaactattcaaaagaatgaacttcttaatgtgggaaacaagagtaaaatattaattcgaggtcatattgttatatgtgttacagctctctctgtctctctaatatatacatatatatatctaatatacatatatcagataaatattagatatacagaatctgtaggcataaaggcctatggagcttttatatttgacccaattaattgacctagaactccttggaagccacagtgaaaacaaagatatagtcatttacatacttactttttgattttggtacatagtacacttagccactccttaaagaaaattttcaaacatctcatagtgggagtatggagggacggcacacagtggaagagaatccaaaacaaaatagctcttttagcataaattattttttgactagagtaataagggggcatgttgtgtatttaagaatctagtaattttgcattctcttctttgtcatccagtttcattcattcattcagccaagttcattcactcattcattcatttactcaaaaaatatgtgttgtgttgagtacctactatgtaccagatgttcacctagatattggcaagaaatctgagaacaaatggagcttgcattctaaggaattaatcagacaattgttcagaaatatttagaagattgaaaatataacctaccaataaaatacacattttactaacttatgattaaaaacaccacctatcacttacgaatgttcttcaagtggatgaagtgactacctacagcaaatgaatgagtagtgtgttctctgtatgtcatggcagtcagatgagtgtaggttaattctcgtttctaatttacactgttattggagatttatggaaacagttttgcaggaaatctccaagtagacattttcatactagcatctgcagtataatcaggaaacgattacaggaagtatgaggatttgaaacactgaagcctttgcactctaggattgcataagggctatagggaacagctttgggagggctgaggcacatatttgttatgttttaggtaagccctggatgcactgtactcagaggattacccctaatcctttcacctcagtcctttgagatcgctgaaaactgtttgcccatgtgttgctaagtgcccaagctgaggtcacagtgcgaccttcggcagcatggagacatctgtgaagtcattacagagattatgtgtttaatatagggtctctcagaggtgtatgtcaatgtcaacttaatgccaggccacagtatctccacacatgaatagtgtcctccaaattcatgtgtacttcgaatctcagaatgtgaccttatttggaaataggctttctacatatataattaattaaggaccttgagatgatgtcatacttgattcagagtgggccctccatccaatgactagtgtccttataaaagaaggagagatgcagagatacacaggtagaaggccgtgtgaagacagaggcagagggtgaagtgatgtggctacaaaccaaaaacaccaaagattttcattaaccccccaaagctaggaaaaggcaaactaggattcttccctagaggattcagagggaagatggccttgctgacgttttggttttagaattctggccttcagaactgtgagataataagtttttgttgtctaagccacccagtttgtggtgattgtagtggcagccccaggaaactaatataccccacacactgaatgtgagagactgcagaaagtgtaaggaaaactgcaccacaaatttctgaggccccatcattcagtgtagtgagtaagtggagaacagcatttctcttgtcaaatcctttttgtaatgaaacagaattttcaagaataaataaggcttcaaaaaaggcctaaattttacatttttaagacagaccttctgtggaaatatatctaagatatcacatcaaagcctcaaacatttgaactaaaaattacaatattttagcttatattattgctatttatcctgttgtttctggttttattctgcacctctcaacggtctgttgtcacatcctagctcttcaactaactgattaactttggcaagttactctttctgcctcagtttcctcatttgtcaaatgaggatgatagttcctagatatgggttcgttgtgagaaaaaaataatatcataaatgtaaagcattcagagcagtattttgcacataagaagtgcctaaatcatgtcagatactataaaaatttctgctcagcgacttgagatttgctttgaagaggcactagtaatacaactattgattttacagtagcaaaagacttatgtgacaagaaatgaagttatgaaaaatattttataattacagataattataatatatatggagagaaagtaaaatattgagttattttctaattttgtaactagtaagtaaagagaccaaataccatgtttcatattttaaactctgaattcttgttacatttcttatttaatgctaagctatgacaaggaaataaatgtgttatctgctccattaactaacatttgtttggaaaaaaacctcattacatttgcaaagtaggatttacaaaacaagctgccaaaacagctgtgcagttctaaaaataataataatgaatctatgtataaccccatcacactctctttaaaaaaacacatttaggcttctttgatctttgaaactgtcttttattttcatccagttgacatgttataaaacatatttttgattgcatgttatgttcagatagcattttttcaaaactatctcttatgtaaatgtaaattttaaaaatatttcatcagccctgcagtcaaatgcaaggctaaattgtttgcataatttaatatgcattagctacccaccacacacatattcttttagagctggaaatcaaattcaaatctggaagggaccctggagactctctagtccatttccttaatttaatcgacatggaaactcaagcccagaaaatgtaagttatttaccccatgccacacagcaagatagtgacagacctgttgtgctgccctccttcctttttaacttttgttttattgtttatgatacagctgagtcctcacaaattgatctaggggaaatctcattcaggatttctggtgtagacgctggctttgctgctcactcactatatcatgtgcctcctggataggactgtaggctctgaagctcaactgacaggtgtaattgctgaccatatcacttgctggctgtgaactttagtatctctatgcctctgtttcttcatctataaaatggggaatataatagtgactacttcatagggttgttattagaattaaatgaaataaatatgtgaaatgcttagaaaaatgtctggcagttcattcaattcaagcaagctattgattgtcttaaatgctctctcttagagtcattttctttacctatgaaatgagagacatatttatctcacagagtggctgtctaggttaaataaagttctctatgggaatgtacattttatatatatatatatatatatatactcatacattaaccaagcatgacttataaggtaaaatcagtatacaaactgatcattttctttaactgtcctttaaaaatttatgcataagaaaaattttcccatgtccatggatgaaactcatcatttttcttcaagttgtaaaacacttattcacttaataagtaaatttcccagctcaatataatataaacacttccttcgttattcaaaggttattcattccacactctcatccacaatcaggccctaactgtgacattcttgcaggaaggccaccaaaaattttagtcacccccactgcccaaaccaaccaccatgactgatatcttcaggactagttagactatggagagggaggagcaggaagggaaccagagaattgttacttgattggtacttcagtaagaatctgggggtagcgcttacctactgtagttaagggttttttagagacttccctttgtgggctctccaactgaaactctgtccggtcagtgatgacttctcaccttcaaaccacttttccatcagctcttggttttccactttctaccatatgtaggcttttcctattaaagcctcgtttcctcttaccctgttctcttgcattggagttttaaaagactctaggctggttcttttttgccatgtggcccacatctattctagaagtattatacactcattctcctctgtcttgaccagctttgggaatgccgttcagtcaaaatataggatgagctccttgcccttgctttctacgttcctaggtgggactatattttgacgttggtgtactgtgcttctcagtacaatgggaagaagatcaaaaactctccatggccctattgaagccctttctctaggttttagatgaagaaattaccaagccctactcttaaactttctatgtcttccttgtagaatttagagcagtgtaatcaatttctgtgttacctattttcagatttctatattttctggaataaaattttagagttcatatctattccctgatgccttagtcaaagtttgtcatttaaaaaaatcctgttacatacataatgtctattcatcaatatatgttaacatagtgatgattttcagtctttaacgtaggtaagctgactgattggtaacagcgtaaaacctttaaaggagaaatgtggctgggcgcggtgtctcacacctgtaatcccagcactttgggaggctgaggcaggtggatcacgaggtcaggagttcaggactagcctggccaacatggcgaaaccccgtctctactaaaaatacaaaaattagctgggcatggtggcaggcgcctgtattcccagctacttgggaggctgaggcagaagaatcgcttgaacccgggaggtgaaggttgcagtgggctgagatcgcaccactgcactccagccagggcgacagagcgagactctgtctcaaaaaaagaaaacagggaaatgtatgtgtacgggataggagctgcagggactgtgacagccagatcctcatacagatgctgggcggtggacttccgtgctctgaatacacgcaaggaggaaagaatgttcactgtaaagacccatgcaagcagtagtgagcactgcaacacagttgtaggttctgcaagcaatactcatagttacccagttaaaaatagtaagagatttgcctcttgtggaccaaaaacttcatgtgaataccctatagagattgatcaaacagctgcccccactgcagaccaagcatcattctttggtttcccttgaaaaccgtctttactgtgtctcttggttttgcaatcacagcagttatgcatatggacagaaatctttacagaatgctttctcattcagcccaataaaagtaataagtgttttatgactgctcctcaaatttggctcctcttaccaacttctggcttctctcttctggcctaggcatatctctaaaatctgaataaacttgagataatatcttcacttagaaacaatctattctttgatagggacagcagtgaatcattttatcaatgaatggagagtatacgggctaagagaaaaattttcctctgctgccttaaggttcactgaaaattattgacaagaggcagattgagaggaaaaaggcatataaatttgtttgatcacagttttacatgacatgaagcctttcagaatgaaggcccaaagaagcaggggaataatttgtccctttttattcttaggtttaacaaagtatggacagtatcctgtagaaatatgattggacaaaacgaatatgatttaatgctaatagactgagtagggaaactcagtaagacctgtctgtctagatttttcttggcctttctgagtacgtattcctttcttctgagtgtggtgaggaccctctctggaaagggaatcttattacctacagttaaacaaggtaggtcagataattttttcatagccaatttttgtacagaaaggtagagggggcaagttagagtaatatgttaaggtttttggctggcttcagggaaatggggttctggtttctatcacccaccttgggaaagaaggggtctagtttctatggctaacctcaggaaaaattggaactgagaggcaggaggacaggaaaaggacagaaaaagattggattctgaggccttcagttgggggtattgttttctaacttgcaacaacaacattaaaatgagaatcattttctcataaggcaccttggttatctgtgagtttataagaaatcataaattttaaaataagctgtaaccaaaaaagtagtgaatctacactctaaaaccttgtcagaacacattcagaacattgtgatttgcgctggatgatgacttgaacaaacttgtccattttactcagcactaaatttctagacttcatctaggttgttgtgtaggcctgggatttatccattttacccatgcatttcctcttgaagttgtgctcttgtgagggaaaagaaactttagtgcttaaacacgtggactatattttctgcagtgactgtacgactggtgaatcagctctcctgccagtgagcatttgtttccacgtttgctttttgaacactgcatatatgagcctctttaactccaaggtttgatgattcttaatgaatcgctgactgttaacattgataatctagaaaagtaagtaacgttattccatcccttatcagtaggtgttggttttatatggagtgttgtgatacatacaagatgctgttggtaatataatttatgttagtttcagattacagggaaaggggttccaatccatctcagtgaggtgacagtgaggcaatatccttagctgggaggttggaatgtggagttatctgaacaatgtggtcaagccaatctcgtaatttataatctttcataatttcctggagaacaatgagtaaagtccaaattccgtggcttgacattcatatttcttcacattttgtccccaaagtacatttctagttgtttatcttacttatactttacttaactaaaaaggatatcttaccattccttgggcaaactctcttcattatttttctattgtgttttcctgtattgtttctaccaatctttttagttcccacttagaaaacaccaccttcacaaaaccttttctagtcccaacaggtagatataattctaaagacaaaattacaacagattttagtttgaagatcctaattgttttttatttaccattctagagtcaagcaattttgcattctataaaatagaatgaatatttcaatgagctgaacagagtttggttttacaaacagaaaagggtagaggaaaacatatatagaaaacaaaaagcaaattggtcttttcaaagttactttacttgcaaaggttaatgcaggaggaacttccttatcgtagtacctaaaactggactgtttggggatgtgagtctctcctgattgcttaaaaggtcaaataaacaacttagttttggcttggtgatgaggaatttcagcatgagtgactccatcttggtttggtctgttgggcttggtgcaggagctcagtctaaacgaatggcttcctataaattttatttatctataaataaagtctgattacttatagatagctctcatgccaggtactgaacaaaagaaataatagatactaatcatctttaatctaaaacattaatatgcagcttcattatctatattatttgaaagatctgttttcactttgttaggatgtattttttttccctttgaaaacagttgaaggacctgtcctaggttcttaaagcataatttaaagaaacacctaaaccatggactttgtactgatggcatcgttggataaagaaaatgtgaagccttccacagtgattgatatgaaggaaaccagtttacttgcaaaagctgtatgttattagcaactttgtttctttagtgccacactgtgtccttgttatgtccttatctgaacatcagtcatgctaatttggacaaatgcttacgtatccttaaagtattcacatattattggcttcaacttcagaaaagccaggggattagatagtagctgtaagtagaaaccatttcttctatattctatctctctctctttcccctcttctctctcctctctcttcctctctttcttgccaaattcttaaactctgacgaccctggtttacaccaaatagtttttctgattagccatcagtgtgaccacgttcctatttttattactatgtatcttctctcaagtgtgttaataggtatagttcttgtgaggtatataaacagtaggcaaatatggaatttttgaagtactttctctgttatttatttttggtatggcttactctacacattttatatacataaatacttgtcactgattttctcactgtaatattttggtaagtgtgcatattaaatatgttattttacaaagatgcttgtattggtggaatttttactctgctctaccttgataggtaataatgtaataggaagatttattctggaatttcagtatatctctggatatagcaaataatctttattaactctatttctttttattttttctttagcagtacctttaaaaatagagtatagagtgtttatacgatgtttatacaaaagataattaggatgtgttaaccttgaggcatctattttaggttttatgtttgtaaaaatcatcttcagcctgtataattatctggctgatggtgatcagtcattacgatgctgatgacaggcatttttcactgttttcagttctacttttttttttttttaattcactcacttaacatcctgaagactcaaatccttgaatcagtccactgagcaggaaggacacgggcagcaagcagacaaaccagttcctcagcttgctgtctcaaggttgcaaacacaaattgaatcctcctatctattatttttgcaagcattttttaaagaagaagttttatgggagtggaagtaaattttccgaagccttgacacgcccagtgtcagatatacatccattcatttaatatttactgagggtgtaccatgcacaaagccccagggaagaatatttaccaccttgagaatggtttgcagtccagctacagacatggatgtgcaaacaaccaataatgccaagagatgctgcgtgactcctcgagcttacatctgaatgcatcctgagctactggtgaggaagaactctaaatattgcctagcatgcaggactctcttagaggccctatgtttgtctgtgcccataacccagcttcagccccagggaaacttggtctttttgtctttattttttaacaagtttgtattttgtgaagttttcttctttctccttggatcagagtatattgtatatattttcccttttccactatagtggaagctaaaacagtaggaatggcagtgtctctcaatctcattcatatgtataaatacagagtgcttagtgcagatgtttgaatggatttccccattaacacatttatgtaacagcataagtggttcagtagcttttgttggaagaagagattgattttcttatgaaaggagtaaatcccctcatagggaacactttacccaaaagtgataaaactaacttgcccttagttatgtgggaagtgtggctctatccacttcacctgttctcttccttccttgaaaccaatcttgcaaaactgattctaaaaatttattcaccattttcttctcatctatcgaagtttgaaaaagagatggaggttgagatagatgacattttttcttctgaaactggaaggatttgtctataaaacaggttgtgtaagtgatggcttctcaaatttagcaaatcacaagtcaaggagcatcagactgggaaaggatctttccttacatccatgaatatttttacaatggctatgatcagttgggctatttttgggctctcttggtgatggagagctccctctctttcaatgtgcacattctctgacacacagggaaaaatcaagcaagttggagccttgtgacaaatgagccgcagttatcctgcctcatccctttgcagtttcttctttgttttactcaaatagggaagtatcatttaaaagagtaccaagcatatcatatagtcatagagcccccttctccattgttgaggatttatattcatttagtggagtggtttgtaatttgctggtaattaggttcaactgtgccccgtaatcatgcagccatatttcactggttacgttttattttatttaaaaatgttttaaagtagttttttatcttcatgaaatggattacatttttacatagcaatttcacaaaatcagataatatgaaaatataacctccccgtcccctttccttgtctgcaatggaactaagttaggcttgaaacgaaatgagccttacttgaagcatagctaccacaaaaaagcaataacagttactgaaaattcctagaataaactgtgtctttatgaaatgcttttttaaaaaaatttggatttgtctctgggtgattgtttaattttcagatgactccaaggaactcgggccattaattttttaatgcagctctctgaattttccaggactcaccattatttttattagtcattcctaatatcacttggaggaaagtcaatatttttccctctcctgtcttcccagaaaaccctagaactggataagagaaatgagtaggaccagatcagattctaggcaagaatcacaattaggagatcagctttgaagagccgttttaagacgtctcagtaaaccaaggagtcagtctgtagcctgggaaattctgaatcctttgggatacttctttttacagtgctgcaaaactagtgtcctcagcttctctacctcttccttgggacatattgtatgtctttcagactcctgcattaagttgcctttgtgtttgtttataaaacattcagatgtgatacatgagagtggactgatctaatctggggatgagggttgggaaagacttccccccaaacagaaatatttgaattgatatctaaaggaaaaattaggagtaaattaagtaaaggttggaagataccattagtagaaagaaggaaggcagaggtgatagggaaagctagagataggcaggtaggtgggaaatggtaagttaggctttgtaggttggatttcaaagatgggtgggatacgctgatgggagtttaaatcaggaattctgagccaaatcagactttgccttgctattgtaatgtttcagccttgctactgtaacttccagcaaatgggctgagaatcagattcacaatagttctggttgacagtacagcattcaacaatgcagatacttatgtcgactcagaaaaagtttaatgggcgaataacacagaatacaggagaaaagaatttgaagagtgcttgaacctctgaattcatacaaagccagcagatgtactggatgttactaaatacatgacatgaaggaggctctgtagtttcaaacatgaggcttattcttccttggtaaccaaaaatgatgcatggatgtcttatacaatgtccatgatatttcatgccacagttaatgatttttagatgacacttggagagaaatctttggcaatgtctaattgattgattttggtccagttttttaagaaccatccttactgcagggaatgaggctgcctgccaatatactatctgagaaactcagaagggcaagaaaaacctacatatcaaatcaatttaaatggaatttgaggtgtttttggtggaattctaacatccaccaacacccattatatctccctattttcttcccattgaattagtggattcttttatcttccttccttccttccttctttccttccttccttccttccttccttccttcccacttttcttccctccatccattcatctgtcttaccttttttccttctttttaaaaatttcagcatagcatttttcttctacaatctggaggaatatatgggttatgtaagtgtggaaacatatttgtcattttagtttacctttgctgaaatagtgaaggatacataacgtataagatacaataattctcttaattttttgtgacttggctcatccagaattagtttgtcagctcctgcaatgtacttaacatcttatttctccccagtacccttcatgagatctgctgtggttcatagtaacttagattgaattatttttcttttctttttctcttcttagttcactttgcccagtaatagtaggggagaaatgaggggttttatgaaatgttgatatagtggaatagcatgagtggagaatttcaagaaagttcagttctttgctcatgaattgatttaacagttaccaactaaggtgcaggaaattaagtgctgtattacatgtagcctgaggctccttggagaaaagaaaaatgcttttgcttttcattgagctgtgggaagttgtttcaagaccatcaggaaaagctttatttctgtgaaaaatagctctatggtcatcagagcaaaaaggccttgaattttatatgtgaaagatttctactgaaaaaccgctaggtcctgactccattgacctcagaatgcaggaggatgtggaacacaaaattgaaattgtggcccatgaaagttactctttttcagtaatactacagtattacaaatattccatgttctttaatgaaacaccttgccactaacctgaatggatgtcagttttgtttctctttataacacagggctcactaacaatgttcagcttttcagccatttattaaactcagaaatttgtcttaataaaatcacttcaaaggagaaaaaaaagagctgtatgtctgaagatattctttgtagtattagctataatagtaaaagatggaaacaatttaaatacccaatggtatagaaattattaaatgagtttacatgccaagaggtaaagaaatattgtgtggccattaagagttattgggtagactctgcaactgcagaaaattggctccaacctagtgttatatagaggaactaaataactagtcataataaatatagcatttattaggtccttttaatgtgccaaacacttttgaaggactttacatttattaagcctaacagtaatattattaggtagtactattatggtccctaatttacacatgaaggaactgagcaagattgcagggctgataacccctgggtttgggattcaaatgtagagagtctgtctgcagagttcacatttaaccagtactgtgtatacgatcaacaaatggctgtatctacattgattacatctggtaacactgagtgcaggttaaaaagctaggagaatatagagaaataaaattagttaagactgctgaaatttggaagagaggcatttttttaaattttcttttatgttctagtgggtggctttcactatttaaaaatgtcttagtagggccaagtatgttagctcatgcctgtaatctcagcactttgagaggacaggacaaggctggtggatcacttgaggtcaggaatttgagaccagcctggccaacatggtgaaacactttctctactaaaaatacaaaaattagccaggcgtggtggcacacgcctgtaatcccagctactagggaggctgaggcaggagaatcacttgaacccaggaggcggaggctgctgtgagccaggttcatgctgctgcactccagcctgggtgacagagtgagagactccatctcaaaaaaataaaaaacaaaaaataaataaataaaaataaaaatgttttagtaatgtgtaacatttgcatacaaagttcaaactttattaaagtaggctattgtattagattattcttgcattgctataaagaaatacttgagactgggtaatttatgaagacaatagttttgatcggctcacagttctgcaggttttacaggaagcatggtgctggcatctccttggtttctagggaagcctcaggaagcttacaatcatgacaaggcaaaggaggagcaggtatgtcacatggcaaaatcaggagcaatgcaggggagaagccacacacttttacacagccagatctcatgcaaactcagagagagagttcacttatcatcaaggggatgacccaagccattcatgaggcatctgctcccatgattcaaacatctcccaccaggccccacctccaacattggagattacatttcaaaatgagatttgggcagggacagatatccaaacgatatcatccatcacatagtatgaaagaaaagagctctctatcccacatgacctcttattccatttgaaaacccacatctagagttctggtgttaaatctagttttagataaaggccaccacagctccccagatggagtagatgcttgaaggatgagctcttcgtggaaaattggaagcagcagaatttgctagtatgtagggcagagaagtgcagtctgggtaatcagtttgtaatcctctagcctatgatgcaaaagtgacaaggaaaatagctacatctggcataggaaatatttacgttaaacattaggaagaacttctgagatttcatagtactgtgctgggttgtgtattcatgttttaaaataaaagctttatctttaaatctgagatatccatcccttgggagaacaagaatactcaaatagaaacagaaaggattcttacaaagtgggaggtcaagcaacttatagaatagagaatatgtgatgtggaaggagaactatgatttgtgttaaacttattaaaggtgcgttgttagaaatttgtgatttttgatgcaaaattatctatagtgggtttttatgattttgaatagcacagaaatcatattttataatttaaaatgtcctataaaatttttaacattgggagtccatgaataagtttagggaaattatacagcaaattgatgtatgtgcatatgaatattttcaggaagggaaatccatggttttaatcaaatgtttataaatgtccacaatgccacatttactactataacatctccactgatatgttacgggaaaagagaggactgaatggtaatttaggtagatagatgacagatagattgatgatagatataaaaacagatatataaatataatctcttgcatagacttggagaatcttcttggcccctactaatgttgttaatattctcattaaaaagagaagatatagtcttttattaaactctcattggaaatggaaataactaacatgtatttaaatacctttaatctgtggccattgaaaagcgtaatgcatgggaattttagacgggggctgcagctataccttgcacattgtattttggcataaagatgaatcagagcattgagatgatagactggggttcttcctggagatgctgtgctgccagccaatcaagcatagttatctaagttgcattaatcaactatgtaacctgtgatttcctctcagacgaaatcacctttccaaggactaagactcaattaaacctccattgcttaccttggtgacatctgttgttcgcattgtcaggaaatctgttgtcattatttagaaagcaatcttttagatttcatgtaatcgaaggtgccaaaaatttaaattagcatgaaacatctgattcctcaaggcatcagttccttgaagcagataaccaatgagaagagatttatttctctcctataattcaggtttttattgcttttactttaataagagctttttgagatataagtcacttcatagattttttccctgagtttcttttccttttgttagctttttaaaagtgtatttgttcatgtgtgaggtagtgtatgtgtgtgtgtgtgtgtgtgtgtgtggtgtttaaagatagagcaaattgacttttgaaaagaacgtggttaataaagccattcgggttagtaatacaggatggagtaagactgattgagcagcagaaaaaaatggaaagtattaaaagttcctaattaacatattcattttatgagctaccattttctcactaaatgcctcttttgactctggcagttgctattgctatgacatattttaatttataccctaaagccaagtggaatatatatcttcataggtaaaatatagcaagatataaattagacagtctaatatttgatactggttggagaaagcctttccctgacattcctttgactgaacctcctagataacatgttgcctattatttgggagggcagtaaacctacttaaatacccccagttggttgttcattttcatcttcattcagcttttcatttgttcagcaaacattgaatgtcccctgtgtataaggccctatctgtgcttaacattatgcaagtcatgaaattcataagaaataatatctgcatttaagaagggtcttagacataaccaaagtacaaggtagattgaggatcataatatgacagactggtaaacagaatgctgtggaaacatagagggagcaactaatttaacctgagcagtcagagaagattgtatgaaaatacagtattttgttttgccttcgaaggaccagtacgattttagcagatagaggaggagaaaaggtgctaagtgcttccaacttaagggaaacattaatttattaagtgctttttatgtgcaaaacagtctgctaaatgaattctttcctatgagccagttctttatccccacaatgcatagaaggaaacggaagcttgcagagattcagtttattttctggccaaaagaaagagcaagtaacagagtcactgccatatttgctaagctgaaagacatttctttttttcattattgtgtcagagagaggttggcaaacctttgcttaaagagccagatagtaaatattgtaggctttttacactgcacaatctctgtcacaattactcacctctgccatggtatacaccagactctctggtgtatagcttaaaagcagccatataccataagtaaatgaatgagcatggctgtgttaaaaaaaaaactcatttatagatattgaaagttaaattttacacagttttcaggtttcatcaaatattcttctttttaatttctgaactatctaaaaatgttaaaactgttctttgctcatggctctacagaatcaggaggtgggctggatttgtcctgtaggacatactttgctgacccttgaagctttatcaatacttatcatgagaaataattaagggagaaagagccacctaccctttatatgaggccatcgcatcacacaactcctgggtcttcatttgatttttagtccatctgaatagcactgcctgcaattgtggtctctgcagtttgagtgaccagtgaactcccaacacggaggaatataacatcggatgttactacctcttacacagatgcatctgctgaaaaataataggttaaaaaaatcatctgagataagacttgactctattattgaacaaagaaatgtttccaggccaactcttaaagtgagcaaagttatgtcatacttaagttaccttgtttgtcaatctttacacagcaagggctttttatgttttctcctttatcttcaatggttccctttttgattaaaaaatatgaaaaagtccctgaagtttgacttacttataaagtgaaaatgatgcaagcctgattatgtccttagaaagcattgatgatatcctgtatacttcaatatacctagtgaattctaacacacctgaatggccttgatgtagaccagaacatttagagagacagaggcaaagcacttggcatcagacggtggatcccagagacgttttaaggttcactagacatttgctgtaagtttctagggctagacttctggaattccactcttgttggttgagaagtagagtcttgataaccaggagtatattagagattttcatggaggtctgtctgactgcaaagactctaagagtcaaatcatcataagattctactcaataaagtataaagtatgaccttggcaacgtttctatcctctctgtacatcagtttcctcttctggaaagtgggggtaataatagctacttccttaggttgaatagaggactaaataagaaaataaatcatttaaattattttaattacgctctttgaatttttgtttacccttttctccagaattaaaaatagaattcatattttctacattcctgatttatctgttatgaatgcaagctttttttgcttagacgcttttggattccacattaaatgtgaaaaaaaatcatctcttatttttgttcatcaatatcgtcaaaaaaatatgatatacccaggcaattgtattatttagcttttaggaaaagtcttcctttttgaaagtcattttattgatggtgtgaattaacacaaaatgttaggtcaatttagttatcgtgtgcttggagaatatttattcattctggagatttctggatgtgctatatagttatggtgatatatgaaaacaaatcggaatactctgccaaatttttaacaagaatctaagtcataatgagatattagtttacttgatgggaggattgattcatttgatttttcctaggggaaaacagtgtttcaggctttaaagatgaaatatgacacattagatcctctttaggctcagtaaggaaagtttgctttaattttgcagaactttaaagttcagttttattctgcatactgatattaactgtttaagatgattttgagtcaaagaagaataagaataagatattttgttggactgcatttatgagccttagagggcatatttagactaatgtgtctttccatttgatcctaaaatctgtagggtattaagtaatgtcttactggagttttcatatatggtattagaagtttatttcctctgatttaatttcaaaactcaatttcatttatttcagaaaattccagcatagccagcatgatatttcattgttttgtttaaatcaatgtttctcaacttggctgcacctgagaacttcatggagcattaaaaaagaaacttcatccctggactcatatgcgtatttaattggtttggagtgtggctcaggaatagttttttttttttccctctttttttttatttttttaaaacaacaccagatgattttaacgagtagttttgattgaaaaccagtggtataaattagcacttctcaaattgtaatgcatgtataaaccacctgggaattttgttaaaatatagattctgattcttctgtagttctgggatgggacattgatgggattaatgctgctgagtcaaagaccatattttcagtaagaaaggtctaagctaaggcccaatgtagttagaaaacattttatcaatcaatgccttgatactaaataattgtttatgaaataattaatgtttacttgattactcgaaatgatgtcatactcaacattttacaatggaccatttttactgccatattgcttgattcaatcctatattttctgaccacctactatatacttactattttgctagtcttgcagggaatgtacagagtagaaaaatagaaatcctatgcttaaatagctcagagaatcagagtgtttatgctaatgaccataattaaaaggaaaaggcttgtaagtaaaatttttgattttatacttaattttgaggtattatgcctttttgttagagagatttcttacgttttagaaattattgaaatctgacatcttttctttctctctccctttctgcaggatgcgtgtgtgtgtgtgtatgggggagtagttcttaggggtttttatctacttttttgatgggtttatccaaagcaactagaggagcacttgattggaaaaaaaaaattacagtcacgtgtcacttaatgattgggatacatgtgagaaatgcatcctcaggcaattttgtcactgaacaaacatcatggagtatacgtaggtaaacctagatgtgagagcctactacacacctgggctgaatggtatagactctggttcctatgctacaaacccatatggtgtggtactgaatactgtaggcagttgtaacgtagtgatatttgtgtatctaaacctagaaaggtacggtaaaaatatagtattctaatcttatggggccatcttcttatatgtagtacattgttgaccaaaacatcgttatgtggcacacaactatatataccataattccataatatttaactgtctgcagtcagatctaaaaaccattttgaaaactactcatatagaatacattttagagcttaacatgcaatggagacaacattttttgtcttcagaaaagtgtttttgaatctcttacaagaaatttaacaaaatgatccacagctgttgccaaaggaattaaaagcaaagtttatgcctccccacggccagcatacttgtacgaaacaaatgtcaaaagctgcacgtggggaacttggaatggtttaatttatgtgtacggagtcagcacaaaattcatagcagtctgtcaccaaggtttgttagctaattgctgtgttttaaataaatgtgaattttaacaacactgtttaagagcctgctgtctccctttctcttggcacacctaggggttcaagctattatctgaacacattttctaattcttcgagtactaagggggcacctctgttgtctttgacagtcagtccccctccttaataaaatcagctggacacattctcaggaaaacaacccataagagagaattttcatgggctactactactatttttttcttcacacacttctttccccataaagcacgaacaattcagattgtgccacaggctgctggagataacacgtattgagttttcctcgtctgactctacataaaattactttaggtagggagaattcattttactaactaaaaaactcatctatttgtaaccactgtgttcgatgtaagctcatgatgtaagcaaaaaagatttccttttctctctctctgtcctccttacactttgttacagtgtggcatatcttcatgtgttcctggacataacctctggcggagccatgacatctccacagctctacagacactttagatcacaaacatagtgccaattcagtaattagaatggagtccaaggtgttaatccaaacttaaaagcttgtgtaatcaacagttaaatcctctcccaggtgaggtttgctttagtgcagaagcctgtggttggaaacggaagtatagcattagctcctcttagagtctcttactacctagatgctgtgttagctctaccaggaccaaagtgatgtgtagagcagaggaggtgtaaaaatagtacagttcttgtttatctgggtggcttcataaaccctcggccatggccaacgtttgaagttgaggttttcaggtagaccaggccaatataaaagccatctttttttcctttcatgagtgttttcatggaatctttaaagattccttgctggattctctcacctgcagttcccttagctgatatttctattgcagataattcctttgtggctccttcctcagcccctgcgtaccctgtggtgtgtggccggtctctttgtggtgaggttcctttacccctgtaccccagtttagcttatccgaagtgactccctacccccatctgtcttggcctacatctgatccagataaaaccctatacatccttggttctcacaacttctgggggttgtgccctatctcaatacagcggtactctcctatctgtttctgctatcaaagcagctggtcaggctttcagtctctgtatatatttctctggcatgggttagagcctagtaaagtttaactttttaagaaatgagtcaggcccctgtcctctgtgtctttccattgcagagagataacacctctcagccctccctccatagaagcaggaaaggggacttacaacacagcaataactttctctggagaaatctgataacaggctttctccaaaattctatttctgacccttggacctctatttataccttatgctaactgagaggtccaagagtaatggaatatgttctcccacatcacatgtgtaaattctgcatatggagatttgtgtaatacgcgggttgtattatggtatccgctgggttgattctacagtgaaatctgaggcaggaagaatcccagtccaaggatttgttacatattttaacaagttggggatgaacagaatccaatttagtgtgatttcttagccactgaataaacactattagttggcacagtaaaaatttggtgggagatcaaagatgtataaaatataacatttgtcttcattggcaaacaacctaattgggaaagccagatacactgtaaatagctaaatatagatgaatacggctgtgatatacacttgcctaaactaccctggtatggtatcttgtagtttgtcaagtcagaaggttttgtacttggcaaagggaaaactagtttgctaggcataggaacattttggcatgatgattttggtttggagattggtgaggttattgatattatcgtagagatgcttcaagtgacagaagatccggttggggaagaaaaaatatgtaacagcaaattataaacttaggctaagcccacagattttactgagtaatttctgtcagcaaaagcatccacagtgaagacattcaaccattagagacatatatgagaatgccacatataatcccacctacgagatcagctattaagaattctggcattaatcctaggtgtgaatcattggtcgtgaaacctcacacctcgtttattttcattgctacatcctatgcttcagcaaacttttccttcaaccattacctaaagttaaactatttccactattttgtggtaagaacatatttattgtctttttgtatcttataaaaaaagagggaatttctgattgtttcttctttgaggaaatatttttaaactcccctcaatctacagatttctttagtgaagaaagtataaaaccaccctatttctacttacaaacatttcctaaaacatttttttcctctcatgggaaaattattgccatgaatatttatacatggcatgtcagagacttagtgcgttttgcccatacacttagactttccttgttccaatctaatgcttctggagtttttaaataacataattgtgctcagctcaattcattttttgttctattttatggatatattgtcagctacatttttacgtatagaaagttgttttacagccattgaaccatagccttaacatctattgttatggttcttattcatcacccccaaaataatttttaaaattccaatacaactcttatcttatgatgcagtattttcattatgaagctttcccttattcagtttcttagcaaaaccttttctgataccagaccgatattttccacttatgattctgttttccagtcatattaatcaagctcaacccatgaccttgaaaaaggatgaaatagaggaattgcccttgggtataatgaattgacacaggaaaagctactcatgatggatcttaaatgcaaccaagcaatttgcttagattctcaagagaatgattttatattctctattaggatgtgtttaactgagtaactgcagttacgtaagtaatagtgatgctgtgcagataagggggataaatatacgtgcaaatgcaaacacacacatcacacatacatttaataaaatctgattcgttagtgacgcatatttctgcagttgctaagcattgatgacagcatatcatattcaaagatttatagaaacacgattttcacaagtcgttcactgctttctttctctttatgtggaacatgaatttctttcatatatcattacttgaggaacttctagtcatcaatctgcccatttgtgttaatctgcttttgagtcacccaaaagtttttatactttctttaatagtataaaaataaaatgcttcaaaaacctttaaatcttcatatggattacaacagagcaaaagattaaggtatccaatattaaccttctccaattttaaagaaaatgaatcaactacatactgcttatgctttaaatacgtttttattataaacaaactatactgtttttaactgctattgtttattttatttatgtatttatttattttttgagaaagggtctcactctgtcacccagctggaatgcagtagtgtgatttcagctcactgcaacctctgcctcgcgggttcaagtgattcccctgcctcagcctccttagtagctgggactacacacgtgcactaccacgcctggctaatgtttgtatttctagtagagatggggttttgccatattggccatgctggtctgaaacttctggcctgaagtgatccatccaccttggcctcccaaattgctgggattacaggcatgagtcattgcacccagccctatcttttaaattatatttattgtcgtgtcttatatttttcctcatgcaaaattttcctggttcctctctcccctgcaaacaaacaaacaaacaaacaaaaacaacctttactttgtaacatttctgttcgttttgcttttttttttttttttaaattttaccactaccttaccaatatgcaagcttcactggttctgaatcacacagggtaccgtaaggattggaatttaagagtttgattctcaaacatttgctgcatgtcaagccctctcagaagtcaagccctctcagaagtcaagccgaagttcaaaaatagaataatatcgtttagaatttgctcaccctaatcttgtataaagtgtaaatttgtattccttgttatgaaatcaggagaaagccaattttcctgtgaccatggaaagactcttcaaagggagacttctggcaaagtagtatgtttatgcttaagagtaaaaacacaaacaaaaaaccctccctagtcaaataactagaacatttggttaactcaaccaatcagcaaaatcagcaccaaaatatttttcatgaaatagatgaactacacttagccaccactgcaccataagtggaagttaaaatggctctgaagagaagatatggagaaatctattctttaagaagtcaaaatcccaagataatgatgggtaagggtttccgagaaattactcaaaagtcagggatgtgcacgattacaagcaatatgtgtgcaactgatatagggattagagcttcatctgccactctctgatgttgatatagagatcatctgggtgatggacaggctatattttgattgttattgaataggaaattgggtctaaataacacggtggcaaaactaggacataaattcaaaattctggttctatagctaaatgctaatgctgagactctgacagggcttttgatactgataaaattacccccaaaagatatgggaaggtacttatttaatctgataaaatgtgggaaaattagaaaaggcatgtagcaataatggtactggtttaatattttgaagaataaccaagtcacgttatattatttgcacagattgctcttacagttttacaaaaaccaaacactagtaggatcttacatttagtctgtgagagcataattacaatttatgagcttatgggaaaaagttactgaagggtgaggttttctgaggagcacaattcttgaaatccagacttggaaactagcgatggtgaaaacaaatattaatttccatatagtcactaaccagatccaagctaattaaaggaaagtccaaaagctcaagaaaattcagtttaaattgcctgagttgagggaatgctcattattcatctattctgctatctgtgtgtttaatccataaataattacatcaaataaaaccatacttgaaattattctccaataagacttttaaaacctactttactatttttatgctgttgcctaaggaatctatttcatttcagtctaattaaaatggctcaaagagcatttttaagggagcaagagaaacttgatgttaaaaagtttttttgccattaaatgctttaaatatatggcatatgccataccaaataacatgcaaattagtatagagcacatcatttctaaagaaagtaaacccgcatattttacttaaaatatataaatatataaaatatgtacaatttatatttataagtaaacataaaatatgtaaatatctatacagtaacaagtatgttgcttataggtttacgtgtgtgtgtgtgtgtgcggtatgagtaatggggaagtagatttgcatagagggtacaaatcaataagacaatgaattattgcaaaagtatcaaaagattaaaaggaacaatgtatacttggtcagattattgaaagtttctattatttaacaattataaaattatgcatatttataagtcagaagctggaaatcaaagtaaatgactaatttgcatgggaagtaagactctgcctcattgtagctagttgtaagaattatgacagaagatgaggacaggacaaggaccaaccagctgggttcactcttctttggcgtgaagctgaatatttatgacaatgaattcatcttctggaatagcataacaagttaaaccataacagaagtgacttgcagtttccctccccaccagaaatgatgtcaaaaagcactataaatttcattaatgggatgttttaactctttgttgtggaatgccaaccagaggcctgccaggtgggtacattcatgaaatgccatataacttcgggaaagacattaatggctactggagatgttccatagacttaataataggcacatctctaggaaaatgtatgtgcatggctacgtttagtaaatgtaacatatttctttcatgttaaaaactgcttgggggtccgacatgagaaactatgtttaagctttggcaaataccattttaaatattgttttaataaagttaggtttacattgatgactaatcagagattgcaaataataaagaaataatagtagaggattaggttgtgcttacatgtgatatgtaaaacagatatctaattattttattataccaaacgtgaattggaatagattggaaaactttatgctatgatatgcattttaacatgatccctactgtgcattgataatttaaactttctaggtaccataacactttcttccccaactcagcttactcaggatgcacttaataagtaaaactctgaaatgttttctctccccagttagattgtaattttaattagtatacctctcccccagccctattcattggcttttgttagaacgattgtaatgggaaaagttgacaatgtttataatattaataatttaaacttttctctaacattaataataaattaccttttattgaggttttataatgtgctcagctatttgatacaatgctgtgagcagtatttctattaatccttcctgtagccttttatgagagagctgtgctgttaattcacattttacagataaggaaactgaggcatcagcaattaaagtatttttctcaagatctcacagctggtaaacaggggaatcacaattcataccctgatcagtgtgcctcctaagttaatactcttcctactagttcacatccatacctctcatctctctagacctatggcatgatatgcatttgcagagtgaacattttgaaacttagcaaaaattatataatgttacctaatgttccaaataatttgaaggagttttatatgtgttcattataaaataaatattaaggaaggatctatttgttatataaacacacttttaacttgttataacttcttttgattgaattgttaaactttttatagtgcaaagtgacagagaattttaactcatcattgttatgtaagcacttaatgtcttcccattggatcttttaatgtttatacattagcctgagaatcttggcttttgcctagttgtagaatcaaatatttttagtttaaaggtaaattacagattattagtagtccagtatcacattcaatgcagttatcctttgtacattttcctacatagcctctgaatttatcttcaatgataaatttatcaaatatcctatgttgtgtgtcaatattgcagagaatggctgtaacataataggaaattgaatacatattttatttataatgcatcacaatattaagatggctatcaacatgaatagaaacagaaaatgtagtatatatgcacaatgaaatacacttcagccttaataaagtgggaaatcctgtcatttttgacaccataaatgaacctagaggacattatgttaaatgaaataagccaggcacagaaagacaaataccacatgatctcatctatatgcggagtctaaatatttgaattcatagacgcagagagtagaatggtagttacctgggtcttggggagaggaggggttggggagatattggtcaaaggatacaaaatttcagtttgataggaggaataagttcaagagaactatggtacaaggtggtgactatagctaataacaatgtattcttgaaaatcactgagagagtggatttaagtgttctcatctcaaaaaaataagtatgtgagatacatatgttaattagctccatttagccattcaacaatgtatatatatttcaaaacatcatcttgtacatgataaatatatacattttttattcgtcaagttaaagttaattaatttttaaaatactgtggtggttttacaaatagctgttttaaaccagttataaatgaatgacaaatcttatgttaacaataatacatgattcatttcttttctaaagtgaataattttcatagcctaaatcattctgtggggaaaatttcctgcatctttttatgccgagagtctcaggaaaacatccgactttctctggattgatatgagagggcaagactccaaacataatttgaataacaccatttccccttccaaaccacaaactttagccacatccagccttttcttttttcaattttttaaaataattctgtaattctggacacatttaacagaaaagcaagagaacatcctaatttttattcaatcttcatttcttactgttaactaaagctaaattaatttcttttctctttccatttttttcattctttcttacttttgttcttcccttttcccttcctccctctctccttgttgccatattttttattaagtacttatgtaatatgcgttactcttgccaggagtcatgatttctcaatgtcatcttatttcctccttccctttcccttttctttaataggattagttccatgtctaggagcaaaaatccaacatcaataaaatggtctctctgctctaagaaatattatcttctggagattgaaaggaggtgactgagcacttttgtaaagtatgcaattgagagggtgagttcagatcctaggagcctgcaaaatcaaaccatatctcctcatccagagtcagaacatatttttccttcagtgaaaagtagagagatccaacgatttttgatacattttatatgccattggtcagaaataacctctggatccattgatcaattcataaatccattttcaaggatatgcatttcaacagttttattcaacaactgatgtgatttagtttcttattgtttctttccttggcattaagaccaaatcagttcccccagggtataatgagagcaatgtttcaaaaggcaataatgtgaaaagcacacttgatataatgctttttattataattaatctttttaggggctctttattttaattttactgagatatatatcttatgtgaattaagtactatttttcagagtatttttcctgactatccagtaagtttttttcttttctaccatagctgacattaatcaaaattaaggtgatccttgtgttacttgaagacaagtgattatttgtcaaagagttggcggcagaaagtactttgacagagacattgattctagttagaagcaaccaacataggtacatacatttttatttcctcggtcactgtagagttggagaagacttttcttttcttgtcttttcttgtcttctcttgtcttctcttctcttttctttttttttttttttttttttttttttttttgagacagattctcactccattacccaggctggagtgcaggggcatgatctgggctcactgcaacctccacttcctgggttcaagggatcctccagcctcaacctccccagtagctgggattccaggcacgctaccaccactcctggctaatttttgtattttttagtagagacagggttttgccaagttggccaaactggtctggaactcctgagctcaagtgatctgcccatcttggcctcccaaagtgctgtgattacaggcgtgagccaccatgcccggcttatattctttcttaagagcctgaatatttcgcatcctagagaatacaaaatttagtcagacaggtctctgacttcacgttactctcaatctatattaaaaagacttacacacaaaaaaaaattaagcatgcaattacctgtcatcttgtttgttggtgttcttatataaatacctagcatagactaaatcctaaataacgatacgtgtttcttgtgaggaatgatttatggacaaagtgctcaaatctaatgtgtaaagctcctgtgtaaccactatccagatatttggaacccttctaccactccccgaagtattcctaatgccccttcacagacaaagctctccatcaagaattaactaccattttgttttctacacctatttttttttctgtttttgaactttatataaataggatcatactatatgggccatttgtatctggcttttttttctcatgcaactaaaaatatctaatctttttcatgctgttttgtacatcttcgttcattcattattattgcaatgtagtattcctttgtattgtatataatacaatttctttacccattctcctgatgatagacatttgggttattttcagtttggagctattatgaataaagtttctaaacatattctagtcattttcttttggtggacatgtacagtcatttgtcttgggactttgtataagaatagaattgcacagtcataggctacctatgtttagctttagtagatagtgtcaaacatttcttgaaagttggtgaatcaactgatacacctgttatagccaaatttaggaatgtaatagtacaatagagttatagacaatacacagcatgactaaagcaaaagagcacaacttactctctatcagaatcaaagtgggttctcatcaatgacaacattttcatggcgcactccctgctcttagttaggaaaagataagcagctctttctaggagaaacatgttatatgagtttgaaggccctgaaatatttgatcaacagacaaaagtgagttgtggtgagacagaagagtttccatagagtgacaaagggtacagatttgtgtcccagtagctccattattgactcacgatcagcttaagactgtaagtttttcttatccaaaacccacaatcataggcaatggtatattttgtcctagaataaatataataggatgtctcacttttgctctttctggataccagtaattaagtatgcttcacctgatttcagcatttagaactctattctctttctggaagggccagatgttctttggcttgtatgaatttaatcttctatgtttgattttaaataaatgaacatccgagttggatccttcctttctagtctaccagaaattaaaaaaaaaccttcaaaatagatttatttgccccataatgtattgaattctttacagcacaaagaaagcttccattttatactatgttttgattctccagaaaaagaagatacctataggtatcctctattttttgtttgataaattctttaaaatcaattatctaaatatatcattattggcatttgaattattgttagcagcaattaggtagatagggagagtatgatcagaattttatggctgaaacaaacttgaaatatttaaatcttaatatatttttctaatatttgaatatttatcaaaaacacttatgcttgtattgtggcataattttttctcaaggtgtaaatattaagtggttaattaaatgtagaacattctttggtgaccaaatatgaacaggtgccctgttttcttgtgctgaccataacttatgcacaactcatcaaaataatgactctaatttttccttagtgtacacttaactagctaatgattaatgctatcccctaatcaaaactgtttttctttggctaaatgtggcatttccagggccagagaaccaaattcaaaagttaccagaataaacagaaatagaaaggcaaatttaggcataccctaaaacgttaggttattatgtcagatttaatataaatgttatttgaattctcaatgttttagattatccacatgagtgcacacttcgagtactaagcagaatggagttgactgtataaatgaatcgataataaggttgttttaaaaatgtattttaaaatatcagagcaatggcttccatatctaaagcactcttgtcttctagttagacaccagcctttctcaatcgttgctttttgttgtagtgtagtcctggtgacaatgccattcaacgtttttttgatgcaaactgcttgaaaggagccccaaattgcctttggtcagtgtcacataaaaactgatagaatgtgagttgtaatgattgcctcattgttcagacaacattgagagggtcacctcacatgcctctcccttttgtagtctgacagtaggcaaagtgccaccagaggaagagaggggtttgttctttccattctgaagttactatgtgaacagtctcaactcatcaaaagaatcagggcaaataatgcctttacaagcaccatggaaaacaatcaatgttccctagcaacgaaagctggagttttcacaaagtcattcttaagaccctgattctacgtgttgagaaaaaaaaaactcctctcttcctaaggccaccatattgcatattgaaaggtagcattcaagaccctactgactgttcatgaagtggtggaaaaattattttactgtattactatattttaaatattctgtgggggctgagtcaggaattatatcacaaatttgattcagagcaattgtttgaccaaacttaatcttttacacacgtttatcgagtagctgctgcatgcagtattgtatatgtaagtataatcagacaagtttttaaaatgaaatactagattcatacttgagttctctataatagtgttttattattcagctgtcatttaatgaacatctgctttgtgaaagacattctgctagggaccttggatgggagttatatcacatacctttcctcaaaaaacttgtgattaatattataatagtacagtgggctgcatttacatagcccttataataaaaactcgctaccatcttcattatgtaattattgaagcagtttcattttagtcatggttgactagttttgcatttgttaatcaagtctcaatttgagcgccaaaacagttgttaaaactattcaaaactcttcactaacccaatcaataatcactgattgtaatggtagacagagagtgatgatagtaaatatggctcatcaagcaggtagggttttctgatagatcaaattaattgtgttaagctaaaataaaatgctttctaaagaattaactcttaggattttatatatttgtgtatttattttgagacagggtctctctctgttgcccaggctggaatgcagtagtgtaatcaccgctcactgctgcctggatccccccggggcagaagtcatcctcccgcctcagtctcatgagtagctgggaccacaggcgtgtaccatcacacctggctaattttttgtttttattttttgtagagacggggtctcactatgttgcataggctattcccaaggttttataagtattattagtccagaagactgctacaaataattaaagggaaactttgggatcatccaagaatcttaactgtctgaatacccaggatagcttaaagccacatgccagagaatgtgataagtatattcagtgttagtaattgtgcaacatgaatagtgatacttcttaaattcagataacttgaagatgtcaggataggtgaaagcagctgcatggagaatatgaaaagtgccatattgggccacatctatacatctgaaaatagcttcaaataacatattgtcaaggttgttctccatggtcatgtttcagttcaatgtacactttaactatgtccaagttccttaatggctgttttattaatttgccatttgtaatttttatctcagctcctttgaacatgtgtattataactaatggtttgatgaaatttgtcctagaggaagtagatgttcatagtttggttccgttgattctagatagtatattggaacaagataaaatttgctgaaccatttattccccctttagaactctcatggctgatcatagagaataaaataagaaagtcttgaagggtcagatagctcaatttcttaagcagtatgtgggccccaatttaaaaagtcctaattttttagacattacaatatgtgttaatccaccatctggcttaaccatatgtcaggaacactactttcagaagctaaatacttttcattttcaatatcccttattattggtaaagtcttatttagagcaaaattctacctcactcttttggccttcatctctcctggaagccacacagaagctgttgactgttttttctataaatctttcccagacttaacgtcttcaattttgcatacattccttattaaaagtggtagaatcaataactatataatgaaatgatttattaaattattgaccttgaactgtcatctcctgccagtgatcgctaggtgtggattcagaaaactgtcagcaaaatatgtgccatcatatagacccacatagctgaaattctctccttatgctcttttgacagaatgcaagttggctgacctttaaatcatattgtattcatgattgtgaggtgagcagagtccattgagccatatctgattgcatgcatgggtgactgcaaaatacagtgacctttaagctagtagaaactgaatgaatgtttttttagccaggtagaagggcaaaattactcaccaatttgatactctacagtgacgaaacaactcttcagtgctgaagtctctggggatggcagatgagtgcatctgcttgttgactatttgggattaggctgcaagcatgcctacagatttgggtttgtgctacacaaatgtttcccatcagcaagtcttagcaccattgcacatcaccagtctcctttcctcaacattctgttttgtttcctgagagttgctttaggatattccttccttccttccttccttccttccttccttccttccttccttccttccttccttccttctttccttccctccctcccttccttctttctttctttctctcccttccttccctgccttttctccctccctctctttccttttctttttctttctttccttctttctttctttctttttctctttctttcttctttcttcctctctctttctctctctttctttctctctctctctctttcctctctctctctcctttttttttttttttgacggagtttcactcttgtcacccaggctggagtacagtggcacaatcttggctcactgcaatctctgcttcccgggttcaagcgattctcctgcctcagccttctgagtagctgggattacaggcgtccaccactgcacctggctaattttttgtgttttcagtagagatggggtttcgccatgttgtccaggctggtctagaactcctgacctcaggtgatccacccacctcggtctcccaaagttctgggattacaggagtgagccaccacacccggcagctttaggctttcttatcacttttatatttatgtcaattagaaccaggtcctacctggaaaagcctgcatactatctgaaaaaataagtacttatgctatcttgagtcaaggaaagtgtatatctatctacaacatcttaagacttccagaattccatgggcagcaccactaaattcagtataatgtttggcccatttatatttactccacttatgttaaagattaatttctttcccttttattgttccaagtggttcttgatgtcacctgttgtcacagtgatccttttgctttctttttttataaactcatactaaatatgtaatcaagtatgtaattataattctaaaatataaattttaaaattcatttagtttatgagccttgccttgaattggaacatgcttttggaggaagcattttaaaactaaagctattatttccggtaaatgttttgaagttatgtttatgttctgatgttattaaaaacagaattttgtaatgtgatgagatatcaacgaactaggaattccattttaattttaatgttttttaagtttttaagtgttttttaaagtttaatgtgaacttaaaacttaattgtcctactaatcacttttttactattacatttattcagtcttttagcattagggtccgaaaaagcaaggactctgttgtctgtcacttataattctagacagtctagtagaagtaaaacttcctctgttttgtaaagccctctctgagtctccccaggcattgttactgcctccttctcctagcctcttgccattcttatgatttgtggctactattctaacatggaccaaattgtattaaattctattatattcttgtctccctgaataatgattaccatgcaaattatttaagggcaaggaacatgtctttctctgtttccagtaccttccatgctacctggcatgtaattgatggccattaaatattcattgactaaagagtaaattgtgcttatgcaaatgcataattacttcctgattaaatatttctgatgctcacatgtaggaggaagtgttatgattatgccaatagctaattgatgcccaataaatgtttgctgagtaaacagtaagtccttggccgggcatgggggctcacacctgtaatcccagcattttgggaggccaaggcaggaggataacttgaggccaggagtttgagaccagcctgggtaaaatagcgagaccccatttttctgaaaaataaataaataaataaataaaacaaaataaaattgccgggcatggtgtcatgtgctcatggtcttagctacctgggaggctgagatgagaggattgcttgagcccaggagttcaaggctgcagtgagatttgatcatgccactgcactccagcctggatgacaaaacgagttcctgcttctcagagaaagtcccaagcaaacaaactaacaaaaaaacacagtaagttgggcttatgcaaatgcacgattatttcttgcttaattgtttctgaggctcacacttaaaagaaaagagtatcatagttgcaatgagtcttggaatagaatattcaaaaggggcagttaattgcatgcttgggagatagaatccccagtctgtatagagaagataaccacttggtccagaggaaactcagactcgaagggctctgggtcagtaaggtaaagctgcattaatagcttcatctgttgtgttcatctgtcaacatgaattttaaattaacaaaatatgactcatgtgggatagtattctggatttcaaaatcagcatttgttgatcatactgtgcatatcttctttcaggtttatcataataatcttttgtcaactattttgaaacaatttatttccctttgaacagataatacattcacttaactcacaaccataagatacaagataaattgaacaatctcattctgcctatctatagccacttttctataggctatcaatattacaattttcttatttgtcagctggagttattattattattactttttgcttatacccatataagtagatatgtctatttacctctctttgttagaaaagatagccactgtccacactatcactccattttgctctttccacttaatatttcttggagattattccgaatcagtacacagggagtttctgtattttttaaaagctatgtggtattataccatagactgtgacatacgtgatttcatcagtcccatatttctgaaagtttgcctcaatattttgctattataaataatatagttatacatcagtattctgcacattttatagtatatctgcagagtaaatttctaaaagtagagcagaaagcagaatatttgtaagtttgctagataatgccaaatcgatctccctagatatagtatttacactcaataaagaaatatatgacacgacagtgccaatttttctgcactttcactagcacagtgagttatgtaattttaaaaaatatgatggataaaaaattctattcatcatagttttaatttttactttatttatgatatgtggttttagcatattgtaggagaatagccaatagctgattttattttaattttgttttacttgtcacctatccttgcttttgttcttatttggatcttggtctttcacttatctttctgaaggaacccttttatattcggaaagttagcccttgcaaatgcttcccactttttaccttttgattggtttatggcattttaagtaatacaaaaatttttgcattttcataagtaccgtgtgtttgacagactcaacaacataatgatgttaacattttattaatcttttttttatagtttctgagattttaaaatctcctactgaggaataccttcctattccgttgtcatttaaagtcattaaaatgcctgaagtaaatttattgtttaaaattttatgcttaagttggatatactgtaaagggaatttacttgagttttttttttttttccataaagctgccctaatgttttaccacaatattttaaataaactatctttttccccttagtgttaaatgctaccttgaatatacatatatgctttacttatttggacttctgtactacccaggctgttccaattttatgactgtttattcatgtgccaataacacactgatttaattattgtagctttactttattttttaataacagcaagtctacctcttcttttaatctccacatcccacaccaaattgctcttcgttttcatgatcatcctagttattctttctgattttgttttctatattaatgttagcattaggtttttcagttctctcagattttcttttggtattttatttatagatatatttaaggttaacatctttatgaagttgaatctgcctgtttaagtacctggtattgttttgattacctcagaagtattttgatagtctctaaatatagatcctgaaaattaactatcagtattattcctgaatattatgtgtttttccaccatgatcttctatataatagaggttatttgtatacataaaggaaaatgatttctgtcttttaattttatactgagctaactgactaaattttcttactatttttcatagttgctcagtaaaatatacttttctttccaggtaaacaataatatcagcaaaattaaattgcacctgtaaacaataatactaatttttgtcttcttaatctttttctaaggttattttcttttactaaattatatggccaagtgtatctggaagggtcaaatagcattgtagtaaggactggttttaacttttttttgagatgattggattttggcaagtttcctcctttggtaattcatatattacattttctatttttgttaattttactttaatataatattatgctttatattcaggtttcatattaatttgtagagtttattaaaatagcctttgatttttaaaattttccctgactgatcattacttgcttattatttcttatattgggtgtttgtgcttcttcctttcctttttgactgggctacttcagtggttctcaactggaacaatttggttctcaattggaacaattttgatacccccaaggggaaaattggcaatgttcataaacacttttggttgctagaactaggaaggggagggctactggcatctggctagggatgctgctcatcccataatgaacaggacagctcccacaacaaaaattatcttccttaagtaccgaagtggaaatatcctggcagctaaaacttatttatattattatattttttcaaagaacctacttttgtatttatttactagtcctactcttttgtttctaattcatcaatttattttaatcattgcaatattcttccttctactttccttaggtttcatgatttttaactaatttctgaatatgaatgcttaatgtgtttttctttttacttgttcccttacataaatatttaatgcagtgatttgtttttctgaacactgcctcagctgtaccccataaatactgatgcaacgtatttttattatttgtctctaaaagtcttgtaattttggtcttgatctcttttttgattgaagatatactcaagaacagttggttttgttatttgaagtaacttgaaagcctttttctttattatgtgaatttagccgtatgaatttcattccttaaagaaatttttgcctgcagtcatgagccaggcaatgttccaggtgctcgggacacagcaatggacagaacaagcagacatcctttccctcatggaactatcaataggggagatgtatttaattttaattctagcatagaatttcatgttatcctttcccatctttaaagctttttgtatttcctttttacctactttggagagagagagagtgctgcttctgctcattagaaagttggtattcttgatctaatataatttttataccctaaatcccctgtttcttcaaactgtttttgattctccactataatcagtgatggaattagtatgtttgtttttctttatactgctttttcctcttatccccttgatttcggttaattacataatctttgtagtgttttcctttgagatattaaatacatttatattcacattacttattttgaagtattgaaaatatcctttaactcctggtattataagtgagaaaattaccatacttatcactctcccacccagtcatttaacatttacattctcttctgtcaccttaatccttgcatatgtttaaatcattgttcaacaaatgtatagattcaaatttcagtactaatctttttatatagtctttccaaaaatatctttctgttcagtgaaattcttcttcagcaagaactcatgggaatagtattccctgaattcttacatgttaaaaattgggttttgtttgtatttgtacttgaacactgtggctagatattaaagacttggattatatttttctttccttgaatattttgtgggcattgattcactgtattctagaattaaatgttgctgtgtagatatctaaggtcagctttattttttccctcctcgtaattggcttgttcttatttcctgaaagctcaaagaagtcctttccttaccctttaggttagttgctttaataagatacaacttaagaaaaaatagaggctttgctttgttatggtgaaaagcatgatagtatcataaaataaaaaattacaaataacatacaaagtagagataaagacctctgagaaattggggggagatatgtcttctgacaaaatatcagaccaagatatttataggatttaagctgagtcttaaataattagagcatgaggactggaaaaggaacagaatacagctgggtgataatgggacattgggtgagataatcactgtgcactaggtcatctattttaccagattctgagcagtttgaagtcaacaactacttctgatgtctttttatttcttgcaactagcaaaatcttttgcatataacagctaagtttacatttattgttgcatgttatcattcttattgtagcagataaacatatttatattggttttcagagcaaaaaaataataattttatcagaaaatcatcttaaattcagtgaaaagttgatattccaaaaaaaataacaggggaaatcagataagtcattgtattattattataacattgatttatcttttcttgaatggcaattattgtcactgctgggctggaaaaatccagaaagctctccagtatatggtaattagatatgggatctatcagtcatcgtgtggtgttgaataacaaacatatggaaaaatgaagcatgaatgcatctgttttgtactatttcctctgagccttcagcatactaatggattaccataagggtggggattcaacatgcacaacatctatgaaaaatgtataagacaactttcctggttgagtttttctctaccaagaaggtcatatcttggactttcattcaaagactattatttctgggatcttcccccctgcacccatagtgtctaatacaactttttctcacctttcatcttaccctgtttcactaagacctcagatatttactggggctttccaaccttaaacttagttgtgacttgggttaccccattagcaggattagtagtctatcacaacagtccccaaccttcttggcaccagaaaccagtttcttggaacgcaatttttccacagactagttgggggttggagatggtttccagatgaaactgtttcatctcagatttacaggcattggttagattctcaccaacagcgctcagcctagatccctcatatgcacagttcacaatagggttcatgctcctatgagaatctaatgccactgctgatctgacaggaagaggcagagctcaggcagtagtgctcactcacccgctgctcacctcttgctgtgtgaccagttcctaacaggccacagaccagtaccagtctgtggcccaggagttgggggcccctggtccatcacacacttgaagagctattgttagaataagcttcacataattaacggctttgtcccaatttggtattaaaagagcaatttcccatcttactctgttcaccacaattcagtgtaagagatcagggatttgttcctacttctttaatggaaaaacaaatctatcaaaatcagtagttctggaaacatcaatgcaaacaaaatggacaagtttccatggatttttctattgttcattttgaataacattaaagtgcatggatgctaccatttgtatgcaaaccaaatagagaatagaaaagagctagctttttatgtatcctgcagatattttttgggctcaatttatattttgggccatgtacacttctacatgttacacatagacctcatgtcttttcgtaagtatgaagactaggaaaagttatacactaagcaagcccattctgtgggattggaatgttaacctgtattacactaaaatctctgcttttattaggatgctggtctactttccaagatgagtactgtttgtggaaaatgcacttcccatcacatttgggagaattagattagtatagacttgactcagcatgagcttcagccatcccaggttcaccattgataggcctagcactgtccaaagattgccattgataatgtgctccaggaggattacatgtggaatgaccaaaggaattcactgagttagagtaaactttggacctgtgaggaacctttgaagcagccataagatgatggaaagagcaatatacatgtaacacaaaagcctgggattacctgctctgctcttttccagagacaactcactgaattccttgagcttccatttacaagtctgtccagtggcacatcaaataaaataattgaagtctttctgcttaagaaaactttaaaaattacagttcagtcattttatagtacaggttaacaaaactgaaacttggagtaagaaaacgacctggtggacccctaccattatgcatccacccattgtctccccctgctggcacactccaaccatgacctcccctgccagcacgtacctgcttgcatcctccccctgtcagtgcatacctgcccatagtctttccctgccagtgcacacccaccctcagcctccccctactgatgcgtactcgcctgcagcctcctccattggtgcacatgtgtgtggagactcccactgccccactggagcaattttgccagcagcccctgccagagtgttgttgcaagtgaactgggaacacctcagcacctccagcacagcaggtgcttaatctcaaggggccagagagcaaagccacaggactaatcccccatcccccaggattacagcatgcagcccaagagtgctgaggtgagctttggctccagaaaagcattcagaattgaaaccaatccatgaaacccaatttataccatagtcaaaacctcaagagcatcaaataatagaaaagcaaaaagccccatccaaaagacagcagcttcaaataccaaaggagcatcagtccacacagataagaactagtgcaagaactctaatgattcttaaagccagagtgtcttcttgagtctaaatgactacaacttgctccccagcaatggttcttaaccagaatgaaattgctgaaattacagatacagaattcaggagctgaatgacaaggaaccacatatagttacaggagaaggttgaaacccaatcccaagaacacggtgaaacagtccaagagttgaaagagtacacatccattttaagaaagaaacaaactgaatgtctggagatgaaaaattgactccagaaattttataatgcaattggaggcattaataactgaatagatcaaactgagggaaaaaagtctcagaactcgaagactgttttttggaatcaatgcaggcagacaaaaataaaaaagaatttgaaaaatgaacaaaagctctgagaaatatgagattatgtaaggagaccaaacctgtaactcgttgtcattcctgaaagagatggaaagagaacaagcaacttggaaaacatatttgagaatattggtcatgaaaatttccccaaccttgctggagtgatcaacatgcaaattcaggaaattcagagaacccctgcaaaatactatacaagatgaccatccccaagacacgtagtcatcagattcttcgaaaccaatgtggaagaaaaaaatcttaaagacagctagaaataaggggcaggttatgtacaaagggaactccgccaggctatagtgcacttttcagcagaacccttatgagccagaagagatcagggtcctatattcagcatctttaaagaaaagaaatttcagccaataatttcatattcagacaaaccaaacttcttaaatggaggagaaataaaatctttttcagacaagcaaacactaagggaatttgttaccaccagacttgccttataagagattcttaaaagagtgctaaatataaacacaggagatgattacctgccaccacaaaaacacacatatgtacatagcccactgacactataaagtaactatacaattaagtctacataataaccagctaacaacatgaggacaggatcaaatcctcacatatcaatattagccttgaatgtaaaggtactaaatgcccctacttaaaagacacagagtgtcatgttgtataaaaaagcaagacccaactgtagatccatctcacatgcaatgacatccatatgctcaaagtaaagggatggagaaagatcaagcaaagggagagcaagaaagagcaggtgtggctattattatttcagataaaacagactttaagccaacagtgatcaaaagggacaaataagggaatttcataatgataaagggttcaattcaacatgaaaactatactaaatatgtatgcacccaacactggaacactaagattcataaaagttcctgcagacctataaagagacttagataatcaaacaataatagtggcagacttcaacacccgagtgacagtattagacagatcatgaaggcagaaagctaacaaagatatatcaaatgtaaactccacacttatcaaatggaattcggagacatctagagaatactgtatctaacaacaacagaatgtacattattctcatcagcacatggcgcttacacttagactggccacatgcttggccatatagcaattctctataaattcaaaaaaaatgacatcatacaagctacactctcagaacacagcaaaataagaatagaaatcaataccaagaaaatctctcaaaaccatacaattacatggaaattaaacaacctgcccctgaatgacttttgtgtgaagaatgcaattaaggcagacatcaaaaatttctttgaaactgatgaaaatagagatacaacaaacagaatctctgggacatagctaaagaagtgctaagaggaaagtttatagcatgaaatgcctacatcaagcagttagaaagatctgaaattaacaacctaacattacaactagaggagttagaaacacaagagtaacccaaccccaaagctagcagaagaaaagaaatatccaaaatcagagatgaactgaatgaaattaagacatgaaaattcatataaaagatgaacaagcccaaaagctggttctttgaatggataagtaagattgatagaccacttggtagattaataaaaatgaaagaatatccaaataaacacaatcagaaatgacaaaggtgacattactactgaccccacagaggtacaaaaattccccggagactattatgaacacctctctgcacaccaactaaaacacctagaagaggccaagtgcagtggctcacgcctgtaatcccagcactttgggaggctgaggcaagcagatcacaaggtcaagagatcgagaccatcctggccaacatggtgaaaccccatctctgctaaaaacacaaaaattagctgggtgtggtggcatgcacctgtcattcctgaaagaaatggaaagagctactcaggaggctaaggcaggagaatcatttgaacctgggaggtggaggttgcagtgagccaagattgcgccactgcattgtagcctggcgacccagggagactccgtctcaaaaaaacaaccagaaatctagaagaaattgataaattcctgaaaacatacaacctccgaagattgaatcaggaataaattgaaatcctgaacaggccaataacgagttctgaaattgaatcagtaataaacaacatacaaactaaaaaataccctgaaccagatggactcacagccaaattttaccagatgtataaagaagatctggtaccaattttactgacattataccataaaataaaggaggagggactcctgcctaactcattctatgaggccagcatcattctgataccaaaacctggcagagacacgagggaaaaagaaaacttcaggctaatatccttgatgaacatagatataaaaatcttcaacaaaatatcagcaaaccaaatccagcagcacatgaaacagctaatccaccacaataaagcaggctttagtcctgggatgtaagattggctcatcatatgaatatcaataaatgcgattcatcacataaacagagctaaaggcaaaaattacatgatcatctcaatagacacagaaaaggcttctaataaaattcaacatcacatccctttgttttaaaaactctcaacaaactaaccattgaaagaccatacctcaaaataataagaatcatcttgacaaacccatggccagcatcatactggagggacaaaagctggaagcattccgcctgacaactggaagaagacaaagatgcccactctcaccactcctattcaacattgtactggaattcctacccagaacaatcaggcatgagaaataaataaaaggtatccaaataggaagagagggagtcaaattatctccctttgcagatgatatgattctatacctagaaaacctcatagtctccatccaaaagctcatagaactgacaaacaacttcagtaaagtttcaggatgcaaaataaatgtacaacaattagtagctcaacaatagctggcagccaaatcaagaatttgatcccattcacaatagccacaaaaggaatcaagtacctaggaagacagctaaccagggaggggaaagtactctatgagaattgcagaaactgctgaaagaaatcagagatgacacaaacaaaaagaaaaacattcaatgcccatggacaggaagaatcaatactgctaaaatgatcatacttcccaaagtaatttacagattcaataccattcttatcaatcaatgtcatttttcacagcattagaaaaaaaattctaaaattcatatgaacctaaaaaagagctggaatagccaaagcaatcctaaacaagatgaacacagccagaggcatcacactatcaaacttcaaactatattacagggtgacagtaatagatacagtagtaggctacagtaaaatacagcatggtagtggtacaaaaatagacacatagaccaatattagataacccggaaataaagccatacacctacaaccatgtgatctttgacaaagctgcccattaacaatcaatgggaaaaggactccctattcagtaaatggtgctgggatcactcgctagccatatgccgaagactgaaactgggccacttccttctaccatatacaaaaatcaactcaaaattaaagacttaaatttaagacctcaaattataaatatcctagaaaaaaaatctaggaaataccactctggacatgaccttggcaaaggtttcatcacaaagtctgcaaaagtaattgcaacaaaaacaaaaatggattaagcgagacctaattaaactaaagatcttctgcatagcaaaagaagccatcaacagcataaacacaacctacagaatgggagaaaattgcaaactatgcatccaacaaaggtctaatgtccagaatctgtaagaaacttaaacaaatcaacaagaaaaaccaaacaaccccattaaaaaataggcaaaggacacaaatggacacgtttccaaagaagacattcacatggccaacaagcatatgaaaaatgttcaacatcactaacattagagaaatgtaaataaaaaccacaatgagataccatttcacaccagtcagaattactattatcaaaaagtcaaaaaataacagatgctggtggggttgtggaaaaaagggaatgcttatacactcctggtggaaatgtaaagtagttcacccattgtgggaagcagcccagagatttctcaaagaacttaaaccagagctatcattgaacccagcaatccctttagtgaatgtacacccaaaggaatataaattatcctaccaaaaagatacacatagtaatatgttcactgtagcattattcacaatagcaaagacatggaatcaacctagatgcccatcaacagtggaccggataaagaaaacatggcacatgtacgtcgtggaatactatgcagccataaaaaaataacaaaatcatgtcctttgcagcaacatggatgaagctgcaggccattatcctaagcaggttaatagaggaacagaaaaccaaatatcacacgttctcatttatcagtgagagctaaacattgagtacatatggatacaaagaatggaacagtaggcactgggacctatttgaaggtggagggtaggaggagggcgagagtcaaaaaaactacctatcaagtactatgccactatctgggtaacaaaatcatgtgtacaccaaaccccagtgatgtgcaatgtactaaagtaacaaaactgcacatgtaccccctggacctaaaagaaagtggaaaagaaaaataaataaataaataaataaataaataaatacacgtgcatgggagcccaccattgattaatcttcacttgctagggttgactatggaattatacaaattatgagaactctttcctgatattgtgcatatacatcaatgaatctgatcttttattaagagttttctgtactctattagaaaaaataactttggcatacctaattaagcatttatgacgtggctcctagagagcaagaagtatcataatcattccttctttatttactattttaaaaagaaaggaaagaaaatgacctgttgatacagattggtagaaaacaacaatgaagatatttttaatagacaagctcatttcccattgaaatgtctttcactgtagtgggaaagagctaccacatatagcctgggttttaatgatatgacattgtcaatgggaagttacaagaaaaaaaaaggtgtatttgatttattactgaattctggaaggattatggagcacttgtcagaatttatttcaaatgaatattcgttaagaattaattatctctacgtcgttgagcaatgaaatgaacgtagaagtccatcagaggaattacctttgcatctcctaagtagcaggcagcactgactttgatctctgtttcctactggtcagtaattcacatggtatgagctgattaatctagtcgatggttttctattaggttggtgcaaaagtattgtttttttttcctattgaacgtagtaactaaaactgcaattacttttttttttggagacagagtcttgctgtgttgctcaggctggagtgcagtggcaccttcacggctcactgcaacctctgcttcctgggttcaagcgattctcctgcctcagcctcctaagtagctgggattacaggcacccaccaacacccctggctaatttttgtatttttagtagagatggggtttcaccatgttgtccaggctggtcttgaactcctaacctcaagcagtccacctgcctctgcctcccacagtgctgggattacaggcatgagccactgcacctggccaaaaactgcaattacttttgcaccaacctaatagttttatatccacctgctcttattttaacagccctaatttaaatgcatgaaaatacaaatgtaaagtgtttatttggagttctacagagcacctctaattcaacctcttttctcgttgttgatgttctgtgattcctgatttttaaattttagcttagtaaaaaaaaaggggggcctgtgacctatctaaataggcattttcagattttccatgcattttaaggtttgttcagcatgactgaaacctgcatcaataatatatcaacaatatttaaaatacagagaagaattcggaactctgtcagagatatttccaaggccagagaggatggtataggttttcccttaacagataaaattaatcaaggacatttttacaggtgaactttaagtttttcacatttaatcaaatttagcaatgtctagagactataaatctaaactaattcaagtgcttaaaaattagaaaggtaaatgattttcttaagtaggtcatcattagcttaaagtgtttaattttattaaagctttcatttcttgttttgaaaattccaggactatgtctaccatctatatttttcaacttgatttccacaacctgggagatcacaattgctgatgcactatatgaatttgattgatcattccttacatttcaaggtgtcctctaatcctattaaaattatacatggagactgttaccctatgacagtaaaaaataaagagattaaaaaaaagaatgattacttccacctgaaactctaggttagtctgacattagatttcatcaaaatgaagtgtgggtgctcaagaatattagcaaccttttggtttttttctattctgtgaattgttatttccaggtgagttggaattaatgtttctgagaatttcctactcttagttgtgcatccaaagcattttttctctaattattgtcagattatgatactgtcatcactgtttctcaaggcagtttacatatttatcaggcactgaactaagtatttgaaggcaatccttgccgtccagaaatgtgcagtctaaaatttgcttcagtgatgcaaaaaacaaatacatcaagagtatatgtgtatgccaaaacagttatgtagaggaatgcttaattagaatatgaaacagtaacaccatatatgtatctgtctaaataagtgcccatggatttgctgaagtttcacatcacataattgggatatcaaaacatttttaatattgaatgataaaagtggatcttgaaagtagtgaaattactgctttccatccaacttacatgtgaataagtctattggcaatatgggtaaaatgtatattctgattcagtaagtgtggaatggggtctgagattctttggatcagttcacttcctaggaatgttgatgccattgcgctgtgaccacagcttaagtagaaagatgttaggtaataagctccgtcatatgcattacactttaaagtttacaacatctttctcacataatgtatcatccatttttacaacaattatgtaaagcatgaaaagtaagttgtttattttacagatgagaaaactaaagtgaatgtgacaatttcaagcttttcaggtgtatgaacctctaattagtaaacatagtgcaagagctttgtttttcggattccatgagtagatcgctttcatttacataatgttccaaagctgtataggaatagcatgtagttcagctagtttattttccatgaccattcaaattacttacaatagccatttataaattgctcatagaaatatacatttacctcattttaaactacataacatggatcttcttagtctccaggatctgtaattaattttcaaaatgttgtattgtatcacttaatagtgatagttgacctctaacctggtagcagtactctaaaaaacaattttagagtttctgaaaaataaaaatctgcaatgatcaacacacacttgattagccaatagtaggttatgaggttttagagaaacacaggggccagaatacctgcatctaaattttagctcttccactttccctatgagagaagtcagttaaaggaacaaatgtgaaggattcccacctatcactggaggaagataatcatttttctttgcttttctcaaatgcttgttttgtaccattatataaataaacattttaccagtatggcttggtaaaatggaaagacattcttgggttcgcatcttaattctttcatctattccttctgtgtgcatagccctccaagaactcaggtttttttttttaaaattttattcacttagatccataaaatttatagtgcatcagccatgtcccagaagttagacaacttaggtttagtatagaatgtccttactctcaatgagctccaatcatgaggtgaggaatctcacaatataataagctctaccatagcctgaaattatctgatcaactgtaacatgaggattatgctacatatgtaactcggaaaattattgtgaggattgaataagttaattttaaaaaaacgtaattgaactctgtgactgcaaatgtattggctctcgtagtgtctagtttccctctgtttttcctcagacgcagtattaaaagttgtacggaataatttcttaaatcctgtaactaaagcaagaatgtaaatcagtggagcaagtgatattcttttatattcatcttaatggttctatgccctaaggaaacatgacttgtggattccttgagaatatgacattcaattctgagtattgtttctttcctaaaatagtgatgatgattctgtatttatctctaacactgtaaaaatgcatcatttctcattctgagggaaaaatcacccgagggcatggtgattgtgataaattttccattatttttaatatcttgtctgtgtatactgtccaaaggtgacgcgccttgacaagttgacatggaagctttgctacatagataaaacactgttgtggtaagagcaaagttagttacatttagcctatttacatttttatatatcgctaatatctgtaatgcaattgtcatgattaaatgtgatatgcttgctcaacagaataagaggtcaggacacagggaagctggatttttaccactgtgatgggtaatgcatgcctcatgtcatctataatcacttattttttaattgacaaataattttttatatgtatggagtacaatgtaatgttttgatgtgtatgcatttgtggaataattaaattaagctgatttgtatattaactacccatatacttttttttttggcgagaacatttaaaatccactgttctaacaattttgaattaaacaacacattgttaactatcgtcaccatggtgggcaatagatcactaaaacttattcctcctgtctgatcaaaactttgttggctttgaccaacatctcctctttcctcatccccccatgacttatctttatttcttctaaacaaacaaacttttaaagtaataggtcctcttgtagaaaatacagaaaagtagaaagaggaaacaaaacatttttttgttttgaaaaacattccccttgcttcaactatttgcagttctctttcaatgcttgtcaattctattttttgctgaagttgcttctgttttgagcacaaatggaaaatcatgactatgtatcatagagttcaataagaagtaattgacctgcgtttgtcaatgatggttcgttgggagtgagtttcccttcctagactatgttttgactttcagtcaatttttccttcaatttcatatacttactagttacctcttgctcacttactatggtgtgatagaaattttttttcttttttcttttttttttttttttttactttaagttctgagcactaaatggaatttaagctttaccaggtagaagtaaatgttttttccctggttaaacattgctttccatattccattagtcagataaagggaaatatgaggaagcatttagggtacatttcggatattgactgcttaatggtctacttctggaaaaagattgaactggcatcctcataaaagcaaaggaaaggatatctcataaaccaaggtgagaggcacagggtacggagttaaggcttaaatgtctgtgcataagtacaagaactgtgcttcctgggttttatttttctttctgagattgctgctaaagtagtgattttgctgatagcagtatgaggaaacagagtagtaagactttataagatatgatcattcctttattgtatatgtatgtgtttaagtctgtttgagccgctgtaacaaaatagcataaacttggtggcttgtaaacaacagaaatttatttgtcacagttctggaagctgggagctcaagattaaggtgccagcagattcaatgtctgatgggggcccacttcctggttcttggacggcccttttgtgctgcatcctcccacggaaggagggcaaacaagctcctttgagaaacctctttttatcattatattcattttttttaattgacacacaatattgaatatatttaccaagtgcaacatgatgttttgaagtatatatatatgtatagtggagtgagtaaatctagctaagtgacatatatgattcctcacatagctatcatttttgtggtgataacatttaacattcagtctcttggcatttttctagtatacgatatgttgtagttaagtatattcaccatgttgtacattagatctctccaacctcttttctaaggacactaatcccactcaggagtgttctgccctcatgacctaatcaccttgcaaaggttccacttcctgttaccatcaccttaggggttaggatttaagcataagaatttgagggggacacaaaacttcagaccatagcagtatgtgtgtatgtatatatgtgggttttgtgtgtgcattatacatagatgtgtgcttacttattaatggctgcagtaatggcattttatgttgtctttgcaacacacacaattctgccttattcttattttaaggatctcagcatgttcatgtttcaaatggagattgctacatacaaaatttaaaggatactgtgttttgaaaaaaatagtttgcttttttactgggcattcaggcatagagtaccgatactatgtgacatattatggtaatcatgcatgaaacaaagatattcaaaaaatgccctaagccatggggaaaaaagcataccaggacttcaaaagagcaatggttcacttagtcttgggtataggacgcatgaagagaggctatagaagaatgggtctcatataccaagtcaggaaatttagggttttgtttttttgcaggtggtgaggagctattggagacttcagtgtgttttaacatattcagaaggttgtgcattcatcaccagtatctaatttcagaaggttttcatcacccccaaaataaatcccatacccactaccagtcacttcctattccatccttcccccagcccctggcagccatcagtttactatctgtctgtatggatttgtctattttgcacatttcacgtaagtagaatcatacaatatgtagccttttatggctggcttcttttacttagcatgttttcaaggttcatccatgttataacatgtgtccacgtgtcctttttatgaccgaaaatattccattgtaggaagagatcacattttattcattaattagttgatggacatttcagttgtttttactttttcactgttatgaattatgctgctatgaatattaacatttgtttatacattttgtgtagatacatgtttttaattatcttatatatatataaagtaggagtagaagtgttggtaatgtggtaacctgtttaactttaggaattaccaaactgttttccaatgtggctgcacatttatatattcccatcaacaacatatgatgatttcagtgtttttacatcctcattggaggcttataaggagttttaagattataattatgcattaagaatgtatgtgtggtagcaagagtaggattgattagcatgagggagagaatggagatggaaaaatcaaagacgagatgattataaaagtcaggcaagggatggtggggcagagaatgacgatggaatagaggagaaatatgcaaaatattgagtgcagagcgatgatggctagtgagcaggaggatgagcatactgaggttttgagattgaagggtcattaagagaagcaacaataatttcaaggtttaagttaaattcagcttgggatacagacttgctggcagaatatccagggggagatgttaagtggctaatgatactttttttaatgtgaaatttcagccttgaagttgtggcaagtcttcattttctctgacttgtgtttgtgtaaatgtggcctgtagtaaggatgggcaaggcaggtgctggtaagaaatgctaagtcctggggcctctctcacatgtattacgtcagaattccgggtatggtatcaggaatttctattttaacaagtagttcagctgattcatttacatactggacttttaaaactactgctgtaacctactagcgtaagaagaggtcactgcaagaatctcagtggcaatggcaactcgaactactctgaggattatgtacagttgagaacattcagtttcgagttttattgacatcatgccagacacttcacactttttctttccttttattctaactaattttctgaggtaggactatgataatcctcattataaaaatgaaaacattgagccttggagagtttttcttttaagagtgactcaatggcagacctaagaagaaatttaagaataagttgaggaagaaaagcccaaattaaaaaaaaagtagctatgaactgatatttacttgttaaccatttcttttcctagtcccagaacagatttttctataataaaatggcagatctaagagatgcagaattgagatttgaacactaaaatgtcttttcactttatcaagccatattggtataatttttatttactatataaaacaaggattggctagagaaaaggaaaaagaaatgttatcttcttccagttttgtgtaggaaatccttcacgtttgttttcgaaggactggagtagaaagtatttaaataaatggaattgtatgtcattatcatcatcatcatcaccactatcatcataatacagaaagcgttctccagcaccgttttgctgagctgtgagtgctctgcaccttgcaaatatagaaatgctgtatcagtttgtctagtagtaataatggattttgtaattggatttcagaaaacactgcaacaactctccaggtatcttacaaaatccctaccctgaggcaatctctcagtggtagtattagatttgggcagtagccaaggtgaccttgattttgctgctaacaaagctgctgaggcttgcagaattatcacaactcactctatacactttgtctttcttctttttatgggctatggggaagtgccttcttggtgtaatttattacattaggcaggagagtttgcggaaacaagtatttttgtcaatttagtcatagtgaatgatataataatatcattatattgtttagtagtgaatattttaaagaatatgttaccatttatattttttcaattagattatacatttatagctccccaagggcactgactatcctagtacagttttatatttctcaatacattctgcatatacctgtaatagacagttacggcaaacataatttatcatccgagcctggataattttcaagtgaaatgagataccgtgaataattttgccagaaccataggcataaactggaaatataccagacaaactggatgtatggtcaccatcattaatgaatgctaaaaaggcataacattatttccatattatctgaggagccacggagtaagatctcatgatctggattatagctgataatagaaataattgccctttattcattattatatctttagcttttattttatttcaggaacaactcagtggcagacataaaaagaaattgaagaataatgtgaggaagaaaaactcaaatgtgacagtagctatgcactgatatttacttgttaaccatttctttttgccattcccaaaatagacttttctaaaatggtattctgcttcagttagagggctttgtgttgtttttaagtgtagtcactgtaagtttcctaggtaacctgtaatattcagtgttcaggcgcctctagtaagtaaaatgtgttgaaggtacatagctaaaagaaaagagttttaatttaggcatttgcaagatccctttcatgtgattttatttgctttgaaaatattaataattttaaattcactttactaagttatatctaaccttgggtaaagtatgggcagaggtgcagtgcggaatacgtgcaactgaagaggaaggacatgaaacgtgggggagtttctcaactgcatcctgatggagacactgagtcttaattcaacactcatttctcagaattctaatgaacagttgtttttgcagaataagtaatgaaagtgtgctgagtttcatcctgcatttacaaagagccaggatgagcactcggtttggtgaaactcatggccatattttttgatggaatagatttaccattccccagcctgttgtatcgggttaacttgatagatatcagtcagtatattcttaagattaatttggaatttttccctttttcacacacaataaaagtatcatgtattgatacagcctgtttcccagacactcttattatctttgagtgtggaggagagacatattttcacaattcaattggtatctgccaactgagcttcctaaagaacaccacactagagcaaggtgaaatctgatgtgcaagaaaaatactaattattattctttccttttgagtttccagatgctaacattttaacaatgaaaaaattaatctggaatccaataatcatgttcgggagtttacagaatttttcagaatagaagtaaaggtgtctgatatggaaactgattttcctctggacattctaaggacatgttacagccgaagaaccttatttgagtctcttcaatagagtctcttcaatagagtcggctgttaagaatgctgtatttcagcgttctttgttgaacctaagagaataagaaacctggctttcatccatctcttttcacctactcagcactaagtactcattcccatgttcatggccttatcaggatgaccccaccaagttttacagtctcgtctcccacttcttgccccatttacttgtattctctctagatttgatttatggatagtatctgaatacatgtcacacctgtcatgttctctgttcctgtggcttcctcttcataccacacctttcctggtaaaaatgtaatttgaattataaggcaaatctctatcaaatgtttctctatttcttttgctaatctattttttgtttgtttttgtttatattttgcttcttcgaatcctcacaccatataaccttggtggtatttatatcatgatcattttatacttgttatattctacctttacactgccagtcataactagagacaggattgtatcttaaatattttcgtgatattttcttctatattttatacttcagtaaatctttgttgacctgaattacattttacttttagatgtccaagacttgaactatatttctttctttatattacccatgcatattgttctcttgatttgccccagctttaagccttcctaagtcacttcgtccaaaatgtagatatttaaaggactatttatgatgttctaaaggtccaagcagttggttattcatgatggctatctcttcctccctccagcaccactggtgtttattaacgtaccttagtataaagatactgatcacatccctgcgctgtcatggtgcttacaggtataatagtgtctctcatttgagtaaggccttattaaattctaattagtactacgtatgcatagcattttaacctagttaccatttttccattggctgatctgtcagattaatggcttgcatataagagcctaagagaatgtgcagaatttgtggctttaaggtgagaaggctccggaacatgaagaacacttaaaataaaaagaaataccaatcatgtatgaatgtgtgtgtgggttagccttgtgaggctttgtcaaacagaaaaggtcacccaactctagcaaagaggaaattggagaattgtgtgttttgagtaaaatccaagcagcaccaaaggtaggcaagctgccatgtttggctgagacccagtcttatcttgttaccagtactcttccctttaaaccatcctctcatggagtcacacaaatacattaactcacctctttgtcattcagatggttggtgcaagatgcttttaagatacaatatttggaggatttatttgtgtctcatttcatctaataaagagagtaataatagaggaattgccttgaagatggaaaggagaggattcacagattatcatcttcagtagactattggaatatttaacatcatgtttccatttgttcaaaaatccttcaaagaaacttttaaaaaacatatttatacccccaaatttctaaggcttcttttcaatgaaccaatatttaccagtcatatagagcttagcacagttcttatcttatagaagtcagttattatttttttggttaaccaactagatggatgatagttcgtaactgacaactaatatgttgtctgtgtgtgcatgttatctcagtatgtcgagtgatgtatgagaggcggaataaaaacctaaggtagtacagagtggatcaaaactacttaagatttgatggatcaaggaaggcttcagaaggaaatggtgtttgggacaattatagtgtgaggagaatttggaggagatggtaacagaagacaaagtttggtcaatccaagtggaatgaaagcataagttgaaacataaagttaaaagtcaatatggagtaggaaagtttaggcaatagtaaattatttagagtttaaagttaatagggaagtagaatggtgaaggagaagtgtagaaatgcaaggaggagccaggtcatggagggtctttgatgctaggtggagtagactgaatatattcaatggcaagtcactgaagaattctaaactgaatgagtttatgacttggcttgcattcaggaagacaaaactgtcaacagtatatatgaggaactggagtgagtaggtactagaggcagggaagccagaaacagattcaattgtcaagataagaagtaatgagggcctggactggaacaatggcagtaggactataaggaaaaaaaaatgattgtaatattaagagggttgaattagcactggaaaagaaaacaatgcctgaagcttggttggtgtctttttgtcataatcagaaagaggaatttcaaaagaaaaattaggtctgggaaaatgagaatgaactcagttagaggatcttcaaatacaaacacagctataggtaagtcagttaactgagtgaaaacaataactataagcaataactaatagagatgtgcagggtctacatagtgcagtggttctcaaatgtgagtgtgagtcagaatcacatgcacatttatggaacacttgttcaaacacagattcctgagtctcaccccagaatttctgatcgtgtaggtcttgatatggcctgataatttgcatttctcacatattcccaggtgatgttggtgctgttagtcaaccactttgggaatttatgctactgtagcccagctcactgtagcatgaggcacatgagaatcatctgaggagcttaaaggaagcataccaatacctgggttcaaaccacatctattatattaaaatatttctgggggtttttcgtgtttaagtatctcaggtgatcccactaggcagccaggccaaaaaccactagtcagttcttctgatatttaaaaattaaaatgacctggcgcagtggctcacatctgtaatcccagcactttgggaggccaaggtgggtggatcacttgaggtcaggagttcgagaccagcctggccaacatggcgaaaacccatctctactaaaaataaaaaaatcagtcgggtatggtggcaagtgcctgtagtcctagctacttgggaggctgatgggggagaattgcttgaatctaggagttggaggttgcagtgagccaagattgcaccactgcactccagcctgggtgacagagcaagactccatctcaatttaaaaataattaaaaaaaataaaaatagatatttataagtaaatgtttctaatttttataacattgcatttaccaaataaacaaagatgtggacttccaagtttgccaacccagctacacaactagggcaacatctagctaggggtcacaataggcagccgaaaggcagggtcaggacctggaagatacatttgtgttgtggtcatagagctaggtatgtatttgtaactttttaaatgtggagcaaatctagcaatcaaatggaaattatgaagtttgatattgtccaaataaaatggttattttaaaatgctcttcctcttttccgccttggctcatttttagtcaaagtactttgttgtgtatgcaattgtgaatcatattggattagtccattcttgcactgctgtaaagaagtacctgagactgggtaatttataaagaaaaagagctttaattgcctcacagttttgcaggctgtataggcttctccttctggggaggcctcaggaaactcacaattatggttgacataggaaggggaagcaggtgatagccagagcaggaggaagagagagacggggaggtgccacacaattttaaacaaccagatcacatgagaactcactcactatcatgagaacagcaccaaagggatagtatttaaccattcatgagaaacgcacccgcatgatccatcacctcccaacaaacccttcctccaacattggggataacaattagacatgagatttaggtggggacacagatctaagccatatcacatataatccagatcaactggccccaaaagatgccagtatctccttacttatttcccacatgccacaaatgccctgccacaagatgaactcaaatttaaagttctccatttatctttataaatttcactttttagatccattaatagaacgtgatttcctgacgtagaaaagtgacaagaagggccaggcgtggtggctgacgcttgtaatcccagcattttgggaggccgacgtgggccacctgaggttgggagttcgaggccagcctgaccaacatggagaaaccacatctctactaaaaatacaaaacttagctgggcatggtggcacacgtctgtaatcccagctactcgggaggatgaggcaggagaattgcttgaacccaggaggcagaggttgcggtgagccgagatcatgccattgcactccagtcttggcaacaagagcgaaattccatctaaaaaaaaaagaaaagaaaagaaaagaaaaaaagaaaagtgacaagaattaattagtatgtcatatatcatgaattactgatggcagtgatgagcccttgatccttttaaattaggattttaaaagaactaaatgcatgtgtaccgttacaaaactatttaaagcaaagcaattcagagaaacatcttcaaatttgattttatatatttttcctaataaaatactaaagcttaattctaagttattcataaaaccattattgacatgatggcaaagagacttggcagccattgagacctgcctgcaggtgttttacagctccatgtgtttttattttgttgtctacgttcctctttgctctctaataaagagcatttacccacagtaatagagtcaaactcttgtgcccacttcttcccctggattagacctctttgcttcagcttgaatttggttaccggctggtacaaagtgaaaagagtggagattcaaactgaacctgagaagaatatggaaaaagtacttattcagtttaaaaatagtaacaacaacaaaaacaacagcagacgctcatatagcgcttaaggtgttgggcagttttatgtgcactgcatggattaactcgttttatcctcaaaacaagcttatgaaagaggtaccttcattatccctcttttagggatgaggaaactaaggccttgtgtggttaattgacttgcacagtgccagaaagctagttatcggctgggtggggatgtgaagccaggtttatctggctgaaagcaaatgttcttaaccactgtgctcttgcatactgtatgtatagcaagtgccactcagtaaacatgctttccttgctgcacagattataaataaaacaaacacattagaaacatcaagtttcctgattcgattaattcatcttctcacatccttaatattcaattattaagatgcttaccagtacaaagaaaaaattgttgtgaaataaagtgataagagttggaaaccagagtttaagcccgtgtttgctccacactctctgtagattaaacagatattgcatttctctgggcctcagttttctcacctgaaaatggtagttttaaagattattttcagctccacaattttgtgaattaaacttgatttctgagataaaatgaaaaaggaatgagagaactatttagagattgttttctaccctgctattgcctaccaaatcctaccaaatgtcaataattttctttttataaatcttttatagaagtttctgattatgtagcattttaaaggtattgtttattacacgttataaaaaattttatataaagggaaaccaagttttttagcacatacaaattttatgatatgtatttcatttgatggaacgatgtgcaaattcatttactttccatgcaagagtgatcttgttttgatttcagactaagagctggaaaaataatttccattttgttgttaaagacaatggatagtaaaacaagatctgggtggcagggaataacctccattaccagggggtagataacaaatggctggatgtgtgacaatgtccaattcataaaattctggttaacaataatttaataatacttctttgtgcgaggagaaaaaataaaagaaatagtcacttggagaaatgtaaatgggaggagatggtgtttttctgtcattgaatataacaatacactacattgtctttgtaacaatggtctggaaattggtttcagaggaaagtaaattttcctaaatttactgtgttatctgagctccttgtgaactatattcctagggtctagcaaggtgccttgtacataatagaaactcacgtgcttgtacaatgaattaatcatgactatattcaacattttaatacagataagatagtgggatgcatagagaggagggcagcaaagtgaagaaggaggagtcttaaaattaattcctgtgaggaaagaataataaaaagctggacgttagatgagacttttagggaaactagaaagttgtttttatgtcattgaagaattatatcaaagaaatggctttgttttatatgtctaccaccagtaaaagattggcagaatttcttctacaggggaaaaaggttttggaggaaataagagagagcagtctaatctgtacagagatggctctgagctatttggagagacaatgagaacttcctaacagaagacctgctaggagataataggtacagagtcggcaggagtgttgtggagaagctgtcagccttaaagtagtattgaatttatggctttttggcctttaagacccatataaccattagccaagcacttacatttgggcccaatgctacagataatgtgtagtaagtaaaaatcttaactgaagaagcaccattgctccaatgaataattgccatgtgaggtccatcaattatagtgctaaggtttagcaaccagcagtagtggtgtgagggtaagaaagacttctttaaattgctgggtgatgagtaccaagtatttctcctctctcccttcttcattggctcagaaaaacagactctgagacagagattagtgcagagtctaatgggcaggtgggggttatttgagaatgaaaatgatatcaacaccttcgagggaaagccaggaaagggaagacaaggaaacaggattcagcagagggaattgtgagtaaggatgaagctttgatgggagaacacagccattcactcctgtagagagttcgggaagagccgatgacaacgtaagcatcctctgatttaggctgaagaggattggcccctatacctccatgtcgattagtcattgtaaggcagctctcttaagcagatctggggggagctgaaagcatgaagaatttcttccagcagttctcccagcagctgtggaataaattcattcctaaggaggcaactgggttacatgtgagagtacctaaaacaattgttttcatgtaactacatttaagttgacaaatattattctttacataatgcaagttcctaaaatcattcttctccaaacattcttatgtgatcaaagatgtgtgtgctatttagcttcatcctaatgttgatatttaagacagctgttggccttggactaacaatgcttatgagttggcatttttaacaacttttaacatgtcaattaccaatttgccttctccatgcttatttctgctcgtgggtaagttgcttcatcataacaactgaaactatgtggaacacaggaaaatgtgactgatctggaagccagtttgtagttagagctccttttttctactgtaacacacatatagacctatttggagcatctgatgatggtgacctatgtgtcacttgtctcttctcattccacatcttctgttagcaaaaatatttgacagtaccattacctcccccaggagaacatttgcaaataaaaaagtaaaacacaccaagattcatggaagaaatgttactgtgcttactcagagattcactgttattatttctagctttggttctgggttctctcatttattaaacatgaaatattgagaaaatatcttgccttttctggctctgaatttcctaagcagtaaaatgagtataacactgatctcacgtggttattgtgaagaataaacaaaaatgaattagtaaatgtaaaacgtgacacacaatcatatagtttcttggtaaatgttacagttcccgtctctgtcgaaggaaaagcatcttctagattgagaaatgacctaattcagtttggcattctagtaacgagcgttataatatttgtaaattacatggacacacagggagaaaagtaacagttttttaaaaaaaagcccctcccttttcttgacttgggtctttcatgccctggtactccaggaagttccccaaccctggaatcagagctcactcacagtcaaatgcccacagcttccacaacggtcagtgaaactgaaagctgcattggaataaatgggccacgaagatccaatctattgagagtcaccacagctacatgaaataaggaacaatttggctgaatcacaggcctgtgagtagtgtgagctgtgttcaatctatctgttgagccacggagagagacagttcttatggttcttcaactctctggaggataaactcctatagtgatagaaactgtaacttcctgaaatgaggcagttaaaatgaagtaaaatgagagctagactggatctaagacttagtcttgccccttctaagctgggcgatctcagataagtcacttgacttatttgaaaactgtatcatcatcactatagtggaaaaataatacttactctggaaatggctgtgcgaatgaaatgagatgcatatttataaatgagaaaataaaatgatatgagcatttatcaatttaaagagcttaattcatgtctggaaatagtgttattggatttagagtttcaaacaagtagaaggtgttccctcttaaaagggtaattcctattctgattcatccagagctccctactgactacaaaagcagcttccaaaaaaaagggaaaaaaaaaagaattggagacgctttcagataaccaagacttagaaataggcagatgctctccttcgccttcagctgctctggcgctcgcttgctgggacaattgtgcttacaagggggaaggaagagtgacagcacacagcgttttcttgcccagaagcgtaagcacgttctgtgaggaaccttcttgtgcagaactgtagacattgataaagattggcacatcataacctgacaagttttgctgcaggaagaacatgggacaaagaccattggtaccattgcacttctgggactggcacgagacagatagctctgacaagagcagctgccactccagacagggtgtttgatttttgtgtgtttctctttattgtattacacatcactgatgctaacgagattgtctccaccaaagctcaaggaccagcttttgaaattatcaacagaaattaccaagttatctttttatttctttttttaaccccccccccatttttgtgaattttaatgttgagaagaaaatatgagagattctcagtctccaggatgccacaaaatgaggcacattatttatgactgttaaatgacaaatcctgaaactgctttgagtccaggcaggataaaaggtttatattaaatgtgacctttgagtttaatggtatctagcagaaaccttcattttgactgtgcaaattgtgctataagttattagcccagtttactgcattttcacacagtggagtatagggggcagacagacagcagcaaatatatatgtatttcttttcacctaccatcttctaaataacaagttatttaaacttaaccattcttctccccacaccgttttacataacacatttaatacatttttttttcctgaaactaactgcctgaactaaatcagagttgacgttttatgggaaatctcttccctacactgtcctcagttttcatagctgcaaaatgacagtgttcgtattcattatcaatatatttgtttctagctttaaatcttcactatataaccttcctgtttttattgtctatgaaagaataactgttaatcatggcaacaactcagcggtttgcagccagataagtgattggaagagcaatcaacttctcagagatttcagtatttaaaggtaggccctgctgtgcacgtctgtataagtgacagtgttgcaacacagagaggatgcatttgaaaaagaagttaggcaaaacagaagttaaattgcaaatacatgttgttcaagttgcacaatgggctatttgggagaacgctataggctgtttaacattcctgtgtttaatgtgggagagacttcactttgtagcaagagtctaaactttcgtgttttcctatttcttctaaaatatgcaattatgtaggatttattatgttatttgaaagggaaagctattttgtattatgtcttttttaaagcatttaaaaatgaccatgcagcagatctaataccttctttaaaatgtattgttaaaataacaatattttacaatatttttatgtttacaaaaaataaaggccagtcacggtggctcacacctgtaatcccagcactttgggaggttgaggcaggtgggtcacctgaggtcaggggttcatgaccagcctggccaacatgatgaaaccccgtctctactaaaaatacaaaaatttagctaggcgtggtggggggcacctgtaatcccagctacacggtaggctgaggcaggagaactgcttgaacctgggaggcggagcttgcagtgagccgagattgcgccgctgcactccagcctcggccacaagagcgagggtccgtctcaaaaaaataaacaaataaatcacaatattgtggtatcacacactaaaccgccattgattttttcatgtccaggattgatcttctcttctactatgctccatccaaagtgttctcctttgtcgttaatggcaactctacccttttagttgcttaaaaaccaccacaactctcaaaagcatcctggattcttctcttcttttatatcccacatataatatttgaacattgtcatggctctgttttttcaattatatgcataatctgaccatttctcaccttgtccagagtgcccctcaaatccaagctttcagtccttctcctctggaatactgtaatatcctccttagtggtgggaatccaccattgcacccttggagcctaatccaaacaacaggaagagtatcctttcgagatatgagacattatgtcatacctctgctttaaaccttgcaatctctcctgttttcacaatggcttacaggatctaacccatcaatacatctctgacttctctcctgttgttcttctcgttgcctccagccaccctggcctcatcactgtctttggtctcatctaccttgatgaatttatgaacttcttaaaattgccacattctttctcacaacaccttacccccatttatattctaatagcactcatttcctccaatataatatttattacatgactgtctctctcttctactctcgttagaatataagctccgcgatggtaaagacttttatctctattccttgctatatccgatatgtagaaatttaatttaattctatgacaaataccgaggtcaaacagaagtgctgcaattgtcatttatgttcaagttcataaaatcctaggttactgtgtaactttctattcttccatctcttttctgtgtactctatgttgactttcctagaattttattaaactagttatacccttcttagagctccagccaaagccccatatattaccaggtctgtccacctttgtggggacatgaactactcttggctctgtgtgagctccaagaattatctggcttttttcttgtgtattttttttctcccatagccttgggtagtttcctctcacacatatgcaggtcagtattcgtctaaattactgacttcttttaatctgatacactgacacccaacttctagccaccttgcctcccctggctccctgaaatccagtttctgtttcctcagctcagtgaatctccttggctgtttgtgttctttctttctgtgccgctgtctagacatttccttctggggcaatgctcactatgtttttttctctcaaggatcacagttgtacactgcatgtttcccaacatctgaaaatcattgtttcatatatggtataatttttggttgtttaaagtgggaagttaaatctagtcactgttactgcaccatggcaaaaacagaagcccagtgaaaaactatgaaagctattttttttatctttaatcaaaggagcacgtaagtgagtcaggtagtgaatggtatacaacatgtgactaatgttcacgtgtagaacctgcaagttatcaataggaaagcaatacattttaagtcaagaacgtttggtttctggctgtaccaactgctgttgtttgacctgaggcagatagctcaaccttaatttcatcatctgtttgtatgggaaatggaagtccttctgctttattacagagttacttcaaagattaaatgtggtcacagatataaaaattcctatctctaaaatcctgtatcctatctctaaaatcctgtactgatgtgaggggatattcttatttgcatcatcattatttgtgaagctagaaaattcagaatgacaaaacacttcaccttaattcatcttgtgcatgtttatcctgataatttatgtagacaagaatacattctcttttgatataacctgtgtcagctaagattaattttcactttaaacaaactaaaagtggtttaaacaaggcagaagcttgttctattataaaaagggatctgaatgtctacagtccatagctagcacaggattcccagaggacactaggaacccagctttctatttttctgttttcccatcctcattgataattttcatcacctcttgattcaagatggctgctggaattctagccattacatccacatttcatgatgatgatgaaaatgatgatgatggtggtggtggtagtggcaatagctggaagaagtaggggagaaaatgttttcctctaagccaaatcaactcatttaaatcagcttttctgaaagtcccataatatatattcatttatatcatattagccttaatttagtcagatgactacatatagctacaaggaagaatggtaaatattgtctaactttttaagtaatgtagccaagtataaaaacgtgtgttgttatcaaacacattagaaaagaatgaatactgaaagacagttgtcagtttctgccacatgcttttatcaacaaggaattctctgaactagttcaactgaaggtactacaaggaacactaatactacactttatgccgagtgagacacttatagacagtagctaagttagatacctctcacgtggcaactgagaagcatttggctcaaattgaaatttgtctattttgaaaaagtaaattcactacaaaggagttgctcccagtaaagataggtcaaagaatgctctgaaagcattcctcaaagagggttcccaacagtgttttttgttttaaaattgaaattattctacatttatttgcattctggaagtgactccgttgatattaataatgtattctcgtgaaatatctattcacaagaaaattcaatataatgagattaaaatagtttttcttttataatttggtgtatatatataaaatatccaaattacaacatgttctttaatttatgtagcaaaggacatagttcatctgatgagaaactgtggacagagagaagcacttaacataaaactatgtatgagattcaggcttaaagacaatagaggttcttattcagtggctaaacagctgtatttctagctatttctattaatctgactactcatattgtcacactccctacagtgttttgagttatggtggctgaaatttgtgaaatgcattctatggaatatcgtaacagacattcttcttattctagtttctataaatcacatcgaagtgcttttataaatcaaatttcctttttcattgaaaaatgataacttcaaacattttattttcatccatgaagatttttaataagaacacttgaaagtacatctttaggattttcttgactttctccgcctctatcaagtagctaatgagctgtaaagggatgcctaaatgcactaagaaacttgctatttagaggaactctgggatcctaaaatgaatccttttatgaagcagagaatgtttctgcagtggaaataattaccctgtaatttatctggccctaagtaggattttcctctgcttagctttgtgagtgtggtttacactgagtgtcctgcaggcacctccacttcagcgtgtctgaaatggtggcagggagcccaggtaggaggctgttgctgtaagtcttgacaccagtttctctcaactctaattcatcagccactctgatgccaaggaaatatttcctgaaaaacaaatccactcatttcactgccctgctaaaaacctctgctggatccccgttgcagatcttcatcctctgctggataaatgccaagccctttagcaaagtatcgatgacccttcacattttggccctgactgcttttccagcaacacttcctggtattccccctacatgccatatgctctagccacacttcacttctccccactctccaaatacactgaacatttcatacttctctgcatttgcctttggctatgccgggatcgctccgtgtccaacaacttttgtacctgaagaatccctccttctgcaaaagcttcagctcaaatatcactgttccagcattccaaggaaagttagtcatctgcctctttattgtcatagcaatctgctcacatctgagagaactcattacattttattgtaattatatgtctccacaactggcctttaagtttaggaggcatgacatcataatctttttatgttgaaggttgataacatttggatgtttactaaatcccagaaactatatgctctacaaataatatatcattaaggactttcaatacaattatgaagtattattttcgtttcactgatgaatggatggatattcaaatgctaaggggctttctcaggactagactgccaataaagcctatagctttgatttgatcccattttctgatgccaaagcctagttatttttttcccaatataatatctttcctcctcaagacttagcaccacgactgatgtctaatacatgaaaaaatgtgtgaaattatgttctgcctaactctaaagtttacattcacccccagagaataagatttcccactattgaggtcagtgtgaaggaagcttcaggggcagcttccagggggccctccaggagggttgagagtcagggcagtgctttagagttggatacagacacccttttaataaaatgttaaactgttaacttcgttttgctcaccatttgtttcaatgacagcaaggcaacttttgaagaaataaaacttataggtagggtccccatcatccaccctatcttgtcgaaaatatattttttcttttttgaaaaagtgcccgaaaatatgagtgggttttgtttcaaaatgtgtgatatggtttagaaatattcatttactaatgtagattgagtgctgttaaactggactaaaaaccaaaaacacagaagtgcattaatatttcttttgtaattgagcagtctcaacttggtggatataaatatgaacctattacgctttgttttgttcttcctgtcattacttttaactgtactttgtcaaatccagctttcctgcttaacaacgtactgagtagattctattattctccaaccacttggtctaatttagcaaaaaactttaatctcatatctgatttcaggctattgatcttcccttttggagactagagctatgatctatgatcctttgttgggtagagtgaaagagaagagggttctctgagatttccccttccgttgctgcttctgggcctagagccttcagtttttcagggaaagggaaaaggatggaaaggcagagatctccttataaaggcacatgaagatagtggagtgatgtctatggcattgctctggattggcctggttctgtctgctgctaaagcttcaggtgatgtaattgtctccatattagcaatatgcatggttttcttggagtcatcttcaacttcctgtgaccttctcttggtgaggaccctctcagagaaggagctgtgtctctgattaccccatcaatggtgcacaatagtaacacctcctctgtgtagagcaccacattctttgaactggaccttcaatatgcatagccatgcggaatccagaggtcttcttctgtgtccctgcagggatgtaaagactggagtggaatagctggcattctcatcttcttccacgcttatcacaccacttcaaggcctcctctatgatcccataatcaattatagcagggagcctgatttccaaatctcttcatcagaagtgggcaccattttctatgttctcaaaggccgaaaacatgaggtggcacaagtcacatttttacaagaacttcttaagcactccctactctgcctacaccaacaggactactgtttatcaagcacccagtctaaggataagatgctagtctcttcttgctgggcacttaagttttatgcataatattcttggagcttccttcacttagcttcaggcaggagggatattctcccttcccctaactaatccacaaggagggaagggaattgattgtcctcaggaacgctgcgtctctcaaagacctaggtccaagaaaaccctctctcatctctcatccttttcttatattaacatgggggtaggatatggtatggtagttggcggtatttctttaatctcttagaaagtgctataaagggtagatgtctctaattctaggaagcttatttagaatgtggggtggataaggttgaatattttaatcttggatttagctacaattctgggaccacacaaaaatctacttaaagacctattacactaagagattttctaaattagattaatctttttttttctaatggctgtcataatttgtcctcccaaaagataacagaggatacttcttccacaacacatgcttagacagcatttatattaggaggaatgagcagtccaaacttaggagagtagaaaatcaatagtgaccaagtctaaggaagagaaatgcagagataatgaagcagagctgtgcatacttcttccaaggagtgcaaattttttctttctttctttctttcttactttctttttttttctctttttgagatggagtctcactctatcgcccaggctggagtacagtcttggtgcgatcttggctcaccacaacatctgcctcccaggttcaggaaattctcctgcctcaacctcctaagtagctgaggctacaggtgcatgctaccacgcccagctcatttttgtatttttggtagagatggggttttgccacgttggccaggctggtctcaaactcctgacctcaagtgattcacccaccttgatctcccaaagtgctgggattacaaacctgagccaccactcctggctccaagtgcaaatctgaaagtgaactcctgatattatgggacctgcataaaaggcaacaacctgacttcacaggttattaaaatgcagcatatttatctgcctggattgtggcactttacaattcttgcttcagtaaagtgtgactaaaatatttagtggcactctctaatatagtagacactaaacaaatatggctatttaaaatttagttcctcagtcataataaccacattttgactgctcagtagtcacatgtggtatgtgtctactgtattagacagtgcagaggtataccatttccatcattagagaaagttctgctgtacagctttgcatgttgagactcttatttgctctgtgataaagaaaatggaattttctttcatctttttgctcagatctgccgtgtgtggggctaaaagacatggattagatggattccttttcaagttttttttccaactcagtttttgggtgaccttcatctaatacctagacaaattgaaaagtgaaatttgccatctatcattggttggatcaaatcacacaatcataattaataaatcggacagatttgctttttttttaacgacaaattctttttggccaatgaaccactggcctttatttctaaaaagtgcagttattcagggaggcccctgacatgtctaaaattgaaatcatagtaaagaaagtaaattgctgggcatggtgatgcatgcctataattctagcactttggaagtataaagcaggaggattttttaaggccaaaagttcaagaccagcctgggcaacatagtgagaaccctgtctctacaaaaaaattttaaaaattaggtgggcgtgacagctaataatctgaactacttggaagtctgtaatctataatctataatctgaactacttggaagtctcagatgggaggatcacttgagcccaggaagtcaaggctgcagtgagccatgattgtgccgttgcactccagcctggggtgtcagagtaagaccctatcttcaaaaaaaaaaaaaaaaaagtaaagaaaaaagagtgtaagcttgtaagctgactcatttattagagacacctaagctacttcaaatgcaacatgtatccaaatccttagacatatagacatgtgatatttacagaagagtttagcatggccttccaaatcttaactttgtttatacttttcaataaggatatgtgcaaatgaatgaaaataaagttttacctcccaagtcaatttcacataattctaattccttttaactagagaatatcttgtttagaaggatcattaagctaggtcaaggtaaaaaacaggttataagacaaatgcatatgaaatctacaacttataaggaaagaaaataccaaattagttctatcagtcctctaaactacagaagaacattatttttacctagtgtgcatgtacacacacacacacacacacacacacaaatatttaatgcttttaagtacatttttaaaaaaaatctaaacaatactttgactagtcttttcctcctaatattatatatagactgaagtttttgaaaataaaagtagctgagccaatgaaatgctttagcattgtatttttaccatcaagcactgtttagcaggctgtatttcccacttttcttcattgatatcaggagcaagcactagaaatatagaaaataaatataaaataatcacaagttcttaaccttatttttttcagtctttatcagcttcacgtagagagctgctcactgtgttatagcactttttaagttgcaaagccttgtcatatacattataatttgtattcctctaagcaagtaaagtggtaattactggtatcctcaactttctggtgatagaacccgtagttcagagatgctaatgctgcaaattcacatagggagaataatagagctcccatcactgcattccaacaatatggcctttcctctactattcggatatgagacaaaattaaatattttcttgattttcccttacaattaaagaaaccgttgtcaaaaacaaaaataaaagcttccagcttagcatttgcttcagtgttgtatgaaaacagaaagtgcttatttcaattaaaaaacagtgtttttgcctacattaattagaacaggcacataataaatctgtgcctaagaccaaacacaaatggagacaaaaatcttgggcagttatctgtggctttaaatatttggattttgctatcatgtagacaaagtactcatgaccttccaaagcctgacatcaaaactctgtttagatctttcctctaatgctttcattagagctaccgggccaatctctgttcttgggaactgtgccacttcctcaatctgtctgtttcttttgctgtttccttcatcttgcattccttctgcattggaactttctgttggataccttactttttttttcagggtcccatctcaaataccactccacttaagacatttttgcatagaaataatctttggtgtatttacttttgtcatctgaatgagataaatggaaaaatttggcagcataaattgttcaaagtcaatttggtaattcacattgaagaaacatccatatgtaagagattattagaaataaagccttttaaagaatgtattgttaataactattagtagatttgttcttggtaaatagaagaacattgttccccagaggtttatgtgtatattccatatctgaaaatcaatgtgcacaaacacggggctgttattagcaaagtcattaattacagtcctgcttgctcttctattatgaagaatattcattcgtttgctttctctgactgacaggcagtaatgacttcaataagctaatgagacatctagttaaataaatatgattttaagttagtaaaagtgtaaacatgattttaatgagttcctaggctaatagagtttccacagttatgggctgatggtggtggtatacagagagggatgaatataagactgggttcctattcaagctctgcgggttacaagatgtgtggcctgattggagctatatcagttctctaaactgtagtctctgggcttactgcatggagatgtggtgaggataatgtcaaataactcacattgacattgtattttgtaaaatggcaagtgttaattaaatgcataaaaatgaattttaaagacctgtagagtaggtgtccactcacaccttcttgataaagctttgcccttgcctgcccctttctgaatatttccatttcagttgttgtgttccatttccattcccccacacatataatgaaatctgttgtccatccaatatgtgtcaaaatttgactttagaaaacaggacaatgctaaagagatcaatcaagaaagcagaggaaattacacatttagaacataaagtacagcttagcaccttgactccttccatattcatacatcatctcattccctaaggatccagtgttaaccagctaacttagtaaagagatatataccagtggccccctacagatgacccttcacaattaacagagggattatctggagacatctgaagctgtacccctttatgaaaactttctgtgcttttattagctttttcacctggctgtcaaagcaggatacttttaccatctcttaaagtactgaggtagcctactcactcattttttttttttcacacaaaagcctggttcttctggttctaatgggagcctattactaatcttctgacaaataatataaaatacagaaccactttgtgacatccataaacttaaggagcataggccttgctagagaaactaaatctatggtgctgtaaagagtcgagatagcatcttgtccccattccctctcccattttaatgaccatgagaggacaagtatgtcttgtccaggatcacatggcaaggtactgacggagtttggtctgtcttaccaagcactcactgacactgcagtctacacttgtgaggctttgataatcgctggcatgtgaagatgctccagtaattagtgtacacatatgggggaaacaatgtgggaggatatttggcttcctacgtgaaagtttctttcttaatgtattacatgttatctcttggatctagtgtttttctggtttaaactggagaaggagaaacagtacacagcaagtgtttttattcctgtttgattggcattctcattttattatgattttaatatcttcatgttcccaaacatgaataatttctattgccttttttttttaagatggactcttgctctgtcacccatgctggagtgcagtggcacaatctcggctcactgcaacttctgcctcctgggttcaagcaattctcctgactcagcctccggagtagctgggactacaggagcacgcagccacacccggctaattatttttttttttttttgtattttattagagatgggatttcaccatgttgcccaggctggtcacaaactcctgagctcagacaatccacccacctcggcctcccaaagcgctgggattacaggagtgagccactgcacccggcctttctattgctgttttgatttacctctttagcattgctctgtttcctggagccagggagcagtacgtttcatctctaagaaatcgacttgaaaatccctgagcaagtacatgtatatgattggcctttgatatatgaatcattctggtcataaacctagaaaataccctttagtccatctgaactgtgatggttttattcttgagctttcctggcgtaagagtggcgtatgatacaatcactttcatcttcactgttttcagagtgggaggaggagggaggagttagatctcataaacagctagactacctttttattttttgccttttcagattggcaaggaatatcatttattgcatcttttaatacccacttacaagatttagcttttctcagatggccaaataattatcctttattcctaaacttcatgcactggctctcaaaccaaatgcaggttaggtgaggtttctacatttattggcctgcttgtgaaagaaggccacatatacatttggcctccatttgttagctggcttcactaagctacttggtatttgcagacaatgctgtttctttgtcctaatcatctccttccctctcaagaaagtaagaaatctcaaatacggaggacatctgatctgaactgttatgatgtatgtcttacatgaaatgctatccttgagtgaaacgttagggaggttgaatagaaaaagactgaacaggagcacaactcagtacacttactacttagttttccttttcaattttgttagcattctgttttaggctcataggctcttagacatagaacagatctgagattatctcatcccttttctccccttgccccattttatgaataagtgaggccaagagagacgaagtaacatgtcagcatttgcaactttagttagcattgttactgacttcagctctttcccatttgttcacacatcttgcacatatcttccttgaaacggtgctgagaagagctaaattagcttactactaaagattattctgattagtctttgtttctcctgattaacctaaacaacacatgtgtaaaattttccagaatgaaaagattatataagtttgggatagtctgttaatgaactattgcccagtgatgaagaaactaccttaaaagccactaagagctgtgtctctggtagtgtccagagaagctgagtaaacaacatgaaatttccttttgatggtggacactagcatgttgaccttatttacctcttcactgtaataattaggacttttcaaaacattccttagttatttacatatttctaaccagttgggtcatgatattggtaattacaaatttcaggaatttggagaacatcagatttgtaagcttttttatattccccaaatcttaattttcatgaaatctttctaatatcctcagcagtctattttagactcataggcacttatacctagagaacagatatagaaattatcttgctgccttccttctctcacccttttttcatggctgaataagtgaggtcatgaaaggtaaagcagcatttcaacatttacaaatttagtgagcattattactgattttagctttttttttcatttgctcagtggtttttatgctcaatctaatgtacagattcttttttactcaggttaaaggttagaaaatagatattaactaaagcaatgaaaaaaatcttgtcagttttaaaggccattaattccctaatcgccatcagtgaacatttgcttctaattttcaagtgcctgaaaacattttggtcataaaaaagttgaacattctctcctaatcctatttatgtgattcatttgcttttcatatctttttatcagaatacaaaatactcagctctctgcctttagaatggatgcaccgttctggatcctttggggtctttcttttattcaaaatttgtacaaaactataaagttaagaagtttgttgacagcaaatttgctgatattgtgagagaagaagttaaaaaaaaaaagttggctttgtagtttggcactcgggacccccggaggactttttttttttttttttttttttttgaggaggaatttcgcttttgttccccaggctggagtgcaatggcatgatctcagctcactgcaacctccgtcccctgggttcaagtgattctcctgcctcagcctcccaagtagctgggattacaggcatgtaccaccacgcccggctaactttgtatttttttaaaagagacggggtttcttcatgttggtcaggctggtctcaaactcccgacctcaggtgatcttcccgcctcggcctcccaaaatgctgggattataggcgtgagccaccacatccggcccccaggagggctttgtaaaggccatcactattctcccttcatctgttacctcattggtgagttcaggcactgtagaggccccttggataggatggaaatgtgaaagcaacacatttcccttcactgtttcaaatgcagagggacttataaggtccttatgatctttatggtacttaatctagatcattttataaaagctagacaaaaaaggagatataacaacacaacactgcagttcaaatgtcgttaccttcaaaattaaatttcatataacgcagacttcgttttatccccaatataaaaacctcacactgaatattaaacatctttaaaaatgagtacagaaggacacacgatacgtgtttgaaactgattgcctgatcttgaagttcacagtaactgtctatagagtttcatgtaggcaccgagaagaatacagagtgtaaaacaaacatcactaaaaatacatttttatactaggattttccagaaagacttatagaaaattgcacatgtactgccgaatcagagattgtggtgggccaaatctaagcaatcaataggaacagtaatccattataatttttagataattaattctaagggaaatctttgagggggctcttacctttccttagatttctggtaactgcacatcttatctaacaaaaacagaaaccccaagcatctcataaccgatctctttcctgagtctgttaagtagatactggttttctgttcactgtcttattaagttattttctgtaactactgcttagttgatttcttgctgaaaaaaaaaaatacttgtctttgcaaatatggtctctgaaaactgaatctataattttaccctgtgtcttcatttgtatgctcaagactgtcaaattgtcacacacaaaaactaaatagatttaaatggtggaaagaatgctacaaaatgctgtcacgtctaccttgatggttcacatttagagtgttatttttgacggaaagttagaaatttacaccctagaatattttagttattaattttatctacatttcacattctttacagccaaacatgttgctaaacagctttatggcatagatgggattttttttttgtctcccaggcaattaaaaagctctactgtcccatcagatatgcttatctaataagctctaagtattggctaaaaaatgaaaagtggcatctcacctctctattgtttataatgatcttttacatttcagagcattacattttgttgtgttctaacactcccatttaaaaactttgcccaaggaattaaaaaatgtgctatttacccagattagtttttaaatctcaatttttaaggtaatatttggaacagtcttttgtgtcttttaaagttgatggactcttttttcatccgtccattgaggaacacttgggttgattccattatcttgtttattgtgaatagtgctgcaataaacatgggagtgccaatctctttgaaatcatggatgaaactggaggatattatattatgtgacataagctagacacagaaaaacaaataccacattatcgcactcatgtagaatctataaactctaaactcatagaagtagagaatagaatagtggttaccaaaggctggggtggttgggggaagggggaatggagaaatgttcctcaaagtgtatgtaatacagttagatgggaggagttaagttcaagagatctcttctatagcatggtgactgtagttaaagaagacatattgtactcttgaaaaatgcaaagtggatgttaagtggtcttaccacaaaagtgataactagatgaggtaatacatttgttacttaggtatatttaaccatttcacaatgtgtgtgtgtgtgcgtgtgtgtgtgtatacacacatacatacatacatacatatatacacatacatacatatatatacacacacacattgtgaaatgtgtatatgtatatacatatagttatacattgcttacaatggggatacattgtgagaaatttgtcattattgcaagttcattgtgtgactatcgtagagtatacttacagaaaactagacggtatagcttactatacacctacactatgtggcacagcctattgccgctaggctacaaacctgtccatttatggaataatgtaggcaattgtaaataacggtaagtgtttttgtatctaaacatagaaaaggtacagtaaaaacttcagtgttacaagcttatgggaccaccatttgcacatgtgctctgtttttgacctaaatgttttgaggtgcatgactgtatttcaaaacatcatgttgtacacgataaatacgtataactgtatctgtcattataaacgtgtaacaaaaatcatggactctgacttttctctttgatcatttaaatggtaacgactttagttgaaataaaatcctcatgaaaaataacacaaaaggccaatgatacattacatataaaaaaaatttgttttgttcccacttcaaaatgagagttcacgatgcctttgttgaaagaggtaagcaattggtgggccctccgggctacgtataggactgccaatctgcatcctagttctggctccaagacaaccacaatgggagacagaatacttggtggagatgcttttctccattaaactgtaaaccacttgaggacaaagtcagtcagcatgcttcttttaccacaaccctttgcacgatatctgacccaaagcaggtatcttgtaaatccttgctatataaattagttaaattaagccttaacatttaatattggttgcactgtattttaattttttattggtgagaaatctgaaaaatatgttataaaaatgatcaaattccttactaaaaaagcgtacatttaaaaagtcttattatagttaggtagagtgaatagactccacaatgtttcaaagatagtattggtttttaaactgttaataaagttacatttctatgagtatcctatcaggaaaaacttgacacactctgaatccatccatatgatagtcatggacagaaagaaaaattccaccaggtatatactattttatttttaggttgtcaaacatctaaatatatatgaaaataagtccatgtggaaatacccagatgtttagtgctgtgaatgaaaatttcatccagagtaatatgaatgtatagctctatggtattatcagtgtcaattagactctaagccacagtttcattttgtaagtggagaaatgagaatctccagagtttcatagctctcactcagcctgattcaatgattttagttaccacctgatcctctgaggtatgcattatccttgcactgggtgagaaaatactaatcactgggtcagtgtgccaaagaggctcagcatactttgaggcacaagctttaacaatttgggcagaccacaagataagcataatgagctaaatctcttgtcatacattttacaaatttctgacctatgtgaatggatttctgctttatataaatcagctgcttgaaggaatagaaagctatgcattttataaaatatgtgcctacatttaaaaccgctcagatttatttttgaacattatgttaggaccagaaatacagggctgtatgagttggagaagtgacgttgttttagctagaaaaatattgcttttattttttctacatactacacatccctgctggcccagtatgtatatttggtagaaagaaaagttgagaaagctatttattcacagtcaaactcaagtacacgaagatgagccgactgtaattgctttgtaggacaggccagaagtattcctgagaatcacgctgatggtacatatacaaattataatgcatttggaataaaaatatccttaaaaaaaaaagaagacagtggctgctttctagtatttaaaagtgtttcagtaaggactggggaatcattccaagataggtatagagtcatgttattgaccagtgatgttgaaaatggaagatgacatagggtgagactatagagtgtattctggaaatgatacttgatttttaaccaaagtaactctaatcattaatcttcaagagaagaggtatgtttggtaagagaatgtcaaataaatttgatgattataatgttagggctgctgataaaggaagctgattatgagaacctacttaaaaggaaaagaaacttggatcactgctgaggagtgagtcctttattacctgtagaagaaaatgagcacccttctgagtattctgtgcagtccagtgttggagtccaagacagtgatggggtgatcgtggcagtatcatatccaaggcataagagttgaagttgttctcttgtcacctcagatcagattatatctaaagtatgtattcctttattggagtcatattttaataggaacattgacaatccagaacagatctagagcaaggcaagcgagaccaggaagtaagtcaaaccatatcatgggcagagttaaaatatttagaatatttaagaatacacatggcatttatgaaactttttttggtctctgaaagaagtgagcttgagaacccagaccactgatacccaacttctgttctacctggatcgaatcttgtcctgctctatgttcttcctacctcccaaaaagacaattacagcaacaatatttcactcagtataggtgctaaaagtattcttgacactgctgcttacatgattatatattgtcattaatttcatttttattgacagttcatgatgcaaaatgcttcctacttaaaataacaaacatctcaatgctgtatttacacaatgatatgctatgtatgcgctgatgtattatatgaataaaaaataactgcaggtattcataaatacctgttgaaggcagacttaatgcaacaatatagaattaaagacacttcttttatttttcattgtctcactcaggacctatttctttgtaaaaatcaaatgttctcccttttaagtttgaaaatactgtgattctataattccacagggaaagaatgcataataaaagtgtggagagaagaaaaaagttattactagttatattaaaaacctgtttcaagtgcgaagatctgtcttgtttcctgccccactgtgtgtgtatatatataatttatatataacatgtaattatatatttatattatatatttattatatgtaatataattatatatttatcatatataattatatgtacatatatgatttgaacaaaaaatcttacaaattttcttctatgaaaagtatatgtgtaaatgtgtatatataatttgaataaaataaaatacttataaatttttgtaagcctaagagacaatgagagaaagataatttccctttctaccaaaaagtccataatcaacagctaaatagttccattttgatcaacttgtaagaaaagtatgaagctagtaataattttattatttctccattaagtgaaagttaggagagcaagacttccagctctaattatgacagatcttcatttagcatgttaaagtttttggatccaatgagattgaagaatgatttctctagagtttgtcctgaaggtttatgccagagcaccagattttaccactgttgtatgcttagtgtgttgaaaggcacacgatgttatcccatgcctatgtgacaaacacataaaatgaacttaaaaattattcagtgtaattctcttattttctggggaacctttcccctactctgtgtatctttctttatccctgctatttgtttagggctttgttattagttttttaaaggcttttttttttttttgagacggagtctcgctctgtctcccaggctggagtacagtggcgtgatctctgctcactgcaagctccacctcccgggttcgtgccattctcctgcctcagcctcctgagtagctgggactacaggcgcctgccaccatgcccggctaattttttgttatttttagtagagacggggtttcaccatgttggccaggatggtctccatctcttgacctcatgatcctcccacctcagcctcccaaagtgctgggattataggcgtgagccactgtgcctggccttaaagactatttttagagcagttttaggctcacagaaaaatggagaaaaagttacaaagatatcccatatactccctgaaacacacatgcatagcctccacattatcagcatcttctgcattagtggcacattagttacaatgtatgaccctgcactgacatatcattatcaaccaaagtcaatagtttacaatagggttcactcttggttttttacattctgcgagtgtggacaaatctataatgacatgtatcagccattatagtatcacacagagtagcttcactgccctaaaaattttctatttttcatggattcacctgacttttcccctgggatccctggccaccactgatctttctattgtcctcatagttttgtagaacttcattattttacttatgaaaatacttctccatattatgtcagggtagtcaccaatactaaaagtactgatgggaaagatgtaccttcaagaaaaattacagaggtgtccttacaatatcttgtctaattatacaagatctattattgttttcttttaggctcactcttaggatagcctaaagaaatcgacagaaataatgaatattcttttgaagaagtcatcattcttcagataagggtcataaataataatccgttgcacatacgtgatactttataatttgaaagaccatttcacgagcattatcacatcatttgtattctgattcttttcatggggagatgttgacctattgagatttataaagaataattcaaaaagagtattggggccgggcgcggtggctcacgcctgtaatcccagcactttgggaggccgaggtgggcggatcacgaggtcaggagatggagaccatcccggctaaaacggtgaaaccccgtctctactaaaaatacaaaaaattagccgggcgcggtggcgggcacctgtagtcccagctactcgggaggctgaggcaggagaatggcgtgaacccgggaggcggagtttgcagtgagccgagatcccgccactgcactccagcctgggcgacagagcgagactcagtctcaaaaaaaaaaaaaaaaaaaaaaaaaaggagtattgggcttacagattgtcagattttaattatcaatgtatagttggtttatataaaaagaatattgtagctctgttaaataattcattaaattttcttctaaaatgtggatgctttaaaatattttcaatgaattaatcatttgccctttaaaatagtttttgaaacataaggaatttttgaaacataaaacttcatactagttgcaatttataaaaggtgtttttgtttgtatgcttgttatgggaagatgtattgttatataataactataaagctttgaccactgtgtttgatcctagagaagttatataaaaatgcaaagtctatgcaacataatttcaaaataattttttatatttcttataactttaaaaaaacttttccttagctctcataaactatgtgccataccttaagtgcttccatgcttttttcaatttgtcctgatccattaaaaagtggacaattccaccttgaccttctatgtttcacatagtctcccccaccatccccccttgctcctgagtgtcaaacacaaaagtccttaaaacatcctgctcaaaggaaagaggaaagggagggactgggtagccaaaccagaatcctctttggtcggtatattagtttgctaaggctgccataacagagtaccagagacggaatggtttcaacaacagaaataaattttctcgtggttatggtgatcttggaagttcaaggtcaaagtggcagggttggttccccctcagacctctctctgtggcttccagatagctactctcttgttgcctcttcatgtggctgttttctgtgcacaccatgcctggtgtttctgtgcatatccaaatttcctcttctgataaagacactagtcagcttggaaagagcccactctaacagctcatttcacttcatctaaaggtcctatttccaagtacagtcacattctgaagtaccgggaggatagggcttcaacaaaaaaattttggggtgagagaaggcacagtttagtttgtaacagacggcaaagagaggagagaggtgcgtcaactttacattttttaatctaacataaatgcattcagtcgccagctaatttctgtttggagaggtcaaatttctctgttattttggaactgagaagcatgcctatgtcacaggagagggtatgactcccttaaagattatctaattaatattgtctttctccattggattcctccaagtatgggaagtaaaggaagaaaggagaataaataaatcaaaggaaatcaaaaaagccccttttagatggcttaaacaggactggagataccatgaaaccgaggctgaggaagcctacaagctgcggctggcatgaaatgtcaagtagttctttgacattgatgtgccggagtcccaggcaagtttcccctaaatctgtgttagcacactcatgtgtagggaggggagcctgggtcacgtaactccagctaattcttagacagaggaatgaagatgaagtgttacctgaacttcagactttttcataagaaattagagattacatttctatgtgaaatgttgtgaacttgaaaaacctcttgggattggatcaggcatatttgtggatcatatctaggtggttacccacgttcttttcaaagcacattgcaccacatggctttgtcttctaacagacttgtgaaataagtatgatgattcaagttttaaatgagtccaacgctcatagaaatgaaggaactttctgcttttcattcaactaataaatggcacaggcaaaattgaaactcagtgtcttgcatcaaagcccagagttttcatttgtcttactgtatttctcagacaatgtattgtcatccaggtatcacatgacacacttagttgtttctaaaaacttattatcgaagcttatttctcaactgtccactgcagtttttgaaagaaaaaatgaaatagatataagaatcatgggacccataaccctccctttcttggtcccaccaactgtagcctcttggaaccaagtcaccaccccgccacctagtggcggcattctctaattggaggttaagtaccacctcaggaaagcaacctgaaaatggaaacacaaaaacacgtgcgtagtttcaatctgtaatccccattaacctgtaaagaggacagaataacataatttgaaatgtgctgagttttgtggagcaaagagtatggaggtcctatgcttagaattcctgccattggacagtcttttagttcaagctgtctcactagtacctctttgaattctagatttcattcttagaatcacatgattatgaaattattagaatattataaattgatgttggattaataaaataatacattgatgaataaatacatgaggccactactctccttaggaaactttcctggctctctgtttcactggaatgtctctgaaactcctgggactagaataggaatgtctccactttctaaacctcacttgtctttccgttctcatttcctaatacatagatctgctactgtttatttccgtgatatggtaaccacagttgaccccccatgtcgaggaaaacttactattctttcttccttttcccttcccttcctttttctttcctttcttcaccttccttcactttcttttcttagttttctcttttttcttttttctttccatctgttctatttatttctctctctcctttcgtttatctctcttcatttgcttccaagttcctacacattcttcaagggtcaatccaaagcagcctcttcaggaagctctccttggtcctgattcttattcaagaaggaagcattatcacttaatcttatacctcacagtatggcaaattctttgactgcaaaaactgtttattaatctctttatcattaaccagttagaacatggacaggatttaagtgttagctaaaagactacatgaattacataattattttagtgtctatcgtgtaattaaatagcaaatgctgtttggtcaacttcacattaaccttctctttctacctggactggctcatttatagctgttttacattaaaaatatatgtggaagttgagaatgcaggcaaaaatatgcttatggttttactgacctgtttatgataaattataagatatactatataaattttgcctttgctcaaaaaaagactatatatgtcagaaactaaaactcgtcgactctagcataatatctccttcacatattgttctgctctcccacacagtagttttaaatacagcttttcaaaattgaatgctagaaatttgcatgctgattctattagggaaaatggtcagattctattcatgttgaatacaagctaaactgatgagatgctgtgacccctctgctacttggcttcaagttaagagaacagaaacagtagtgaggttggcttccttttataaaatgatgaaattccaattagaagaattccaagcttcctttcagcttcatctgtactaatacagatttctactaaggagaagagaattaaaaatgccaagctgcaaaatatctgaaaagagcagactatgtttgagtgtgttggtacatttcagggggaaccaaaatcaaatactaactgcttatcaacaattgaacctcaaacttcaaaactgaagtttaggcagataaaagaatttaaggtcaagaggagacatgactcatactaaacaatagatttttcagttgttcttgaaactgccaacgcagttctttattttatttttttgcaagagcatgaaaatcaaaacaggaaatgaatcaaaattattctcctttcaaataaagtagcagtatacacacacacacgcacacacaaatgtaagagaaaatgaactgatggtttttgtagttgatgatctgaagaagaaattgtttattcattcgatattcctgaaaaataactttaatagaatgagtctatagaaaggaagtagatagccttctttctagtaggcttactatgtgcacaaccacatatataagaataaatcatgtacatgtcactaagtatttatcaaacagcatttgtctaaggctttatgcaagatggtggcaccacgtagtcatgaactgaacaggaaccctgacattttagaatgtatcaaaacaatggatttactcttaagtgattcacatgtaattctcaaagtattaacatcagaaaagaagtattcgcattttccttatactctccaggtcccagaataccatctgtttgctttggttcatacatgttaatgacatttatcaagttaacatatatttgaatttctacacaattggttctcagttcaagaaaaaaaaatagtatctcttacactcaacataaaatcactatcttttgtaaactaacatagaatgtgaagaggaggttgaatcatacctgtgtttattctctcatattataggcttcttgagattgtatgcttcagtttatatttttttaatgttttttctctctctttcaccaatgagtgaatattttctgaaaaattaaatggttattttttaggctactgatccattaattattcgctgtaactttttttttttttttagacggagcctcgctctgtcgcccaggctgaagtgcagtggtgcgatcttggctcattgccacctccgcctcctgggttcaagcatttctctgcctcagcctcccgagtagctgggattacaggcacccaccaccatgcctggctaatttttgtatttttagtagagatggggtttcaccatgttgtccaggctggtcttgaactcctgactccgtgatccaccagcctaggcctcccacagtactggcattacaggcgtgagccaccacgcctggcctattagctataacttttacctttcaattaaaaaaaaaattcatgaaaaaaaaagaaaatgtaaacagttgagttaagttctgaattttgttagctatgttgatttgtagaaagtctactgctggaagctatctgtaataggcttcataagccgttacaagggctatttcatcaaactactcccgacatggaacaggctagactcctccattcattagctcatttacaaacagttatggaggagctactgggtgtcagatgccagctactgtgcaagtatcttatttcagtgagaaataagacagaggccggggtctcaagtgagttctatatagtatgtcatcattgcaaatacacatgatatgtaatacaaagtgatcattatgttaagacagccacagataaatagctatgacgggagtcagaagagaaagagataattttagatgacaggatcagaggcaattttgtgaagggagttgaatttgaactagatctttaagaccaggagagatttggatttgcagatataggtgggaggaattgccacatgtgaaagcacagcagtagtaacaacaaatgaaataactataaattgtaatgaaatctgtgagaagtgataagatatatatcaagtaccctaatgagatggaggcacatatatgaggtgatttagcaatctggtggtaaagatagagaatgtaaattatccacatatatctgaattctttttatggatttgtaatccaacactgtaaatgggaaaattggtagataaaacacgtttggagaacgatttcatttctttaccatttttgtagggtctgcaaagatgctttgaggaaggcacttgccaactttcagtttgctagagaaaattactttaggatcaaatcataagttctgaatcacaaatgaactcaaaatgtgcattgatagcatcattaggtagcagtacggctattgattttcagagttggattggccttcccctgacctttcacccattgttccctttgcccacacatggcaattctactttgaaaaatacagtattttctccattcaccatctctaattcagaccatcggtcaagcttactctggttttatcctgttcatataaaaagaatcacccttttttgccctttgccagctcttacattactagtgtctgctttatggaatcaagagcaaataacttcctacctgcagccaaaatgtctaaaagcagagaattcactctaatcggtaagcaaagtgaaaacaactattatattaaccgaagcacattggtcagtcatttgattaatggaaaatatgctgaattaaaagtaaaagcctattttattttatttttgggggacagggtctctgttgctcaggctggcatacagtggcaaaatcttggcttactgtaacccgtgcctcccaggcccaagctatcctcccacctcagtctcctgagtagctgcaactacaggcacctgtcaccatgcctgggtaatttttgtatgtttttgtagaggcacagttttgtcatgttacccaggctggtctcagactcctggggttaagtgatctgcccacctcgacctcgcaaagtgctggcattacaggtgtgagccaccatgcctggattataaaagtctattttagctaatcattcttaatctacgaaagcgcataaatcataagcaaagcacccactgtggcaaagagagggcagacccctggactggagagcgggttctaatccttattctgctgttatttagcgccatggtcttgatcgggttaattccttcccctgctcagccttgctttcttcatctgtaaagtgaagagtcaaactacatatttgcaattttagatttcaaggattctatgatgaggacagagcttatgaactttctttttagtaccttttatgaaattaaacaagtgtacttgtgatctctttgtccaaatggtagtatatccaaaacatgatacaggtaaatgatattcctgggactttagaaataaagcataaagtgaaccaggcctctctgtcttcattcttctttggtggtgcaggtgtttactttgcattctcattctgaggacacaccatcacagcaagaagcattgcagcaaagatttttttcaaaaacacagccccggcttttcagtgccatcagaactgtttatctagcagattactctttaggctgttaaaatgaacgtggctggagtgacagtccatgcaggcttgattgagtctgagcagaaaacacctgtgagatgtgcgtttctagctctgctaaggatatgatgtcagatctcagcctactcactgctgggtatcttcatgttgttggggcttctttgcttttctaaaaaaaaaaaatcttacatgctctccagatccataaaaaggatttgaggtgtctgctgtactcacatcaatatctcagcaatactgcaccacatgctgcgtcccagtccacgtttctccttcattgaccattatagtctctcctcactgagaaatgtttcagtcactgagcattgtaatcacctgcaggaagtctatgtttagatgaatgtataatttaaacccaatgagcaaacaagtaacacaaacaaattctggagttgtttcttccccatggccgtaggcataattttatgtcatgcctacaggaacataagacccccaataaaagccctttactgcatattcgcaggtgaaatgtcatcatcttctggagagcctacatccttcattccagctttgattagaaaattaggtagtgttggaggaggaatttcagggccccctggatgttgggattgatctgagtcatgaaaatactgaaaaatgaagcgagtagagttcaaagaatgatgagtttgtttgctttaatatatatcccttgtactgaggtccagtgtagttctggtggtctaagcaggacatagacgatggggtaagtaaacatatttattctcattccctcctatactcaacgagtccatttagagattgcctatttcatgggttcttcattgattttcttccttcagtaatttttcagaggaaggggccattcttttatatgggattaggaaaacttatggtatatccttatagtcatctttgttttgtgagcctgggtaagtaaatttgcacttcagaatatatgttttataagatttgaaataaaaccctattagtaattggaggtctgtagtctatatttaactagtacattaattgtacttgacccagaatttttcccctaaattcattacttgaagtaataatacatgtagaaaaaaaaaaagtctatttcttatatctctgctccctagccaaccaaatcccttcccaggagccaacactattaccagcttgtgtaagcttcaagatattttccaatcatacataatacacacaaataccgagttgtttatatgtgccagtatccagcctataattaattatatccagtaatattttccctcaaatatggttcctttcagttcttaaatttttattgggttttaaaaatcatttatattttttctgctgtttattgtttattcattatgttcttttttttcattgagatatgttttctctagaacatatttatagtggctgttttaaagttcttatctgttggctgagcatggtggcccatgtctgtaatcccagcactgtgggttgatcccaggagttcgaaaccagcctggggaacacagcaaaaccctgtctctactaaaaatacaaaaattggcagggtgtggtggtgcatgcctgtagtcccagctacttgggaggctgaggcagagaattgcttgagctggggcagtggaggttgcagcgaacagtgatcccgctactgcactccagtctgggcaacaggagtgaaaccctgtgtcaaaaaaaaaaaaaaaaaacaaattacttctcttaattttaacatctaggcgaccttgtgatcttttctactatctgcgtaactgaccatgagttacatcgtgctgcttgcatccatgttttgtgatattgtatgttagacatttataaaaaacattgtagagtgtattacattatctgctgatacaggtgtgtgttttgttctggcatttggattaataactaataaatcctcttgatcttgtcatgctgtgtgtgtgtgtgtgtgtgtctgtgtgtgtgtgtctgtgtgtgtgcgtgtaggtcttgtcttgactgttttggttctgtctttaatctgggggatgaggacgtgctcacttagggtgtggtcattaacttgaacctgtggcctttctgaggtcttcattgaatgccctctttgcttagtgaggcccctgctttctgacttgcccggaagtttatcatatcctagccctacacagccacagccatctccattcagctctcaatcctggagcagccattctatgctgggccttgaagagtctcatcctgagcatgtgcttttctctctgtaaacccaggatccacaggagatctccgtacagtctcctgcccctcattccatccagccctttttcactggcaccttgctccacaaattcaagtcaccttagcaatctcgaactacagtttctgcctcttcagcttcacaaaaccacagtgctgtcccttgaagaaagcaagaaaaccaacacagagccaagcaaatacacagtgcttacctcctgtgtatctgccttctctcaaagatcaaacacccacagttccagttgacaagtgcctggaaacttctacctcatatactttgtccagttttataattgcttacatcggaaagttaagtttgatatcagttagtttgacttcatgggagttgatacagaagttttaaaagttaggaaatttcatgtaaaaaatatattttttagccttagttgataatttctcgtaccttttagtgtatgaaatgtgactttccaaaaagcagaagaatgttgaaattgaaatatgtgcatttgacaacatccctactttcatccttatcccaagaaaggaagacagaggctgaggcactagaagcacatatcttgccatgattttcctgttcagtcatagtgggacacatgattacgtattgtgcacaggttcacttggtaagaaccaaaggcattttcaatggagaattgtgctgcccctccaatatctgctctagatatgtcgtctctaaaacattgaagctcctggaagttattttgatgataatagtgaattgtaatataatatacccctcacccactggctttctcccacctcacttctatacttacagtcttctggctagaggctgagtccagtggtattgtggtataatgcctcattaggaggtgacaagaacctgaaattaccacatcacttatctccaattgatggcaccaaattcctctaccagagaaagaaaagtgatctgatatctctgtgttctctatatatagatgaccaagttgagccttaagcaagataatcttaattaacctctcacaggtaagagatcctcatgacacgttatgtggatccacaactacagtgacttttctctgcccgctgctcaggctactgcattctcatttgtgatatcagttttcccctgaaattgtaaccaggagtaaggagagtgagtaataagtcaggtactacatgcttgacacaccttcattgtctagtctaataatcacaacctggccggatgcaatggctcatggttgtattcccagcaccccgggaggccaaagcaggcagatcccttgaggtcaggagttcgagaccaacctggacaatataatgaaaccctgtctctactaaaaatataaaaattagcccggtgtggtggcacacacctgtaatccaagcaacttgggaggctgaggcatgagaatcacttgaacccgggaggcggaggttgcagtgagcaaagattgtgccgctgtactccagcctgagtgacagagcaagactgtctcaaaaaaaaaaaaaaaatcaaccttacagtgatgatataattaaccttaacttacagatgtgaaactgagtttcagagaaattaagtaacttgctcaaggtcaaaaatcaagggtttgagtattgagtagttgtgtctatctacctccaacattacatttccagtacgtcacaggttgcattattttatgatggtataaatttaccttgtttccttgtcagatgttgcaaagaatgtgttaacaaagaacctttatttttagaggaatcagctcagtagttttccagtaaaaattatttcaaaagtgtgtagacaaaggtttccgtatctgcagagttgttttttttaagttataaaattagacttgttctagtcaaagcaatcccaatttttttttcaaaaaaattcacttgagataatgtaatttggcattttctttgcctcttgtcaggatggaaaacaatatttctcttgcttgatttaatatcattatgcgtgacaacagagttagcaaagtagcagctattatagcaaggattttcaagttctctccatctaaaggccattaatgaagttagcaaatcagaagcttcacagccaaatatccagtgagaataaccgaaaggactctgtctctggagttgttggatgtaaattgtgttggaagattccccagttgtttttgattcctttctttcttacacaaaactgaatccacaaggtggcacagcaaacagagaaggtggttatatacattaaaaagagtttagacctggcgcagtggcttatgcctgtaatcccagcactttgggaggccaaggtggacggattgtctgaggtcaggagttagagacccgtctggccaacagggtgaaaccctgtctctactaaaaatacaaaaaaattaaggcatggtggcaggcgcctgtaatctcagctactcaggaggctgaggcaggggaattgcttgaaccagggaggtggaggttgcagtgagccgagatcgtgccactgcactccagcctgggtgacagagcgagactccctctggaaaaaaaaaagagtttagatttggggttttaagtgggaaagatagaaccaaaatcagaggcccttttttatctggcatatgcttgaaaattcaataatttctacataccatatggagaatcattagtcataattactaacacaatagcaaagtctatttctctgattaatttttctttgtttgcttattaaataataatatattaccaccatttctttggtaggaaagctctatttttgaagaaacaacattttatataggctctttaattttaatacattatgtatttaatatgaataatatagctataaagtaagacaaaagtgacatttgagattgtgtaatttggcatttcttttttacatttagagaaactgagagcctaagaaagaaagaggcctttcccatttgatcacaacttagagatatacaggaagaaaaaattcagattttatgatgtattttcaccaaattattttgttggagtcgatttgttgtttaattcccagaactgttgagaatacgaagagaatatagcaatcatggtagctactttcaagaagcttaaacaaattcatatgtgttataatgccagaaagggtcaagttatgaaggaaaacaaaagcaaggtaaagggttagaaagtggccgtagtgctaaattatgtaaggtagtcaagggagctttctctgaggtagttacatttaagcagtaacctgaatgaaataagagatcaaaccatgttaatatgttactgaagacattttcaagaacaaggaatattgattgtgaaggatttgaaatgggacatgcttattgtgtttcagtaacagcaaggagaccagtggctgagtacaacgagcattcactcattgactgtacattcacccatgggttatctcagccagagcagtaaggaggaaacagggatctgcaaagagcagagtgaagatgaattatggttatggtatcgtgtaattatattaactatacagtgctaccaagtgctgtattcctacttgagttggaaagcatgcatttggcaagtaaagctcatgggagcaaaagcggttctgagtgaatcacataacattctttacctttcaagaactttattctgagcagatgtcatactaaaatgtagaagcctttaaagttacaatatcaaagttgtctgtgaaaagaaataatctcaaataattttataggcctttgtagttatcaaagagctttcatatctgttaaataatttgatcattacaatgctcctagtctgtatagtaaacgtatcttcagtgtacagtggaggaagttgaggctcagagaggttaactggcgtgccaaaggtcagggagaaaattgtcagtgaatgacaaatcagaaatttagataattcaaatgattttccagaaaatacttactgtttatttctccatgtgtcctggacaattctgtttttctattctgttcatttgatgtcttgacataattattctgtaggaccttgtaagtggttacttttaacttacacagttttacaaacattattagtaaatcaaacatgtaagcatgggcgttgtataatataacggtgtggaatagaaaataagaaggggaatgtgttagttggagacagaatggaaaatattttttcttgaataacttatgtgatccacaatgttatatttacatcttgaacaaaatttgcttgcaacctataaatgaatggttgttatttgttattaaacttaccatacatcatctgttagctaattatgtaggaaaaacttgatattgaaagaaggacaaagatttttgggaagtaatttttgtcattttacttaatcttcaaacatttttaatgtgagaattattgctcccagtttaatgtaatagaaaaagagatttttaacaaaattaaatagcatgtccaagttcatacaggtaaagggactgaatcagtactgtcaatcagttctatctcaccacataacctttgctgtttccttgacttaaattattgctacatttatttaaacaagaataaactgggcgctgaattgcttggcttcataaaaagcattgaagaggattatgtccctgtgaactaaagctcacattgtctgctataggagcaagaaaaaccatcgtgattcaagacagaacacattaaatactaaaagaaatatcaaatgctatgagaagcaaaaggaaggaaagtttgctgtaacctgaagagtcttgaaagagcatctgttatggtcctatttgatagagaaacagagagaacagcttgagcaaagcacagcttgagggttaggaagtgggggcattgcaagaaattagcatgtgatgaaaacagtgttgacagtgggagtcaaacctgaaaagatacagcattttatccaagtattcattaaaatctctaaatttctgtctatttatccttgatggtgtttatatcttaaggggaattccattcagatgagggggcggtgggaaaggccaaagctgacacagttagaggctgactagagaggaaaggacttttcctgggcagtggtagaccctaagaagccagaaactgtgtgacagttgtctatgtgcagggagaagaaacaggaagaaattcagtgttggagaggaatcaaggtagagtatgaaactatgaagctggggtcagggagcattctagggagaggaggttggaatcccatgggatggggagagactagaaggggtcctgagtgatcatgttgggcttacgtaggattccagcattcattcatcatctggattaaaatgagttggagattttaacttttgaggcaaggctagggtggacaggtatttggaatgtgaaaaagaattggtcaaatattggcttataccatgatagaacaaaaactcagttctgcaaatgctgataaaagagggagcattcaaaaataatttcggaacactatcaaaatattcattttctgctgaagtcaaagtgagtggaagttgaagaatgggcaggttttaaagtaataattgtgaaaaatagacctatcatttcacatatctacacacatgacatagaatagaacacgggggtgtttctatttcagcagatttctataagttttctctgatgcctacattgaactgagggctcaagactataggaaaaagaaacactcatgagatacaacatgactactggttagtcttacgaaagaaacaaaatcatccttattatactgattatttactctgctttctattatatgcactggatcaaggtggcctaggattttatcacctttgaccccaagcctgcctgtttccgttatacattagattttttgtcagtctgaacacacattttataaccacagaaccccttctgaatatatgtgattgtctaagtctttaccaaaagctttagattatttttaaaatgtctatatatttgtaacctgccttaactactcttatggcacaaggtcctagatgttggagcagatataaacatgtgacaaaaaccagaattgagtgccttattataggattcattgcatttttcctgctatgtgaaaagtgaataatgagttggaggttgttaaattctaaacatttaaaacatgtgtccatatgcatgattttccttaaaataactcaatttacagttgaaaatgtgaaatttagagaattgtaatcacttacctaaaatccacagctaatatgtgtggagccagaaggaaaaccctgattttttttttttttttactccacgtgtagggctctgatttctcattacaaaaaaaaaagaggcataatagcaaatacaatgtaaattctttgatgcccaactccatattgaaactgaaactgcacatatattgtaaaggttctacttagaatgactatccaagctggttcagtgccattaagatttcccgtccagtttatagggtagcctgcctgtgtccacacaagtgcctgcagcaaactcctgccatgtttccagccggaaatgtcttgccctggtcaggtattaatagctgcctcattttcagattctgactctgcatagccctgttggaattatactgaatggaaaactccacttggcttttcattgctgattaggacctggatgctgtgcaagaaatcccccatttgtcaatttagtagttcaaagcccggttcctacctaatgcggttcctggctcaggaccccaggactccagcttctgtgcaatatctctgatttttgctgttccgggagggaattttaaatgagtatgaaacagaaacctaagaatcgttatttattaaatgagagtgttgtttttctcatgtataaatgacaatgtagtaattatacatcactgatatggtttctataatatgagtaaggcttgcccaaatcaagcttggcatcaaaagcaggattgcgtatgcagtaggaaagcaatgtgtggcattggaagaagtactgaaccagcagcgaggagcccgttgttcaacacagggtctggatctgccgctagcttcctatgacactggggacaattatttcgctgtcatgagctttagttaccttgttagataaaggtgccaaattgtactatcatcactaagcagctttatatctatcttcaaatttacatgtttctgtgatgtacattcataaggaagaaggttttatcaccatctacatatatgacgatatgtacttacacaaaacaggaattatttttttcctaacttctttataaagtctgaaatcttatacattgaatgtattgcttgaactttccagagttccttagcatagcatctagggttaatactgtttgctagtattggactagatcgagaaaaaaaaataataaaaagctttgggattattttaattagtttgtttttaaaagaaaatgaattaaaattcagacctaaatctaagcattttaaaaatactttattagtcctaggaaaaaaacagaacttaatattatcatctatattgaatctgagttacttttatccatatacttggcaatgactaaactctgtcctggcaatattgagacaaggccttcgaagagccagttttccttcacatgggttatcatatagccctgtgctgccaggcaaggaatgtgcaatagtttcattccttccctcactttctttaatcacctggtttatctgattttttttcattgagatatcaattgaatgccacgtaatttacattttaaaaatgtatgcatgctttagtggtttttggtacattcagaaagttttgcaaacatcaccggtatctaatcccagaacatttcatccctccaacaaaacagtcactccacccttatccctctcacctccttccccaacccttgataatcactacagtacttactatctccggatttgcttattctggacatttcatataaatggaatcatacatgtggccttttatatctggctccttgcacttaacataatgtgtatgaggttcatccttgttgccacataaatcagtatttcattcttttttataattgaatggtattacagttgcattctgtagaactatcacactgtatttatccattcatcacttgatagatgtttgggttgtttccacattatgaatgatgtcactatgaacatttgtgcacaagtttttgtgtggacatatgttttcattaatcttagaactatacctaaaagtggaatttttggattgtgtggcaactgtatgtttaaccttttgaggcactgccaacctattttccacagcttctgcataattttacatttccaccagcaatgtatgtgagttgcagtttttccacatcctcataaacactttgtcatgtccatttttaaactatagcctttatagtggatgtgaagtagtatctcatggtcatttgtttctttgattcttaagctagtagttcatttacttaaaactcaaagtactctaagaaatcatatttcagtattaatataaacataatattaatttattgctattcatattatcttactatctacaaccacctttctactccaattttctttggggggtgttttcttggacttttttttgaagggggggttgagatccatttcactgtgtcacccaagctggagtgtggggtgtaatctctgctcactgcaacatccacctccctggttcaagtcatcctcccacctcagcctcccgagtagctggaaatacaggcatctgccaccacacccagctaatttttgcatttttagtagagacggggtttcaccatgttggccaggctggtcttgaactcctgacctcaaatgatctgcttacctcaacctcccgaagtgctggcattacagaggtaagctaccacaccccagcctactccagttttcttagtctcatttttcttcgtctataatgttggaactattcaaaaacaagctgggtgcagtggtacacacctgtagttccagctacttgggaggctgatgtgggaggatcttctgggcccgggagtttgaggccagcctatgcaacatagcaagaccccacctcttacaaaaagaaaaagaaaaaaaaggagagagggagagaaagagagagagagagcactctctacaaataaggagattggcatgggagtatcacctacaaggacatggcttcaaccaacctatattcattaatattcctatattcattaataacttaattccaggtttgcttgcattaaatcatgggagtctcacactgaaattcttccagttcatggagaggaagatggtgactgtggtgaatatgtctgacatgtaggactcctgtttaattgcagctgaagaagatgcaatagcatttgtttttcttctgctgatctcagaaggggagaaatttcttccttccacacaatacattttgttcatgtgacatgttaggatatgattttattgtattgatttttaaatctcattataagtcactaaacaagactcaggcagaaaaggtgagcctgagagactgtgattgtgaagcaatgaatgtgagctctggcattgactcagtagtttcttaaatgtgtatttgaattaatcacgtgaccttttggttttctcacttaccaaatgctggagttgaagtacaggatcttacagtttcttctgagactagaactctcattctgtgtttcactgaggtcaatagtaataggaattaatactattagtaattttcttcaatataatagtaatttttttctattattcctgggctttttacctgagattttgattactaaggaaaaaaatgttttaaggaaattagagaggaagttactgactttaggaaaagtggtgattttcctgaccaagctgtggctgtgtaatacatttgtatatacagaatagtctcttcaaaagcaccttgtgtgcctgtgtttgctgtggttatatttgattttgatttccaggataaattttagttccttatttacatgttaagggtgagtaaatgaggaatggccaatcactttagtttacaaaacatattgctaggatcggagcgcagacttggccacagtcctgaatgattttaacgtagcttcaagcctgagcaagttattatctctgggctgaaggttggctagaaaggcaatcatgttttttgattttgtatgatgaatctttgtaaccaaaggctaatagaaactatgtgtcattgcctttcatttgttcttaacagaggacatggatttcaagcttattggatttaagcatttgctgattcacctttaaatcatttctcttttttgtgtctttttttttttttcctacaggatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaaggtatgaaaccaactgactgtctttgttggacccttatctgtgtgttgacatcaattctgcttcttgcccttttggtccagagagtttgcctggaatgcaacagatcagaagaaagattcaaaagaaatattcagagaacacaatagtatctcttccttttttttttttttttcttttgaggcagagtcttgctctgtcgcccacactagaatgcaatggctcagtctcggctcactgcaacctcctcccggattcgagcaattctcctgcctcagcctccgtagtagctgggaatcttttcctattaaaaaaaaaaaaaaggaaaattctattacaaatacttggcacttaaaaaaaatgcctgaatatagaagccggaaaaattttgaaagtagaaaagaagtggtagttactatctagtatgcagtttcctccttttctaaacctaataatttcctttctcaagatacacccttgaaaaacaaatgatacttttatatttaccgtattgcactgtatccttctcaggtgagcctataaccttttctctcgtaatcatttaattctctgttcatttatttcaaactgaccattagaataaacttttttgtttttttttttctgaggaaaccgatttttggcagctaggctatgttccctcagaaattccttagctaggatgagagcatatcatttgggtaaccacatttcctgaattcagccaagctttctactacaggctgagtaagcttgtttctcctctgaaagtcacattataatcactttaaacattggctcagcatcctcgtctgaggaaatgagaaaattgaggcagtgcattgcaactctgtggcttagtcaagcttgctgtcccctgaatatctcatatggcatggtcagtcaatcagtgtacacaatgcctggtgcatagtacatagcacggtgactgcaaacatttaagtcaatactatcttccaatgttccaagcactggatgaaatgtgatattcaaagcccctagcccctctcaggaccctcttcacatgctgtgtattcagcacatgaaatgaacttttctttcctgcagtatattttcactttatttatttatttatttgagatggagtcttgctctgtcacccaggctggagtgcggtggtgcaatctcggctcactgcagcctctgccccctgggttccagcgattctccttcctcagcctcctgggtagctgggattacaggcacacaccaccacacccggctaatttttgtatttttagtagagacaggatttcgccatgttggccaggctggtctcaaactcctgacctcaggttatctgcccacctcggcctcccaaagtgctgggattacaagcgtgagccaccatgcctggcctattttcattcttattgggctcattttgttcatcacccctgctcctttagtttttatccatttatctcatctgcctggaaaatgtctattagtctttggaaaaaaataattcaagagtcaatacttccatgatggccttcttgactttcttcaagtagaactaaacattcggtcagcttgtcattgcatacatttctctcccatagaaattatgacattaaatttgcccaatgccactctgtctcctcttattcatggttagctcactctttgaatgaacagaacatgttttatttttcttcatatctccctttgtcttctataatagttggcatatcatagagagatatttgataatcagttgtctgaaaagtgaacatgtgaatgaattaatgaatagaaaactataaagacaaagaagaatatatgcgccagagaactttatgatattcttagaggtgtgacatatgtttactcagagcaaaagtaaaatgttaagtgatgcaatatataggatttatattgggactcagagaaaaaggctattattttcccaaaaagtaagatatcattgagaagctaatatttaaacttaccttcagggctaggccaggttcctgcaatttgagatgagaggtagggattaggcagacaaaaacattccaggtgcagtgtgaataaaggcaggaaagtgcctgcttcttagggttaagcaaagggtacctgagaagtaagtaatattttcacagggaaatatatggattctcaaaaatgaaatgtttgatgaattatgctcttaattattgcatcatttttatttgttcatttacattgattttcttcttgttataaaagtagtacaaggtcattaacaattttggaaaatttaggaaagtatgaagaaaagaaatccacgtgttgtgtttattccctttacggataatgccctttatattcaacttcaccctcatgaccccacttaaaaatacacctaggccaggcttggtggctcacgcctgtaatcccaggactttgggagaccgaggtgggcggatcacgaggtcaggagtttgagatcagcctgaccaacatggtgaaaccccgtctctactaaaaatacaaaaattaaccgggcgtggtggcacgtgccggtaatcccagctactcaggagactgaggcaggagaatcaaggaggtggagattgcagtgagctgagatcacgccactgcactccagcctgggtgataaagcaagattttttctcaaaaaaaaaaaaaaaaaaaaattttatatatatatatatatatatatatatatatatatatacctataacctaccctcctaattttagctgctatctgtactttggttaatcaagtttcctcttgggtctggatgagcatgtacgtgtacaactggacattcctatatggattagaattaaggttgtcttcacacaacacaaactcatattaacagcagcttaatcatataaagttttttattctctcacaaaacaaatctagagaccagctatcctagctggtactgtgcttttccaattggtagggccttggctgcatccagcttttactacctctctcccagtgttttgctacggcttatttacaactgtgcactgcacccggaacacaaccacacatgctggccctggatctgcccttctgcccatgatccaaccagcatcttattccagccagagggcagaggagaggtgaagaagacagaaggaaaagccagggccagttttctttccaagttgtccatggtaactgccatatgctacttatcgcactggccacaacctagtcaggtagtcacacttaggtgtaaagaagctaagaatgtagtcttttttttttttttttttttgatagccatataccaaataaatgttctgtgactaggggttatggcacaatgggtattgagacactaaaaactctgcttcaggcttccatcctcttaattttagaatatctctgatttcctaattttctgattgacatcttttggtagattatcgtgtttttactttatgttattgactgatcctttagaatgattttctttttgttctgggaaaaaaaatgcattctaaatcagattcactaatactttgattcacttccaaggatttttgtctctctaggtgtgaagcatatagaatatgatgataattacttccaaaaatgaaaaaaaaaacttaattggttttaggccaaacaccttctcattccctataaatgtctttatcttttgtcttagggaactaactttattgaacaatcttagctaacagttttataaatgcttactctgtgcaggtgctattctaagcacgtctcaattactgtctcttactttccattccatttgtacgaagtaggttccagtattatccgcatttacaaatgtgaaaaatgaaacacagagatattgagtaatttgtcctaaatcatgcagctagcaattggcaaagccagaaatgaaaccaaagcattctgacttgaacaatcaagttcttaaaccccatttaaaactggtaagataggctacagtctgaggtctgagaaagatgtagatgtaacttcaatatagtgggacctagtaaatgatcttgaataaatgtctcctaattgcttctctttttaaaaatctgcaatatatccctaccccttagaaataaaagttcttgcagattaatggagatcatcacactcttgtaactgacatgaaacacatgaaattggttggttctcttctgcctcctatgtgctttgatgtccttataatacagaaaatgtgaacaattaccttatgattctccatgcagttatacattatatccttaaatgattttaacaggttaccattactatcaaagatatgtacacttgaggttgtgtcaggcattaatccactggacattgaaacctttctcctcgctgctgggatactcaaattatttttgctgccaccattacttctattactagtcttactacttctgtatgcagtttatcaatttactatttgctagccaggttgcgtatgttatctctgttaagcctcacaatagttctgtatttttatcctcattttatagatgaggaaacgtaatttaaagtaactaagtaaccagtccaagaccacagggctagataaatacagaactggggttgcagtccaggaaccctgatgtcacgtaacctctgtactatgttgcccttcaatctgaagtaagcctgtgaatatgcaaatactcagaaaagtcagtgatagcaaagcagaaaccttatactatgatgcaatttgaatagtaaactagttttaaatcatgcaaaattgagacaggaatacatgatatgatgagaaacacattggtaaacaatcagataaaacagttaatggaatgccatgttcaagctaggcaagaaagaattaacaatgcatcacttcttttctggtgaattctaacaaggtttatttccactcagcaaaaaaaaaaaaaaaaattggaccagatgatttctaaagttctttggcaatgacattgtgtggcagtcgttataagcccttcactgtaaaaccatgttccttcatagaacctagcctagaatttacatgtaaaactggtctaaacatattttctttattgaattattgaaaaaataaattacagctttatgagctatttccattatttgtgattttttttttaatgaagggataggatgaaaggcatcctagccataacttacatttaaatagattttaggacagacgcagtggctcatacctgtattcccagcaatttgggaagtcgaggcaggtgaatcacttgaggccaggagttcaagaccagcctggccgacatgatgaaacgtcatcactactaaaaaatatgaaaattagccaggtgtggtggtacacacctgtaatccccgctacttgggaggctgaggcaggagaatcactttcaacccagggagtcggagtttgccaggagctgagattgcaccactacactccagcctggtcaacagagaaagattctgtcccaaaaataagtgaataaataaataaataaagttttcgataatatttttccatagggcaggtataaagcacataactagatgacacttttagaaaacgattagaaaatgatagcataagagattagctaacttgctgctaatgggttaaccaaaaaaattattgactattttgtttgtaatgtttaaaggcatctttgtaaccctgtaagtccaatggtaatactgttaacatcctaacagagtccagcactgcacggtaaatgagcccttcctttgtgaagggaattgtcctcttagggaggaaaagccaaagtagggttttttttggctttgggttttgcttttgttcttttgttttttcctgcttatttgtttttcacatatgtctgcctttatcccagtcctgctggtgttgtcttttgaatgtcacgattcccaaaattaagctctgccagtttgaggatggttaagtcctacactgataacatgataataattacccaccagcccatttcccttcactctttcacgtctcatcctgtgtttagagaacaggagcgttgatgaggggtttcagggtcacctattctgatagatggccttgatgtttaagcacattactatgtacattgcatataaacctctacttacatgggtcccctcccctggaattttggacaatagcacaggcttcctgattctcaattctgccctttcagagtattgttcaaagcacagataagtaacttccccagatgtaaagtgttttagtggtgacctccccctttagcatcagatatagcagtcaaatactctttgacaaagaacaaaatatagtctcctccttttctcctccctcctccttcaagaagcacattgctcagctactgcaggtggctgagtatttaggatctggttcttcccttctgaaaaaaaaagtctgtgtactttgcaaagatttaagcttcaagagctgagacctggagaaataaatatatttccaaataagataactaagaatcatttgagagccatccatacagaagtattaaacttggaataaaggaatattgatttatttctcccaatttatttggtagtggggagacagtactaacacacacacacacacacacacacactcacacacacttggccatatacatggtttccattttctttgttagaattggtgctttaagctcatagaatctgatttaagactcagcagaatgtaaactgtcatttcccaaacatcagtaccagaaccatctgtagtgttcctagaagctaacagattctcagagcaaatctccaaagtgatctgatgtttgaaacctatgtatgacctaggactctataggtttaaaacgctgtccaggggatttctgatggcattgagtttgagatgcagtgttctgaatttggtgtttctaagctccttttggtcaaatctggccatggatgatttaaatttattcatattattgtgatcaatatattggactgaatctaatgtaatataaattgtccctctgacatgaaattaagtatactatatatgttacatttttacattccctactactatcaagacaggtatgttttagtccagggttaaattcctatatgaagtcagtagaggtaatgccaattattttattaaattgacacctcttagagcaacctaatagaaatcaagtaaccaagaatacagaagtgtctaattctttgggtcaaaatttggcaatgatttgctaagcaatttttgtttgaatgaaagcaagtgtattggagaagtcaagaaacagaagaatggctactccataggcagagcagccttgctaagtaattttgagaaaataatttatctccttctacctcagtcatctctgaagataaagtctattataaattccacctgcttcaaaggaataatatgaaaattagacattgtaaaaaaaagttggatttttcaagagaattctgtcagatcaaacatgaaatgcctttttcattttgtcttagaaaatggacattgtcttactgtgttttgtattggaaaaatgctgtgagatgtggcattgcatgagaaattaaaggcaatgaaaatggaatctggaaggaaaataacaatcccttcaaaactacataataagacaccaaagaacagagcaaatcaggagtcctgatgttttaaaactccaactggtggacactaatgccaaatttgatatttttatttcaataaactggaaatagaaataaatgccttggttctcttttggacccaaccatactgaaagacaaaagcagaaagatggagcaaaaaagaacctctctgccagtaattgttttaattacagaaaggataatagctgcaactctttcttttgtgttttgggtttctgccagcctgtgatactttcctcctgcaaaccattgtaacttattcaaaccagttttttctggtttctgaatgtagtctttaatacaaccctcttacctcttccccacacattcttcctctttctctctctttgtccctcattgcaaatattgctttttctttctttctaaacgaacatacagacgcttttgttcacaacgttatagttgttatctcattatagtaaatatgtatagcacagtgaatgcatttctaaggcaatacatttcttccaaactagcacttagaattctcccagagttccaaaaggatcccatgtaacattaattcaggtgtgaaattgctttaggtaaatttcccacacccttctatgatctgctattaagacaattaagtatcttcaatggtgcattaactaacacagcagtctaacctttcagcttcttggaaattacagaggaccaaggaaaattcaattaaatttgtagtaataaaatgattaatcatatttcatttgtctttgatggtaactagtagtcgatggaggttctttatagagtttaatgttttagttttattaaaaacagaagttaaattgtttttatttggaaaacagaatttgtcagaacaactccagtgttcccacacacaggttgttcaactctccactacagagtgacattgacacttaaaaattactgctagcactctcaaatttcaaaggatctgtcaagaatacagcaacaatataaagtgataattagtagcagctatactaccttatattccatttgaatggcatattgtcctttcaacatgctttctgaaccaaagtatcatttaatagccactaaatccttggaagtatgaaggttaagatttactatccctattttaaacacgagaaagatgtcatttctagaggttaactcacttaggtgtatacagctagaaagaagcaaaactagaattgttacctggtaacttcagatgtcatgcttttcctactacaaatgtgatgtgatgtgtgtgtgtgtgtgtgtgtgtgtgtgtgtaaataggcgttgtcattccttaaagttattcaatttagttacttaatcagttgtgtgtgtgtgtgtatttgtgtgtaacttcttatgaattagaatctgcagaggcaagacatagatacaaatgtgtattcttagaacatccgggtatttctcatggaagaattaaggacagcaactctacaagttgagtgtgcatcagaattacctagagagcccactaaagcatagattgctaggccccatctcctgaatttttaattctgtacgtttgagctggccaaataatttgcatttcttaacgttcctgctgttggtggtggtggttaggggtcatgccttgacaatcactaagtttagggaactgtctgatgcaatgatccttagaatctctttcctttctagactctataatgcaccatatatacaaggaaaggtaagggtggtcgtcagctttcttggtttattttctgtttcattgatttttcttatttctgtgaagatgaggcttattatttgattattcaaatatcacttaactaaaggagcttgataaatattgtctaccgtatagtattccttgctccatttgtgtcaaagtcatctattttacctttatattggtcagtttcagggaactcagcccaagtttaggaccttagataaagtaaagattcactgactttaaaggtgaaagaaaaatcagctttactccaaccaaagacttcttcagttagtcactgtagcatagtagataggaatattcatttggaacataactatgaaacatctactaagcgtctttcactgtactaatggggacacagttagtactcaaggaaagacaattttgacttgatagcatttatgtctagaaatgggtaaaaaatacgcaattaaaaataagcaagcattttaaaacatcactagagattagttccaagaaaaaaatatgggactattttaaaaaggatgatgaaggtaaattttttagagaagatgacgtaaatgatgtttgaacagtaatctgaatgaaatttagtagtaaaccatgcaaagatgtggcacaaggtttttgcaggcaaagctgagagattccaaaggcttttatagactccgaggatgcctaataatgagcaagaaagccaatgtgactagaatggattgattaaaggaatggaaggtaggagatgaacttagagagaaaggaaagactataaattgagggcttgtaaccaccttcaggactttagattttatggttaatgtgatggggattcattatagattttgagcagaattgcagtgaaatcatccaggatcttaagcaagatagtattagattggactctagggttttataactagaggtagagagaatgactttgaatttattttgaaggtagacctgatagagcatgctaatggattggatgtaggttgttagataaagacagaaatcagggatgacttttaggtgttaggcatgatgaactgggcgaataatgggtctgtgtgctgaaatgtgtacacacacacacacacacacacacacacacccctacttaaatatgacattttaaaatcacttgtaatcccctagtactggttattacaactcagacactactgacattttgggactttgggttctataattccttgttgtggggcacttccctgtgcattggaggatatgtagcaacatctatagcctctatgttcaggataccaatagcaaatcatcctctctagtggtgacaaacaaacatgtctcagacattacgaaagattcactgaaggcaaattcaccaccgcttgacaaccactgccctaggttctatgactacttttcaaatggggagactatcttgtttggaaaaattattctattgtgtggaactttctcacattatagaatattagtaataccaccttgacctccatcactatagttgtgacaagaaatggggagaatacttccctagtttcttcacactgctaagaaaatgaatgtaattgctgacttactcctggggaacactaacatttattggaaaaggaggctcctgcaaaggagaataaaatagagtagccagtgatttgcagaaagactaggctattttgattgatgttcaagaagccaagtgaaaacatcttgtcaaaaaggaggaaataattaactgtatccaacactgctggagtgtctagcaagctgctaaatgagaattgatctttgcttttgtaactcgtggtcagtagtgacttgacatgagtgattttggtgaaacagtgagaaataagtctgaatggaaagaattaaatgataactggaggcaaagaaaagaagaaggtaatattgaatattaaagttcttttgagaactgctgctataaaaaggaagtagagaaatgaggagggagctggtgagaaacatgacagttacatggtagggttctttgtttttaaagctatttcatacattcatatactgatgggaacaatctgggataagcagacattgggatcacaggagagagggacaccaaagaacactgagtagaagggctgggactgagtgcaccatggcgctctagatttaggtaagaactgcacagtgcaagcattgtaacaagcaggagtcagaacacgtgggggcagatgtccataggttggtaatttttgccatgaaaacatttctcatctaattctcctttctaagtgaaatgcaaagtcagacagtttattgtcttggaaaataaagaggaagaataagaaggagagagggagaaggaaggaaggagggaaggaaggagaaagagagagagagagggagggagggaaggaagggagggagggagggagggaaaaaacagagagaaagaaagaaggaagaagaaaaaaagagaaagacgagaagaaagaaagaaagagaaagaaagggagggagggagagagggagggcgggaggaagggagggaaggaaagaagaaagaaaaaggaaagagagaggaaggaagggagagagagacaaagagcaagaaagcaagaaaaaagaagaaagaaagaaagaaaaaagagaaaaagaaagagaaagaaagaaaaagaaagagagagaaagaaaagaaagaaagaaagaaagaaagaaagaaagaaagaaagaaagaaagaaagaaagaaagagaaagagaaagggaaaagcaggcaggtctatttcctgagtctgtggaggggctaaggtggtattggaagcttgaggtacaaggggaaggtgtgaaataagtaacttgcgaagcatgagagagctgattgaccagaaagatgtagtagaattccagaaagtgctgtgtacaaccatgaggtttggggtcaaggttttgacttacgaccagtcaaaacagttttatgtttttcagcatatttacacatactcaactgttaggctatcagcttagagcaggggcaccagggttagtctcaaatggattttaaagctgactgccctgtattgctatattactttggacaggttaccctctttgttcttcagtttactcagctgcaaaacaggccactaaaagtatctatttttatggtcatttaaaaaactgtttgtatgtataatgtgcaggcatatagtaagtgctcagttaacgttagatattattatgaggatgactaatgcttaataggagagtactcataggatggtacttggcacccggtttattatagctgtgtgctttataaataacagcaatgcccaagattttacttttttcatacttttaagaaagtctttgtttcattgtaattttttcagaagaaatttataactaaaatagaagttattgttgaatgttagaagttgtaaataggggaatctgagccatcacgatggcaaggaaagcctgcatattctggtaactgcatttgcaacacaggcacccatgaaaagaatgtaatagaaaaatattaaatagaaagcttgccctggaaaaaatccatacctaatcctacaaagagaaaatggattgtttttgacaatacttcaaagctcagtgatatatatttcacatttctcttttctaaaagtgtaaatttttcactttaaaatgaagcaagaattaaataaatagaacaaataccatatatcatcacagagtcaatatattatggtcctgttctgaccaagtgttgcattgtatttgtgttaccagaactgcagggctttctatggctacatggtcagtgcatgctcagacagctgttaaaatcaaaaccttcactgtgctgggtcacctggtaactactgtctatctcacaagtgcattctgctgacattcaagggttaaactggtttctagtaaatactgtgctttaaagtagtacatactgtgagctgtgttattagaaacctgcttgtccttgtgtctgaaaataaggaggaacactctcgcaccaaatctctaccttattttcactcagaaagctgggttaaatctctccgtttcaatctacgatagctctagaaaagtcaaaagcatgaatagaaagaaacattaagaagaaggaagaaaattgaaatgtaagtcagaatagaggaaaaataagaagaaaagaagtgaaataagagtgtgctttgatttgaagaaagagtacagaagaaccaaaaagaaatgcttcctcttcaaaacatgatcgtattttaccatttgtccaaaactattatgatgatacatgcattagaggagcaatgatattttatctcagaaatatcctggggtgagggaagcaaatatttcttttcctactctatgtacttgacaaatgaatagaaagagggcaagcggcttgatcaaggacaacccagaaaagccagatgaaagggaaataacattgtttatttatcttgcaggccagatgaaagggaaataacattgtttatttatcttgcaggccttgcatctttaggacactgaacatccttgaaatttgggtactgaaactgtgttggaaaaatagtatcaagtgcaatcagagagaaacaaagtttaaatcagttttatactaagtactatctataacatcatacctgctgaaaataaaatctatatcacaagtgttgccccaaggtcctgagtgagacatagttaactagtaacatcccatattgtctaaattagaggatttgcttccaatttcatatgagaagtgccactgaatctgagtttttgtggaacaggattggggaactgggaagacaagaaagatagggagtttctgtttgtttgttttgttttcatgttatttccagtctagaaattactgcttatcataagaactaaaatatcaaattttgttctcatagctgaagtggcctccagtgcataacacagaggaaacaggaaaataatttttgaagaaaaaaaagagatttaaaaaaaattctagcacctcctaaagcatggcaaatctattcctggtgaaataatattgcgcattataacagaaagagatggaaaaagtccctcttgaaatacattgcacttcgagctactacaaatcaagggactaggaatctttctggttaataataaggatctgattattaggaagagagaaacttaatctggcataggataagaataatttgagaaccacagtttaagagttgtagaattcatgtagctattgaaggtcagagcctagacagttctctggacatacttgctaaaggtttcccctaaatgcttaatagtatgtgattagaaattaatagcagaactccaaattctagtgctgatatttatataagatcatgaataaattttactataaagtacatgtgattcccattttctatgtggtattagtaattctccatacttgttcatagccaaaaggccagaagcaatgacattagtaattcttaatttattttttgtttgtttaggcttcttaagctcccccccaaaacaaaagaacatgttttagatcgcccaaatgaacctcacctttcaattgcattcagaattatggtacttggaatgggtatattagataaacagtgggccctatacacacagtgggacttcagctagatttattcctacgaaattgtgattgtgtttgcaaagcaccagaacaactcataaaagtttcaaatgctgaaagatggccgaataggaacagctccggtctacagctcccagcgtgagcaatgcagaagactggtgatttctgcatttccatctgaggtaccaggttcatctcactagggagtgccagacagtgggcgcaggtcagtgggtgcgcgcaccgggcgcgagccgaagcagggcgaggcattgcctcacctgggaagcgcaagggggcagggagttccctttccgagtcaaagaaaggggtgacagacgcacctggaaaatcgggtcactcccacccgaatattgcgcttttcagaccggcttaaaaaacggcgcaccacgagactatatcccacacctggctcggagggtcctacgcccacggagtctcgctgattgccagcacagcagtctgagatcaaactgcaaggcggcagcgaggctgggggaggggcgcccgccattgcccaggcttgtttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaaggtccctgtctgacagctttgaagagagcagtggttctcccagcacgcagctggagatctgagaacgggcagactacctcctcaagtgggtccctgacccctgacccccgagcagcctaactgggaggcaccgcccagcaggggcacactgacacctctcacagcagggtactccaacagacctgcagctgagggtcctgtctgttagaaggaaaactaacaaacagaaaggacatccacaccaaaaacccatctgtatatcaccatcatcaaagaccaaaagtagataaaaccacaaaaatggggaaaaaacagaacagaaaaactggaaactctaaaatgcagagcgtctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctcaggagccgatgcgatcaactggaagaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttcccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagattaggaagaaactgcatcaactaacgagcaaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataaaatacctaggaatccaacttacaaggggtgtgaaggacctcttcaaggagaactacaaaccactgctcaaggaaataaaagaggatacaaacaaatggaagaacattccatgctcatggctaggaagaatcaatgtcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagagcaaagctggaggcatcacactacctgacttcaaactatactacaaggctacagtaaccaaaacagcatggtactggtaccaaaacagagatatagatcaatggaacagaatagagccctcagaaataatgccgcatacctacaactatctgatctttgacaaacctgagaaaaccaagcaatggggaaaggattccccatttaataaatggtgctgggaaaactggatagccatatgtaggaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctagtcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccactatgagataccatctcacaccagttagaatggcaatcattaaaaagtcaggagacaacaggtgctggagaggacgtggagaaataggaacacttttacactgttggtgggactgtaaactagttcaaccattgtggaagtcagtgtggcgattcctcagggatctagaactggaaataccatttgacccagccatcccattactgggtatatacccaaatgactataaatcatgctgctataaagacacatgcagacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatctaacctgcacaatgtgcacatgtaccctaaaacttaaagtataataataaaaaaaaaggttcaaatgctgccagtcattccttacagagttcactcagtgagattcagtttgaatgatttttcttgactatactgactagttgtatccatatcacgtaaacctagacatttttctacataaaggaattaatagatttttctttatacactcatgtcggatggacgttaactcttcatttgctatcatatcacttaattaactaagtatattaactcttcacttgctatcatattgagcctgatatatatgatgttcacggtttaaattttctggcctggaattcagcaagctctgacacaaattagccttatccttcttattcgtcatcacctccctattttacccagtcctgtagtgtttatttttgcacttatgtctcatctgaattaggactagctacattgtacgtgctcagtggccacatatggctaaatggatgctatactaggcagcacagtcctagaatattttcatcagatttctctatccttttcctcgccctgtacctcctcagttatatctcaactctctcttccttaatacagttctaaaactaatgttttttattattggggaattgctggctcttcctatgcaaatggaacacctctggctttaatagtcacttcttataccttatactcaggacaattcaggacaagttgtttgtttgtttgctttttaattgtggtaaaatatgataatacaaaatttaccattttaatcatttttaagtatatgtttcattgccgttaagtacattgacattgttgtgcaaacatcaccatcatccaactccagaactttttcatctcccccaactgaaactctgtactcattaaataagaaatccccattcttccccagcccctggcaagtacagttctattttttgcctctgtgaacttgactactctgggtatctcacataagtggaatcaatatttggctccttgtaactggcttatttcacctagcagaatttcttcaaggttcattcatgttgtagtatgtgtcagaattttgttttttaggctgaataatatttcattatatgtataggccacattatatttacccattcatttgtcaatggacattttggtgcttccatcttttggctacagtgaataatccttctatggacatggatgtacagatagatgctggggtccctgctttcatttattttgagtgtacacctacagttggaattgctggatcatatggtacatccgtatttaattttttgaggaatcaccatttcattttccacggtggctgagccattttacatttaagtagaaatgaatagggtttcaatttctccacatactcaccaactcttgttactttcttttttgattttgtttataacagccatatgttttcttttattaccatttctgaatgactttaggaatatttagtgaagttaaggccaacttaaatcttgattaacatacagacataagaattcaaacactgatatgtcagtcattttacattgtttgttggataaattatggtatttctgattttattcaaaactcttaactaggaccttgaaaccctaaatattcatcctggccctgccactactcactctctgactttatggaagtggcttaatttcttttatatttaaaaaaaatgggggtgataatttctcacctactatattcactgggttataattgtaaaatttagttaatcaatttaaaattgctttgaatactctgaaatgatattgaggctgctatatacatcatggtgattttcgtttacattttgcacatataatgcactttagagaacacttacgccttgtttccttcctcaattttgtttcattatttaccatgtacattcagaatagcagtcattaagcgttaatgcaactatggatggtagtaaggcagttatattactgaagggaggtactttattctttctttgctttctaattggattatggtctttaaattatattgtaattcagaaatttgattgagacttattccccttgatttgtcagcttcttagatatattactgaatcctaggtcctgtaaataacaatgaaaattaatgctcaagaaattacatttaatctattgctttgaccaaggttttgctctccgtatttgtatttgcatgcagtttctagaataactttagtttgctttctctgaacatctttttattttggttaacagaagtatagaaattcaaatacctatttgatttattgaggaggggggcagttttcatcagtgaactggaaaacctaccttttacttgtcgttttctaactgggacatgaactaggttttcaaaaccgttaattttattactccatttagtgcaaagattgggaaattagaaaatgagttgtatgagaaaaagagcaaattttacatcttgctgtggcactggtgacttttggtctttttgaaacactgtatattttcagatgtcaatttgcaataccgctcaatataaggatggccagcagggttaaattactggaaaagttatctgcagcagtaattataacagtaacattgtgtgttgacacaaatgaagtattttatgtgcaagtgagaaatagaaaacaaaacaaaaaaaaagataaaagtccaagtgaatgttttgggtagaatctgtggcataaaaaaactaaaaaggaaattgcaactctaagaaactcagcttaaaaagtgataaaaatatacactttaggccaggcgcgatggctcatgcctgtaatcccagcactttgggaggtcgaggcgggtggatcacgaggttaggagatcgagaccatcctggctaacacggtgaaaccccatctctgctaaaaatacaaaaattagccaggcgtggtggctggtgcctatagtcccagctacttgggaggctgagacaggagaatggcatgaacccgggaggcggagtttgcagtgagcctagatagcaccaaagcactccagcctgggctatagagcgagactccgtctcaaaaaaaaaaaaaaaatatacactttaatgaaaattagaaaatttattcctcaagtatccctggatgaagcttaaggatttgcaggtcaaaatatattatttttgaaaaaggagatttttgtaaattcattgagattctgatttagcaatctgtggggtgacctgcagatgtgtaagttttcacagctgattaggtgacagagttgggaagaactattttatggtatcatatgaatagtgttccagctaaatcacctcgttgcttcttgcgttcccctgtgcattgagcagttttatgtaaatggttgtattttgcacaaataaaaaactatgctttaattttggagtttttaattttttttataatagaaagagaggtaagcaccattagacttagggaacttcaagattctggcaagatattccctaaggatcttctatttgttgaaacaaaaaaagaagaagaaagacaaacttgaatgacttacttgtgtcatttgaaaattatatgatctactctctgagctggtttcctctgtatactctgttacttcagccaagggcatttagtcctttggggatgttggaagagccatccgtgcagtaattgaaatatttttaaatctcattaaaatatatgtggctaatttacataacagccttaacacacatattttattcatatattttctgctactcagagtgtagtctgggttttatcagcatcaacatcacctgagatctatttaaaatggagactctcaagctcactacaatccttctgattcataatctgcattttaacaatattcctaggtgattcccatgtacggtaacatttaagaagttctgtaatagaatatgttggaagaaatctgtctcctcatcactgaaccagtctcaggagactctcacttgtattctaaattctgttttagtctagttttggatttagaatactttcagccaaaacaatttatttctatattctctgaagatctgttattcaaaatgctcacaaagaaatcagctccttaattttcataaacattttttggtacttgctctatgcaaggcatttaatcttcataaatatgcaatttttcatttatgaaaatgtgtccaaattaacaaggctaggagatggctgagtcagggtgtggatccgggtagcatggttcgcaaatcggtaaccactcaaagttcaagggaggaagctatttgatgttggaagtaacattcaaattatcaaatctttgtaatgatggtttaataggtggagatacctgtttgttcctaagccgaggataaaagtaactcctgatatttacctgagacatatcatatactcttatctagtcacatttgtctatttcacaagagtgtaatgaagctgaattaacgtgttttgtaagaataacttgaataatttgaaaacatcgttctttctaaacaattatctaggaatagccatgatggctcacagatgactgaactttacagccagacaatacaatagaggagaaaagaacggtttatatagatatgaactgaagtctcatgcttgcataatcacgttccctattgatgaaaaactacaaagtcacggactgtgtttcttactttagctaaatgtagggcagtcggggaaattgcttcatcttttttcctcttctctgtcctcccttatttttttacataggatgccctggaaatggcaataaatatttcagtttgatacattatatttcctatggtagggtaaagattagcaacatgtaaatgaatatttttttacctacccgaattagactgcagactaaggaccaaaaagcgaaatatttcccatgtctcctctgactctggatgaaaatcctgttttctaggttaggaaactgtaaagattcaagccttatctatgagagaacagaaacaacttacttaaatgtctgcagttcaagaaaagtttaaaaggttgtgactgaaagaactgaaagaaaattaagtgtattcactgattatcaagttaaaactgtttttttataatgagaagaagagcttgtgatgagagtgaagaatattgtaaaatcaaatttgaaaagcttattgaaggaaatttatgtccactgtcataagtaatttttgttattttgcctttcagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactc

SEQ ID NO: 17245 - DNA, 16083 bp, Human
cgagaccagcctggccaacatagtgaaaccccgtctctactaaaaaaaatacaaaaattggctgggcacagtggctcacacctgtaatcccagcactttgggagactgaggcgggcggatcacaaggtcaggagtttgagaccagcctggccaacatggtgaaatcccatctctactaaaaatacaaaaattagccaggtgtggttggcaggtgcctgtaatcccagctactcaggaggctgaggaagaagaattacttgaacccaagaggcagaggtttcggtgagccaaggtcgcgccattgcacttcagcctgggtgacagagcaagacgccatctcaaagtaaataaataaatacatacatacatacatacaaaaagtagccgggtgtggtggtgcatgcctgtagtcccagctactcaggaggctgaggcaggagaattgcttaaacatggaggacagaggttgcagtgagctgagattatgccactgcactccagtctgggcaacagagtaagactctgtctcaaaaaaaaaaaaaaaaaaaaaaaaaggagtttgaggctgcagtaaactaagatggcaccactgcacttcacacctcactctagcctgggtgacagagcgagaccttgtctctaaaaaaaaaaacaaaaaacgaaaaaccaaaaaaaaaaagggtgggggtggaatagaataaacaactctgagaagggacatgatctggtgacaatctcaagtgaatcagtggttgaaccaggaccagatcccagtgccccatcttctggggacgtcctgggtctgaatcttcaatgcatgtcccttctgcagtgccttcctctgtggccctcaaagggaaactgaagcctttgaggacatgaagactcgcattaggccaacgaggggtcttggaactccagatcaaagagaataagaaagacctgactctgtgtgtgtgtacgtgtgtgtgtacgtgtgtgtgtgtgtgtgtggcagaggggggtgtggtcatggggtattgacatgaatacgcaaggggcaggaagcatctgaaatcagagctaacttgggaggcacagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgagtagtggcccctagggacagagcctgattggggggtggagtggaggagatcactaggctggtggagacttgaggaagcaagaaagcccttggtcccctgtggaagcctctggtcccccgtgggagtcctagtctagaacacagttctggacaccagactcaatctcactgggtggagtccttcacacccctaagcggtctacctttcctttgtctgaagtccgtggatcaaagcccctggagctttctgggctgccggagaaggtgaggggtccagccaaggggcagacatgtggcctcagcttgcccttcttagagcctagggtctctctgcattctctgtggcaggagatctgcctctgggcatctgtcctcacatgagaggacagtaattctgaagctgccatgtcccacacatctggaatgtttgtttgagaggtggaggtgatggacccaagatgggggccagggaccttagtttctccacttttccgggaggaggagggaaaggatcaggcggctttaactctgggccaccagaaagaggcaggacactcaccatgcttcatgggcccccacaggtgacaagggtccccaaaggctaagcgggtccagctatggttccatctccagcccgaccagcccgaccagcccagggccacagcaagcacctcccagagagacctacctgagtgagaagatccccatcccagacacaaaaccggtgggatgctggaaacttcctgggggcttgcaagattgacaggatcctgaaggatcccatgggctggagaatggggtctccttatgatcatgggtggcaagtcccttccaggtctgagcagcagtggtggacagtggcaactgccccttcctgcttccgtccccagtgcttagctggggtgcttcagtatttgtctaaaagcgattaaatgactttctcaatgaatctcagctttcctatgaaggaaaagaggcccagggggaattgggattggagccttgaggacatgttatagcatttaggaaagggcatagggagaagtgaaggaggctgcaggctggcatctagcatctaggatgctgtcacctgcatttccagtatcttctctttttttggagatggagtctcgctctgtagcccaggctggagtgcagtggcgcgatctcagctcactgcaacctccgcttcccaagtttaagcgattctcctgccccggcctcccgagtagctgggattacaggcatgcaccaccatgccaggctaatttttgtatttttactagagacagggtttcaccatgttggccaggctggtctcaaactccttagctcaagtgatccacccacctcggccttccaaagtgctgggattacagacacgagccaacgctcccagcctccaatatcttcagcagatttctaagtcaatatgccatgctctggaacagggtggggggaccatagcctcagcggaccacagagaggaggccccgtggtctgaaaaggagctggcaagggaggagctgggctagggaagcttggccccctcacccccttagacagccccctgtgaggtctctgaggacctgacaagtcagggcttgaggggcaggcagttcaggtgcaagccggctgctgagcttaacagatccagaaaaagatcctctgtgactcatcagagcatgctgcttcctccacccatgccctccccatcccttgggtggcagacccaggaatgggccatggagggcagggctgggctgatgagcctgttggggctcctctaggggatggccaaggccagctgccaccatccctatacccaggaccccctcactctactcctcccaccccccaacagggcaccttcagcctgcggaagctatgggccttcacggggcctggcttcctcatgagcattgctttcctggacccaggaaacatcgagtcagatcttcaggctggcgccgtggcgggattcaaagtaactaagtcgggacctgagtggggacactttcgagagggaggtgaccaggctaagtgttgaaggcccctgctggccatgtttctccaatgtggcctgggagctggtgttaagttcaaatgggcccgaaaagggtccccagggcagccctgccagaaggtggggcatttgtgtggggggtaggggactggactcctctctttaaaatatatatatgtatatttatttatttatttatttaattttattttttgagactcagtctcactcggtcacccaggctggagtgcagtggcacaatctcggctcactgcaacctctgcctcccgggttcaagtgattctcctgcctcagcctcctgagtagtgcatgccaccacgcctggctaatttttgtatttttagtagagatggggtttcactgtgtgggccaggctggtcttgaactcctgacctcaagtgatccaccgcctcggcctcccaaagtgctgggataacaggtgtgagccaccttgcctggcgtaatttatttatttatttagagatgggggtctcactatgttgctcaggctgctcttgaactcctggactcaagcaatcctcccaccttagccttttaaagtgctgggattacagggtgagctaccagcgcccagccaggatgggactccatctctcccaccccctccccgaggagtatgcttggttagagggtaccacgagctcaggggctttctgaggctggcctctctggctgaaggcctctccctgcctcctcacagcttctctgggtgctgctctgggccaccgtgttgggcttgctctgccagcgactggctgcacgtctgggcgtggtgacaggcaaggacttgggcgaggtctgccatctctactaccctaaggtgagcttggggggcctggacagggagaaccactggccccaaaccccaaacagccattttcagcttccacgatcaaataaatacatcatctcacatggggcatcccaagtctgtttgtttttgttgttgtttgtttgtttttcagtcggagtctcgctccgtcgcccagtcaggagtgcaatggtgcgatgtcagctcactgcaacctctacctcccaggtacaagtgattctcctgactcagcctctcaagtagctgggattacaggcgcccaccaccatcatcggctaatttttgtatttttagtagagctggggtttcaccatgttggccaggctggtctcaaactcctgacctcagatgatccacccacctcagtctcccaaagtgctgggattacaggcatgagccactgcatccggccccaattccatttgatagatggaaagactgaggctcaaactgatagcacatagcctagagggacatgagaggcatgtcatttcacagaaggggtaattaaaatttgggaaagagacttgcccaagacaaaaaatggggaggcatcagctcaggaatggtcactggttggggtggaccctggggacttcgttgttgtgagtgtccagtttggaaaacagaaattacagcactggacatttcaaaggtattgaatgcagggattgaaaggtttgggagggcttgaggggcaagggaagagggtgttacaaaaagatcagaaagctgctacacctctggcacaagccccagagccatcctttgctgctgagctcctggaagcattattgatgctgatgaaatggccactagtgctgccagagtccgggttgcctggtgccactgccagaaatacaagaagcagggggagaaaatggtttatctcagcctggggcggtggctcacgcctgtaatcccagcactttgggaggccaaggcgggtggatcacctgaggtcgggagttcgagaccagcctgaccaacatggagaaaccccgtctctactaaaaatacaaaactagccgggcatggtggcacatgcctgtaatcccagctactcgggaggctgaggcaggagaatcgcttgaacacgggaggcggagattgtggtgagccgagatcatgccattgcactccagcctgggcaacaagagcaaaactctatttcgaaaaaaaaaaaaaaagtttatctctgcctttccatctcctgtatgctcttcctacataaggtaggaagcccattggccagactgtctagtaaatgtagtctgagacgacagacaaatgtagtctgagacgacaggcaaataaccggcccacccttaatgaaggatcatctcctccccataggtgccccgcaccgtcctctggctgaccatcgagctagccattgtgggctccgacatgcaggaagtcatcggcacggccattgcattcaatctgctctcagctggacggtaccaccccagtgtaccccaactcttcaggccaggcagagaacagctgctgctacttccccccctaaccagtccctcccagagtctattttatcctgctgtcccctctgaagcagggctgctgccctgttttccagaaatgtaaagtgacttgtctaaagtcacacagatgtgagtcatgcaggactttgggactgcagccccaaactccctgctgcgccgggtgccaggtctctcctctagctctgccctgcctcgactgttctatgccacactcccactccccttgccctagctgtctgggggcgcttagggtcctgctcccaggaggccagattcctgtctccagccctgaggctccgtaggagttagagacccctggaccaggctgggctgacccgggccactctggtttcagaatcccactctggggtggcgtcctcatcaccatcgtggacaccttcttcttcctcttcctcgataactacggtgggtgcacaccccacctcataggggagtggtggtggtgagggtgctgtactgggagaagggctctgacatcgaacagcctgggagcgcacctgagctccctcactctccctgggtggcctctagcgagttacttggacgtgcctctcttcacctgtaacatggggaaataatagcacagacttcagagggtggttgtgaagactgagtgaggtaacatatgttaagcacttggcactgtgcctagaagcgctcgtagtattagccattacgaattgttgatgtcacagatttttttcgttggtttgtttagtttgtttgttctgctccgtagggctgcggaagctggaagctttttttggactccttataaccattatggccttgacctttggctatgaggtaggaagccagtgctgcaactccactgtggacctcccaagatcattcctctcccttccctctggccgcgggctgcggggggctggggtgggatggaggctgagaaatggtgaccgcggcgtggttgcgaggggcggggcttgtcctgaccaggctcctccctgcagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaaggtgagcagaggggaggggaaaggagaccccctcactcagtcggagccatgctggctccgcctccaagcctggagcccctcccctctggctccttccctcaggatttgcggagcctgtaataattgagggacaggcggggcgccatggctcacgcctgtaatcccagcactttgggaggcggaggcgggcggatcacgaggtcaagagatcgacaccatcctggtcaacatggcgaaaccccgtctctactaaaaatacaaaaactagctgggcgtggtggcgcgcgcctgtagtcccagcggctcgggaggctgaggcaggagaatcgcttgaacccgggaggcagaggttgcggtgagccgagatcttgccactgcaccactccagcctggcgacagagcgagactctgtctcaaaaaaaaaaaaaaaagaaaagaaaaagtgtctactgtgcgctgggaggaacagaccgtcaaggcctctgcccttctagagtttccgtgctagtggggtagacggatgacaagcaagtaaaccaacaaaggaaagaattataggccgggcgcagtggctcacgcctgtaatcccagcacttcaggaggccgaggcgggcgggcggatcacgaggtcaggagtttgagacctcaacagcctggccaacatggtgaaatcccgtctgtactaaaaatacagaaaattagccggaagtggtggcgcgtgcctgtaatcccagctactcgggaggctgaggcaggagaatcgcttgaagccagtaggcggaagttgcagtgaggggagatggtgacattgcactccagcctgagtgacaaagcaagactccgtctcaaaaaaagaaaaagaacaagaactatagagctgggcgaggtggctcacgcctgtaatcccggcacttcaggaggcagaggcaggtggatcgcttgagcccaggagttcgagaccaccctgggcaacatgataaaaccctgtctctaccaacaaaaaataaaaaataaaataaattagttgggtgttgtgcacacctgtagtcctagttactcaggaggttgaggcttgagccctggaggtcgaggctgcagtgagctgagatcccaccactgcactctcagtgacacagtgagaccctgtcaaaataataataataataataataataattgcgaaagggactctgaagtaaacaaaacagagaaatatgatagagaatgactgaaagttggggaagtagatcagggaaaagatattacaagcggagggaaagcaagtgcaaaggccactggcagaagtgaacaaggcttgggtccctaacagcttaacagtggctcacacctgtaatctcagcattttaagaggccaagacaggagaatgcttgagcccaggagttcaaggctagcctagcaagaccctgtctctgcagaaaatttaaaaattagcgggttgtagtggtgtgtgtctgtggtcccagctacttaggaggctggggcaggaggatcacttgggcccatgagttggaggctgcagtgagccatgcattgcaccacggcactccagtctgggtgacagaacaaaacctgtctctaaaaaataaaataaagtaagctggacacgtctgaggatggaacaaggtgagtgaaggagcgtgtcaggacctgaggtagccagggacctcaaaggccagccttgcttcacccacacagtggcttacagtggtaaggcctctgtggcaagaacagagatgtaggaaaccatcggctgacctgaacctgccccagactgccacgcaggggacttaagaaggtactgggctttggggagaacatagaagtgtgagggtgggggacactgtggtggctctgagggactttggcacttccctctccctttgatcttcgtagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcggtgagacacactttcccccgcacctgaggccacacacgtactcatgtcctgtaagccttgccgaggaccctaggcaatgcagctgagcccttctgagtctctgccctgatgatcttccctgttggcagatatcattcattcagcaaataatcattgagcatttgttatataccaagcacatcctagaccctggggatacagcagtcaatgctacaaagacccagctctctgcagcttaaatagggagggaggtgagcagacaggaatgaatacccaagggaagtacagagtgggaagaaataaagggggtgaagaagcatagttgggggtatgggggtggggtctgcattagcccaggtggtcaggaaaggcttcttggaagagatgacatttgtgctaatactggaaaaggaactagccagctcctccctgactctctgggatctgggacctgtgtctgtctccccttctgagtggatctcagtcatgaggctctaacaactgcagccagggttgggggcttcctgaatgctgagccctgtgggagaaggggtggccaggcctccaaggacctgggcactgccactgccttgctctgtgaccttgggaggtcacactcctccctgggtctcactctgttccttggcacaaggagggagatcaacatcaggactgcaaacccttgtcttcaagaccaggcaggcgcagagttgtgggaagtggacagtgtgaagagggcatggcagccagctgtctctgtggtgatgccagctcttacgaacctaaaagaagctggaaactgggttcttatgccaggccttctcaattttaaatgttggcaacaaatccacattaaagaaaaaaaaaacccggccgggtgcggtggctcacgcctgtaatcccagcactttgggaggctgaggcagatggctcgcttgagcccgggagttcaagaccaacctgggcaacatgacaagacccccatcgctacaaaacgtaaaagtaaaacaaaacaaaacccaacttattttgttagccaaacaaaatatgtctggccagattcagccttgggccaccagttttggaaccctggtcagtgctaggcagtccagtttcccaaggctgagcgtgctcctcacatcttccttctactgccctggtacccacagttcaacatctgtgccaacagcagcctccacgactacgccaagatcttccccatgaacaacgccaccgtggccgtggacatttaccagggggtgagcgcgggtgggtggggagggcgtgacccagagaggctccccgcctcgggcagggccaccggtcctaccacactcgtccctgcagggcgtgatcctgggctgcctgttcggccccgcggccctctacatctgggccataggtctcctggcggctgggcagagctccaccatgacgggcacctacgcgggacagttcgtgatggaggtagggcagggggcgggcccaggagggcaaggggtccaaggacagcaggcacactactgggggctagaactccgagccttgtgggtcctcttttcttttctttcttttcttcctttttttttgtttttgtttttgttgttgttgttgagacggagtctcgctcttgtcgcccaggctggagtgcagtggcgcgatctcggctcactgcaacctccccctcccaggttcaagcttctcctgcttcagcctcctcagtagctgggatttcaggcacctgccaccaggcctggctaatttttgtacttttagtagagacagggtttcgccatgttggccaggctagtcttgaactcttgacctcaagtgatccgcctgccttggcctcccaaagtgctggaattacaggtgtgaaccaccgcacccggccaatttttgtatttttagtagagacgcagttttgctgtgttggccaggctggtctcaaactcttgacctcgtgatccgcccgccttggactcctgaagtgctgggattataggcgtgagccactgcgtccggccttttcttttctttctttctttccttttttttgagacggcgtttcgctcttattgcccaggctggagtgcaatggcgcgatctccggctcaccgcaacctccacctcctgggttcaagcaattctcctgcctcagcctcctgaccagctgggattacaggccaccacacccagctaattttgtattttcagtaaagacggggtttctccatgttggtcagggtggtctcgaactcccagcctcaggtgatctgccctcctcagcctcccaaagtgctgggattacaggcgtgagccaccgcgcccggctctttctttcttttttgagacaggatttcactctgttgctcaggctggagtgcaatggcgccatcacagctcgctgcagcctcaacttcagcctcccgagtcattgggactacaggctcatgccaccacaccaggctaatttttaaaattatttgtagagatgtggtcttcctatgtttcccaggctggtctcgaactcctgggctcaagtgatcttcccgccttggcttcccaaagtgctgggattacagacgtgagccaccccactcagctttgtttccttcatgtagcccagagggcgacactataagccccattttacagatgagaaaacagatcctgacagatgaggtgacttgctggaagctgcagacccaggactaacagaagccttttccccaaaactgtttagtcttcagcaaccagctatgggatgggagctccccatttctccccacccatcccctcttgccacctagggacagagctgtcccagttcaacagtggaaaaacagagcatgcccccagggataaatcggttgagggactacagaggatctctcctctggaatccccagtcctgtctactcctcaccaaggagctcacccccaccccagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctggtgagatgcgccaaccccaccagccctgcccactgctgagcgaaacaggacctccagcaacccccacgctgagccttgcatgggcctgccaggccctgtcccaggcacatcttgcctacaaggcttccattgtccccacagccaccctggggggcaggagggtaggaatcaccattatccttcccccctcccaccccccagatggtctccctctgtcacctaggctggagtgcagtggttcaatcatggctcactgcagcctgccctccctgtctctagcaatcttcccacctcaggctcccgagtagcagggactataggtgcatgccatcacacccagctaattttttttttttttttttgagacggagtttcactcttgttacccaggctagagtgcagtggtgagatcttggctcactgcaacctctgcctcccaggttcaagcgattcttctgcctcagcctcctaagtagctgagattacaagcgcccaccatcacacccagctaattttttgtatttttagtagagacagggtttcatcatgttggccaggctagtctcaaactcctgacctcaggtgatccacccgccttggcctcccaaagtgcaaggattacaggcatgagccactgaggcaggtctaatttttttttttttttaagtagagacaaaagctcattatgtttgttgcccaggctcattattccattttacagatgggaaaactgatgcactcagttaagttactagtggcagggcttggattcaaaccgaagcaacctggtgccagagcccccaaacactttctcctgctttggagcccacaacctgataaggcaggagacggggaagtaggctcagtgtggttagggcagttgagctcacacccacacagagggtgtcaagccacgcccatcttgcccccacccttgccatattctgaggcagaattcctcagcctaggctcctgctgctctccccagctcccgttcgccgtgctgcccatcctcacgttcaccagcatgcccaccctcatgcaggagtttgccaatggcctgtgagtaccccctttcccaagtgctggattgcatcaccacatttcatcctcacagccacccagaggtacgagctacaattctccccattatcccaatgaagccacagaggctgagagaggttaagggacttacccaggttcacacagctagcaagttgaggagccaagactggaatccagggaagagggctgtttctagagcctgagcgcctcactctcgcctcagactcagctcttgccaaatcccgccagtgtgtagcctggagggcccaggaggcaggaggtggggagggggtctgtctgctccaggtcccacagaccagagaagcggcctcagtgtatccccacccccagtgtgggcgctgggagatgaagaggagttgatgcaggtgggccagcagcaaccagccagtcctgagcctctctcgtgtcccccaggctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtacagtagggccaggggatgccttgggaatggatgagggaaggacaagaggcaaccaatggggagggtttggggggacacaatggggcttccccagaggtcttggcatctccccaattcatggttgcccctcccccaggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcatctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtgaagggcgctgcccgtgacgccagccagggaaggggactgaatcttgctgaagggggggtcggcggtaggggggagtgttga

SEQ ID NO: 17246 - DNA, 40575 bp, Human
  misc_feature (1)...(40575): n = A,T,C or G
aggagtttgagaccagcctgcccaatacggccaaaccccgtctctacaaaatatacagaaattagcccagcttggtggtgcatgtctatagtcccagctatttggcaggccgaggcaggaggatcacctgagctcgggaggcgggcagtgagcagagatagcaacgtcactccagcttgggtgacaagagtgagacaccatctcaaattaaaaaaaaaaaaaaaaaaaaaaaaaaaaaaaaaaaaaaaaaggccgggcatggtggctcacgcctgtaatcccagcactttgggaggtcgaggcaggaggatcatgatgtcaggagttcgagaccagcctgaccaacatagtgaaaccccgtctctactaaaaatacaaaacattaaaagggcgtggtggcaggcacctttaatcccagctatttgggaggctgaggcaggagaatcgcttgaaccggggaggcagaggttgcagtgagccgagatcatgccattgcactccagcctgggcaagagtgcaagactctgtctcaaaaaaaaaaaaatttaagttagcgtataattttaggggatcagcaatatcctgaagcttatccatagcccgttaagtaatgtttcaaagggctatctgtgccttaatgataggagctagtttcttgttcatttttttatccccatccccaaacacatagcagaaaataaattatttccttgtatgtagaacggactcagctaagtttattatattctccccggaggagggaaaacacaaaacaaggcacaaaggcagaaggtgcagatgtagcacaacgatgagttaagattccgcacgcaggtaacaaggagggtatggtatatctctgccagaggtactggaaggtttcaaaggcagaaaaaaatgtgttccggacacctggacgcagaattggaggcatgacaggaacacagggaggcccatctaagttgcctattcacccaggtgacctctctttcatttctttaattgtccttttaacaatatggggaatttcacccaaggaaagggtcctcttctcgccccagcaggcaaggggtgttcctccagcgcaagttccggccccagctgcccccacgtcccacaggtctcctgccttttggcacgcacactcctgaccactcgctgcttccgcatccctactctgatcctctccccatgcatctctgcctccttagacaactgagaattttattgtctgtttcctttgccagactgtaagttccacgagggcagggcctcgtccatttcatttaccactacatccccagtatagagcaagagcccatgaaaatgtttgttggagaaatgaatgcatgatggtgtcgctggacagctatacctggaaagaaaaagaggcacccccatcaaacaagctgggagctaagaagcccgctgggagacgacaagggcgagcttcttgcgaggtttctgaaatgacaagaccggaagaatggagttggatctctgggacaagcgggagagagaagctgaacagtcaggcaagcctcggggaatgacagctccgcgggggacgcactggtaggcggtagacgtaagcggggtcggtgggaaagtagacggtggggcggcggcatcacacatacgcaagcgcagcctccgtttcctccggcgcgcctgcgctcgcgttcacgagtggttgaagcggaaatggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccaggtcggttgggtgggtgggtgtctccacagtctgcgtgcgtgggccagcgcgttcgtcttacccttccctccaccccggcccctctccccttctcccctaacctcctaccccacccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccgggtgagcgcgcgcccggggccgggggtggcgggggaagcagagttgaccccagctaatccccagtgttgtccagtcccccagacctggaggagagaaatggggtgcctggcagggtgtaggggctgccccagcggggtagacgtgggaggcgattgggcgcggccgggcgaggggcagagatgcgtggggagaggctcagaggagggatgcggaagcagcgagtggtgagggctgtgcgtgccaaagggcaggagacctgtgggacgtgggggaccctggagccggaactcgcgccggagtagccccctgccctctggggcgagaaggggaccccttccctgcgtgaaattccccggcattgttctgaacccagagagagcctgtttggaattgggttggaaggagttttcaggaattcccaggactggaggagggaaggagatgcaggcccacatcgccaccagcattctcgttccccacccccatctcctttaaaaggagcagaagagaagactaaaagccgacccagtcttagagccggaaaaacgcgatctctggtttcccttccccgaacccttctgtgagagacactgggccattttgttacatatttttaaagcaaagccaattgtccctcgctccacaccccttccttatctctcctttgaggttctaatgctctctcctcacccactagcctttatctggttatcttgtaaattcttacatcaagaccctaggtctgtgatttcttctgtggtagccctggcccagttacacacttcaaagactccagaatctataaagttcttagataacctgtctttacgattggactttttaaaagatgggcttagggcatctttccaaggcagcctctctgccaaacacaagaatcagtagaagacaatctgctcctccaaagctgctttgcttttctagtataatatttaaaacatgagctaaggattttgggttctaatttttggtggcctgtggccagtccctttgcctcatttccctatgtatgagcatggggcttcacatctgtgtttcacagttaataagtgcagaccgtttctggtgaactgggaactagtaataggaaagtgcttgcagatccacagatgggagaagattggtagaggggaatttttaagtggtcataatgtacttgtggcttggaggcattagaaagtattaactgccatttaaattgaatatatagtatgtcctgtctcctttataaggccacagattttatctgtaaaacaaagcactactttccttgaagtaatacgtgtagtgagcagtactgtttcctgccaggggctgcagttggttatatttgaggctgacttgcttctttcttgtcttagcctctcttaccagtttctttgcattttaaatattcaaatgaatcagcccagagtcttattttgggtgattgctgtatacttttttctgagcagtgtaacacataggaggaagttgaattaacttctgcattttcataactgatcttaatgcattctcaggtccagactagcaaagaatgagacctgggcggttataagctgatctacaagataaatggctgtgtattttcaagtagaggcatgtcttttaacataggagtacattctcatctatttgtgtattaatgacttgtgattccaaaatgtggcccattattcggaacttcagttctttctttttcttttagaaaattattcttaaaaagagaagctaaccatttcggagggattaaataggccctcaagtctggaagacataagttagaacttccaggacttttttttttttttccgagacagagtctctcactggctggaatgcagtggcgcgatctctgctcactgcaacctcgccctcccaggctcaagtgagtctcatgtctcggcttcccaagtagctgggattacaagcacgtgctaccacacctggctaatatttgtatttttagtagagatggggtttcaccatgttggccaggctggtctcaaactcctggcctcaagtgacccgcccgcctcggcctcccaaagtgctgggattacagcactgctcctttcctcaggacattttttacaaagatatgcattgtagggaagctgtatagggggtgcactggtgtgtatgcttgtgcacatgtgcgggtgtatgtgtgtataaatctaggcttttattctggcccatctccccctttgagatgtggttttcaataagcaggctcaaaacattctgctgaaaatttgaaactttgaaaatctttaaaaaaaaagagaccatgatattgtgcctggtaggcagggctctcctgggattacagatgtatcacccagtagaagcccgaatgaagcaaatgtaaattatcagacattccagtaaggtaaggcaaggtgcatgcctattccagaacttacagcagagtttgcctagtgtggttatcataaacatgtatgggattctaccagtgctcagcccaggcagcaacagaaaaaaaggggcctctctgagagcctattagccaagttagggaggtgctaaggggtgaaaggtgttggggtggagatcagagaaagacattaaagggagtagtttggaggagaaaccctggagatttgaaaggctttgctggtgtgggaacctgctaggagaggtcagctccaccctactttttgcacttctcagaataaaccgatgggggaaattacagttcggagcagccttttccagagtgcatcttccatctctgtgatgtccaataagatagccatacaaagtggctggctaaatttaagtaaaaattaagttgaaataaaattgagttcctcggtcacactagccacatttctggtgctcatttgccacatgtggctggtagctgttgtatttagcacagacatggaacatttccattattgcaaagttctattagcactgttccagcttctgaaaatgaaagcatgagatggtcttaaaaatagttctgtggcatatacttcagaatatagttgcattaattttccgtttgaagttgattttttttttttttaatgattcctctcagatcatcctgctggatcttctcaccagtggcctcctactaaaagtatcagctttcttttgggtaaagcagtgttgtcatctaaactgtttaagaatacatttgatcatgataaccttttaatttggaggcagtttgacaaagcctaaggttcattccaaacagattgctttttaattttttcctacacacttctgggaagtggcttattgaaacaactcatagattgtcacaaaataataattattggtaaattgtcttcccagcagcccacaaactaagagaatgtgactgacttaaaagctatgcccaacactgcaaataacctcatgcacaggtctgatcaacagcattgccttttcatttggaaattcttacccagaccctcaaagcaaaagtaatcagacaaattaatttaattctttcgttagtgtacacaccaagaaccgtttcataactgagaagctaggcctgtcaacttagctggagtctggagtccaaaattgaggaaattctgtcagatgcaaattgctgttggatttaagtgtgtgctggctccgtgccacagccagtgcatattgcggggagctgtggttccatgggggggagtgaaactcagtaagcaagcagtgccagttggggtgggcgaggatgatgggaagagaaatttgaaaaaggaataaattaaatcttgctgatactctgttctcattcccaaatatattgcatatgtcctcagagagacaggctgtttggagtgatttggaattaggacattgtttaagcatttagaagaaatggaatgttgtgtccaactcagtaagaagacctggttggtctttttacaggtcactgtagttaattacacactgccacctgtcctgtggcctacttgggaccactttggtcctgaagccccagagctgtgctggaccaaactgataactccttaagagctgggtctatcactttaatcatctttgtttccccagcatcctcattgtgtatatagtcaactcagtaaattggtttattgaagaaattaatgaagccagatagaatgattccttgtttctttaggagctgacatttttgtgacattgagtaaatcagcttttaggtctctgttctccatattttgatatatggcttagtggagaataggaccacctcttacctaatatgatctatttttttaggctttgctcaaaaagaatgatgggagctttatagaagatttaaaggagaatgctcagaaacctttatagtgagcagaattcagtaattcctctaattcaggacataagaagggataagtaggagagagacataaatgcccaaatggggaattggggccaggcaccctggctcacgcctgtaatcccagcactttgggaggccaaggagggcggatcacttgaggtcaggagtttgagaccagcctggccaacatgacaaaacatatgtctactaaaaatacaaaaattagccaggtgtggtggcgcacacctgtaatcccagctactcaggaagctgaggctggagaatcacttgaacccaggaggcggaggttgcagtgagcagaggtggcaccactgcactccagcctgggtgacagagcgagaccccatctcaagaaaaaagaaaaaaatggggaattggatcctagggtgcattcaggagtaaaaaccccaaagttgttaatgagaaaagaagttgagataatacagttgccagaagccctttctggattgattattgacattctagaagcttccttagagaaaagatagaagaaaattttttctaaagggttttaagaatagctcttaaaacctgtctgaatgaattgattatgttttagtgtcttgggttgtccaggcagtaactctgaggacttacccagccggcttgttctaggattccagacattacagcagtctgacacttataggagttctgtttttccttgtactgctaaccaattcctgattcagggaattaccgcaatcctaaaacctctcccaaccacagcttcagagtctgatctctgactccacctaggagaagaactaatttattgattaccttctatgagctaggcactgtgctatatgccttaacatggtttcatttcatttctgtgacagatagtggatctcatttacaactgagaaaaccagggctcttgaggattgggggtgggggtagatattgaataagtaactactacatattaagtaagcaccgtgcaggcatccttcactgtgattcttgaccttgtttatcgtatggcacacagaacatgattgtatttgtatggcacatttgggtaaatggtctagcctctcagagatcctgccacctgctgcctgccctaagggatatggggatcattacctcagcatatctataacttaaaagacaccgtttgagaaactttgctgtacagtagtccccccttatctgtggttttgctttctgcagtttcagttacctgcagtgagcagtgaaccatggtctgaaaatattaaatggaaaatcccagaaataaacaatccattaattttaaattgtgcaccattctgagtagcataatgaaatcttgcgctgtcccgcccaggacatgaatcatctttttgtctagcatatctacagtgtgtacgctaccctctgttagtcgcttaatagctgtctaggttatcagattgactgtcacagcattgtagtgcttgtgttcaagttacccttattttacttaataatggctccaaagtacaggagtaatgatgctggcaatttggatatgccaaagagaacccatgaagtgattcctttaagtaaaaaaagtgaccttggtgtttctttgctacagttcagtgctatccacacttttatttatccactgggtgtcttggaacatatcccccacagataaggggagactgctgtactgctggacatatatcatctcagtcttcacaccaacctgggaggtagatgttttgtccccattttgtagaagaggaacctgaggcccggtgacatttgaggagcattgcctgtggtcacatagccaataaattctgaattctaaataacttgctttttctcacccccagcatctgaaattttagcagctggtagaacagtaaataatgtaactattaattctgggggcctatttagtggaacacttttcctgggccagtcttcctcccgctcctttgtaattttaaaccacagaagtaaaataacaaacgccaggtcttggaattgagaagcaatcttgtgatggtatacttcacgctcagcaaactcatcgttaaggcactgagttctcggacctctaactcccagaagacttcccatgaagtctcctttggcctaatactctcctcagcagccattctctctcttctagccataaatagtaaactaaaatattaatgaatgtgatttgacaaatattgctaagtcagacagcagaccacttaagatcgatcgtagcaacttttcccacaaggatctgtgctcaggatactttatgcctagagaaatttgaaattagagactcaaagtgtgtatgacttggagcccaaaggttatttatttatagttggtttttctcaggtcttttgacaaagtaggagagtgaggaactcagcccttctttggctgaattaaaacctaaaggttaaaaaaaaacttactaagtgatgtaataatgggcttttataaactccctgactcttcagcacagtcagccttccccaggaaagtatgcttccatgcttcctcccattggtcatcctcttaatatttcattcagttggtccatgattaacatttccatatttttgttctttgctcttgttttctagaggtgaggaatggtattggactcgttgcctttgtttcctggctacagtttcaaaatgaaggctcagaagcaatttaaattttcatctagttttttccttctattctgaactctctgcttctccgtaaacccacttgatacttcaattcgtagagatacccagtgcgcttttcctaagtcacatatagagggctttgaagaagcaaggtgaagctttgtatgattcgtataggttgatttttcagcagggctagcatgcttcatagaagccagtttttttgaaaggtattgtctggcttctatatcagctttttaacactcataaaccatgttatatattccattatttcccagcatccctggagagcaacttagtcttggtttctttcgcaggtaatggagcagagatcgtggaaagatacgtacttgattaagaggtcttgagcaagttagacaaaaataaatgtgaaaacatgcgcatcttgtttgctagcccctaaaacaaagtggaatcattgagtttacaggtagctagctggtaaggcaatagtcttcatttgcttcctactttggacttcaggtctgttcttgtgttatatgtagtagttccatgaggtaaataggttcatttttattcccccattttattgatgataggggagaatgcaaaggtgtaagggtatttgtcccaaaacatgagcgtgatgagaaagctaaagttgtaaagcagatgtcctgactattcttagtgatttcatagtgttattttgtgttacactgtctattttaagttccgagctggaatttacaaagcaagacaaaactagggtagaactaaagagggtttcttgaaggtgagtggtaagtactttggtgatgtaaaggaagaaagaaagatgagtaggaaggcttacagacgggttttgaagtggaatagaacttgccgttttgtttatggcccgaaatcatcctttctctttaagcatattaaaaccattctacattatacttagccattttcctgctgaacgttttactcctaataccactgtcctgtggggaaggcattgaccaaaagatggcattttgtggtatatagcatgttgttaggaaattcagaattgaaagcgagcaccaaccaaagcagtagattcaacagcaggtgaaaaacaaaagctatagctgaccttccttttttatctgaccttccttttttatcctctacttaaagcaagtccaaaggttcaggtccatgagaaaatgaattgtgtactctgattggcagtaacctaaaatttatacagaatggtctgatcttaagtgaagctcaggtgcctttccagttccctttgaaggtaagcagcaatacagtcatcttaactgaggaccttttttgttgtttacagaaacaaaccggaagcagtagaagtaacatttgcaggtaagcatctttatctcagccctctgaagagaaggtacaatatgaaaaataggaaataggctgggtgcagtggcacatgcctgtaatcccagcactttgggagtccgaggcaggtggatcacctgatgtcaagagttaaagaacagcctggcaaacatggtgaaaccccctctactaaaaatacaaaaattagccgggcatggtggtgggcacctgtaatcccagctactcggaaggctgaggcaggagaatcacttgaactgggaggcaggagttgctgtgagctgagatcacaccactgcactccagcctgggcgatacagtgagactgtctcaaaaaaaaaaagagagagacaagaaaagaaaattgtacctaaaataagctttgacatggattgggtgcggtagctcatgcatgtaatcccagcactttgggaggccacggcaggcggatcacgacgtcaggagatcgagactatcctggctaacatgatgaaaccctgtctgtactaaaaatacaaaaaattagctgggcatggtggcgggcacctgtagtcccagctactccggaggccgaggcaggagaatggcatgaacccaggaggcggagcttgcagtgagcagacatcgcgccactgcactccagcctgggcgacagtgagactccatctcaaaaaaaaaaaaaaaaaaaaaaagctttgacattttggatactgtccctcatcaggtctttttgagctctttataatagatgaccatttcatgtatttaatccactgatgactgacaatataaagttacctgctgataaattagaagtttggatttaattttgtggtaaaactgaggtttttttgttgtgttttttttttaatttggaaatattacattatcttcaagtagctgtcagtcttagtttgcctagcactagagtagtagggaaacatgaacagctagagatgtgttcatcaagtcagagagagatgttgctgctttctgttccctataaagaattaggtgttggtactatttacttgttaggtgaatgaactcagaggaatacaaccaccctttctacaacaagagtcctcgacaagatgatcttggaagacttttgcagctctgaagtgctgttacctggaggccaggcaccatccctttaccctcctactaactggcattgccagatatcccttcgtgattcccatgacagctccataaagtgatggcactcagcacctaattctagtttcaggaacctattcctagtttcaggaattacacaggctgagtcagtcctgtgtactgcagaaagatagaaccgaaaaagaggggagtcctatagattagaagcaactcaaaagataaccaaatgcaatgtgtggatattgtttgcatcttaattcaaataagacaacaatgcttaaaattttttgagacagtagagaatatttaaatacttgactgaatatttgttttgtttttttgagactgagtctcactctgtcacccaggctggagtgcagtggcgttgataatctgctcactgccgcctccacctccccgagttcaagcgattctcctgcctccgcctctcaagtagctgggactacagatctccaccaccacacccggctaattttttttttttttccagacagcgtcttgctctgtcgcccaggctggagtgcaatggcatgatcttggctcactgcaacctccaccccccgggttcaagcgattctcctgtctcagcctcccaagtagctgggattacaggcatgtgccaccacacccagctaattttttgtaatttttgtagagacagggtttcaccatgttggccaggctggttttgaactcctgacctcaagtgatccacccacctcggcctcccaaagttaacaggctgggttaacaggcttgagccactgtgcccggccttgactgaatatttgatattaagaaattgtttttaaaaatttaggcatgacactagtatcatggttatgttttttaacaaatagtcttctgtatcttccaaagatatattctgagtatttatggatgaaattatgtgttgtatctgggatttgcttcaaaataaatcaatgggaaggaggatgtctaaatgaaacaagaattgtccatgtgttaataattgttgaggctgggcaaggtggttcacgcctgtaatcccagcactttgggaggctgaggtgggcagatcatgaggtcaggagttcgagaccagcctggccaacacagtgaaaccccgtctgtactaaaaatacaaaaattagctgggtgtggtggcacatacctgtagtcccagctactcgggaggctgagacaggagaatctcttgaacctgggaggcagaggttgcagtgagccgagaccacaccattgcactccagcctgggtgacagagtaagactctatctcaaaaaaaaaaaaatcgttgaagcctcatgatggagatgagagttcattatactgttcgttctgcttatatacatgtaaaatccaattatttcagcaccaagctgtgattaaggaaagaatagctttgtaattttaagaaagagcaaagaaacgagtgctcagcaattctatcccagtgtttctgctgatttgtcacatggatttaaaataagttccattttacttacatgcctccttaaaagtggtcttccttgtggcctacggcaaggtaggcgcttggagagattatttcccattcccaaattgttacgcaatcttatttgctttcctcacagatttcgatggggtcctctatcatatttcaaatcctaatggagacaaaacaaaagtgatggtcagtatttctttgaaattctacaaggaacttcaggcacatggtgctgatgaggtaagatccacatcattttccttgggactcttgtttcctcacctttcattggcagtttgccattcatggaagatccatggcactaaatcacccccacatgactacttgctcacctaactaggggctcttgacttgattcctataatgaattgtgtttcctagaaaaggttttgactcttgcttgcttgctttaaaacaatggaaacaaaaatagctttagttctccaaaaacatagcaaagaatacttttccttgatcagtacaaaaatagctgttgcaagaattaggttctgttctatttttgtaatattatcaaggcagatagataacttctagcttgtttaaattttatagtctcaggttctcattctggaggcttaggcacaaatagctgtcttttgaaatttttaattaaagctctttaaagctaccgtctttaaatatctcttctttataactaccataggggaaataagaaagatgtccagacattatgaaacttcggtggccatgccttgttcactggcttctttaaatagttaagtagcaggtttggttcctgttgaactgtatttgctctgaggagagccatttatggaagaaagaaaatgctattacaccagtttgtgcacgctgtggttgggtctcaaagcaggaaatatgactcagttcctgaatcagttttcaaatttcttagttttaacaaactaggttctccttaatctgttaaatgaagatataaccatagctgtttctttctgaaaagtagtagcttttgaattatttaaaacttatataataaaagatgatttgtaaaggaatatggtcaaaagcttgtttaattttttagcataaaaactaaaattagtcttaataccaagagccattggttgcttcccttagttattcaaatgcaattgattttctcataagttcaaagaaagaagaaatatttagaggatttggaatccagattagtttactggaaaaagaaaagcttcagaaagaagacctagtgcttttataaagcttatgaagaattgttttgtaaaagatagtggctgacacttctttaccagataaagagtgaaagaaaacaaatggctattaaagcagccctgcctcttttttttttttgaggtggagtctcactctgttgccccaggctgtactgcagtggcgccagctcagctcactgcaacctccaactcctgggttcaagcagttcatctgcctcagcctcctgagtagctgggattacaggcatgcaccgctacacctggctaattttttgtacttttcatagagatggcgtttcaccacattggccaggctgctctcaaacttctgacctcaggtgatctgcctgcctcgacctcccacagtgctaagattgcaggtgtgagccaccgtgcccagccttttcttttttttttcttttttttttttttttttttttttgacaaggtcttgttctgtcacctaggctggagtgcagtggcacaatcacagccactgcacccctcaacctcccaggctcaagcagtcctctcacctcagcctcctgagtgtctgggactacaggcacgtgccaccacacctggcttattttttgtttgtttgttctttagagagaggaggtttcactatgttgcccaggctagtttcaaactcctgggctcaagcagtcctccttcctgggcctcccaaagtgctgggattatagatgtgagccaccatgtccagctgcatcgctgctttggatcagctataactacctgaaaagaagtgttaaaatatttgaatagactttttttaaattgtgtaatcattctcccctagacagtcttcactaggtgcaagcctgcacagtggcacacacctgtagtgccaactgtgtgttgggacttcacacagttggcttgaggggttcaagtggggagagttgctggagcccaggagttcaagtccagcctggacaacatagtgagattccacctcaaaaaaaggaaaagatctaaatgcaataataataatcctggaaagaaagagttaagctagatttcttaaatctcctttccattctgtgcttttcttacgatggagctccagaacacattgctattcttgtagctaccacaagggtcaaagaaccagccccacccactcaagtgggtggagtaagtaacattcatagtgttggagcagagtgcacagtaaatggctccctgggttggttaaacagtgaccaacccatgataaccacaggaaggttattactttgtcacaggccatttttaaaggtggaatgcctctgctgctagagtgggaaggtaatggtgatgagtgataggttgcctccacccatctcctggtgtcatattgggagagggggtacaaactgaaaagtgaatcatggttaaaagtgcaagtgaagtgacaaggaagtgttggctggttttaccaaggggagggagcaaagcagttgaacatgatataaatttggctctcagtacctcttagatctcagaatattaacttagtaagcttgaaattaaactaaatcttagggacttagggatttaaactaaatccccaccacatctgatttccccttcctcgaaataccaatagtacgtgcaacacagacttgtagctcagaggtcgcatgctgtttcaaattcttgggatatgcatgttacttttttttaaagaagtggtatatcagacacctgaaggtcaagtctctctgtgccaccaacaaactctcgtgaccttgagcccctcctctcaattcctcttcggtaaaagaaatacctcacagtggctgtgcaatcaccaaataggaactacaggtggcattatttatcttttgcccttgtgtaagaaaatgtagtcttgcaggttgaaaatttcttccagctataggaaaatggttaaataaatatgtggaatattaggaaattattgttcagccaggcgtgggggctcattcctgtaatcccagcacttttggaggccaaggcaggagcatcgcttgaggtcaagagttcaagcccagcctgggcaacgtagtgagaccctgtctttgtatataaataaataagtaggccaggcgcagtggctcacgcctgtaatcccagcactttgggaggccaagacaggtggattgcttgaggtcaggatttcgagcccagcctgggcaacatggtgaaaccccatctctactaaaaaatataaaaattagcttggtgtggtggtggacacctgtaatcccagctactagggaggctgaggcaggagaattgcttgaacccaggaggtggaggttgcaatgagccgagatcacgccactgcactccagcctgggtgacagagtgagactccgtctcaaaaaaaaagaattaattaaattaaaataaaatgtttgtttcttaagccatgtcattctggaagcagtttccaccaggtgaagcagtcacggtgacagagaaaaaaatagggagtctcagtctgttttttgttgctataacagaataccacagactgaataatttatgaagaaaatatgttatttgactcatgttctggggactgggaagtccaagagcgtggcaccagcatctggcaagggccttcgtgccctttcccgtcatcctgtagcaaaaggcagaagggcaagagagggccagactcaatttttttttttttttttttttttttgggaaacggagtcttgctctgtcacccgggctggagtgcacccaggctggagtgcagtggcgcgatctcacctcactgcaagctctgcctcccgggttnnnnnnnnnnnnnnnnnnnncatacctagcccagactcacttttttaacagcccctcttgtgaataacaaaccaacttcccctataacaacatgaatccattcatgagggcagagccctcatggcctaatcacctattaccgtcacagtggcaattaaatttcaacatgtagccaggcatggtggctcactcctgtaatcccagtactttgggaggccaaggtagaaggatcacttgagcctagaagttcaaggctgcagtgagctattgtatcaatgcactgtagcctggactacagagtaagaccctgcttccaaaacaataataataatcgtaaattttggctgggtgtggaaaaattagccaggcatggtggtgcatgcctgtagtcctagctactcaggaggctgaggcaggagaatcgcttgaacccaggagatggaggttgcagtgagctgagattgcaccactgcattccagcctggacaacagagtaagactccgtctcaaaaaaaaaaaatcataatttttaacatgagttttcgaaaggacattcaaaccatagcagaaggtataaaaggggttcttggttttttgggttttttttgttgttgttttcatttaattcaaaaacctggaaagtagccagcagtaggttctggtttggggggaaagacatgtagagtatacaaccttctggacaccagtattaatagctagctaagatttcattattgactgtcctttgccttaagagctggctatgcactgagtaattttaaagcatacaagatcagcagacaaacagatcagttcccgagagtcctggtttttttctctttattcacctgggttagtggctcagtctgtacttaggttgataactaacaatctgttctctcacttggaatttggcatccttttgctctcttgaaaacaaaacatgattaagtacaatgtaggatctggaggagaacagagaacatattaagggtgtagtcaagtcctaaaaaaggatgagctttgattaaagattctcggccaggcatagtggctcatgcctataatcccagcactttgggaggacgaggcgggtggatcatccgaggtcagtagttcaagatcagcctgaccaacatggagaaaccccatctcaactaaaaatacaaaaaaaaattagccgggcatggtggcgcatgcctataatcccagctacttgggaggctcaggcaggagaatcacttgaacccaggaggcggaggttgtggtgagccgagatcgcgccattgcactctgtcccaggcataaaaagatactcatctcagttttgtgacttgtttggtgactaaatccacttcccctctgtctctactttcccatccaccaaatgaaagttaggaagaatgccaacttaggaagagcttggcaagtgcagtactttaaaaataatgaaattatcatggcctttggattaacgtatttggttttgttttgtttttattttctagttattaaagagggtgtacgggagtttcttggtaaatccagaatcaggtatgtagtcatgtgagcaactatggaatgacatgggaagagaggtgtcctttttatattatgctttttttacccaaaggatttcgtttaaatattattacaaatatttctgcatgagcccattcctaatttcaactccctccataaaaatagcttttaaggggctttgctttgtccaatatggaacacagtagaggtacaaaattgatgtgtgacatttttaacatttacttgatggggccacatgactcttacttaatctttcagccagagggccacatttgtttgttcatggtgattaaaatggctttgaaaagaatgagcaaacattgattcccaccctcggcccttagtaattctgcatactacatatttggagaaagaagaggaatattcaccacactattcttgtgatttcaagtaataaaaatcagaccctttcttaatccagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggaatgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaagaccgtagagtctctcctcctcttttttaatgggtttatctaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctactaaaagtacaaaattagccaggcctggtggcgcatgcctgtaatcccagctgcttaggaggctgaggcaggagaatcgcttgaacctgggaggcggatgttgtggtgagccgagatcatgccattgcactccagcctgggcaataagagtaaaactccatctcaaaaaaaaaaaaaaatacagatctcaggaatgcttttgggaaaaaatgaaatagtaatgaggtttcagatacttagaagtgtgaaagccatacagttctggtgaagttattcccgtcagttgcctagaatataaaatgatcctcagtgatgtagaaatattcttgcaaaaacatctctaggcagtttgacacttattaatcatttgattctataatcaagtgttccagccggcttctgggaattcatagtggacatgctgtaaaaaggcaggtcatccaatggtttcagtccatgttctgcacccgtattgatgacctgtcatgttccacacactttaagtattgtacattcttttaatgctcacaacattctcccctatctccgcaccccctgccctgctcctttttctttttttctttttttttgagacagaatttcactcttgttgctcaggctggagtgccgtggcgcgatctcagctcattacaacctccacctcccgggttcaagcaattctcctgcctcagcctccggagtacctgggaccacaggcgtgtaccaccacacccagctaattttgtatttttattagagacggggttttgccatattggccaggcaggtctcgaactcctgacctcaggtgatccacccaccttggcctcccaaagtgctgggaatacaggcttgagccactgtgcccagaccaccctacctgccccccaccaccaatttttttttttttttaacagatgaggaaattaacaagtcaggcaattttttttgtttttgttttttttttttggagctggagtctcgctctgttgtgcagtggtgcaatatcagctcgctgtaacctccacctcctgggttcaagcaattctcctgcctcagcctcccaagtagctaggattacaggcgcccgccaccatgcctggctaatatttgtgattttagtagagacagggttttgccatgttggccagactgctctcaaaactcctgacctcaggtgatctgcccaccttggcctcccaaaatgctgggattacaggtgtgagccaccacacccagcagtttttttaaggtcacaaaatgacaagactaggatttggacccagttctgttcgactcaaaatagagtgccctacacttatgtgtcatgctgcatttggcaagtcacgtcacttctttgaatctccttttccctctgcaaaacagtaaccttatctagcctgcagacttcaaaggtggttatggagatcaaatgaagtaaaatgttttaaaaattgtacaatatataccaataaaagctattggggaggtatatgtatgaacaggtagttggtttttctaccctgccacctcataaagagtttgcagtggcacgtagaagggtttatcttattatcacaaagctacccatttgctggccatactgatacttggcacattaaactatcagagaaatatatgtggctcctttacaactgtgtctagaagggtacatttccaatcagagttcccaggttctgactttctcccattacatatttgtaattagtcatctttgatactgattcaaatttttgattaacattaattatatatatttacaagaatcttataaaaattaagattttatttcacctcattttgccctgtgagatagatggaaatagactatattctacccaggttaaaagtacagataatgagacaaaatgtcaatagaacctgaaaaaagatttttttagttgcctctagtctctgtttacttggtatagatagtatgctgctttttttttttttttttttttttaaatgtaactgctgggttgttttttgtttcttgttttttctttccctccaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtgagtatagaatttggtcctgaagcctggatatggctgctacaccaccatggcacttactgaaagaaatatggcttggtcaaactttcagctgtattgcgtgaaaatgtttttcctcataaaatgtcttaagccaggaagtagatgatagggcagaaatcagccactcctcctactctccagatactgagagctgacagatggtggaaagagaatccagtgctttcctttaaggcaccactgttctgagtcatgtttaagagtatagcctggataatcagcaggcagggtgaccataggtccatgttatatttacaagtcaataaaatctacttctgataatttccatctgctgcctctcttagggcattcattttgtgcactgactttgttgaccataaatatcatctcatttggcacacctttatattatgatttaagagatttatgactttagccttctgatgtacttgtagatcaagttattgacaaaaccccattctgattctgtacttatcctcatggattttgttcctctcaggtatgttgagtctaaaaaggacagagtcacagtagtcttcagcacagtgtttaaggatgacgacgatgtggtcattggaaaggtgttcatgcaggtatggagcagacatcttgggggaaacccatgcatggcgacttatacctttgcacccaaacataccatgagcgtaggaaagagatctagcaactctactgatgttagaattttttttttttttttcgagacggagtttctctcttgttgcccaggctggagtgcaatggagtgatctcggctcactgcaacctccgcctcccaggttcaagcaattctcctgcctcaacctcctgagtagctgggattgtaggcatgcaccaccacacccagctaattttgtatttttagtagagacggggtttctccatgttggtcaggctggtctcaaactgccgacctcaggtgatgcccatctcggcctcccaaagtgctggtattacaggcatgagccaccatgcccagccttgacgttagaatttgttgaagatttaatagacaactcccacaaaactcagtgaatattttttgttgctgctgctgttgttttgaggtggagtcttgctctgtcgccaggctggagtgtagtggcacgaactcagctcactgcaacctccgcttcctgggttcaagcaattttcctgcctcagcctcccaagtagctgggattacaggcacgcgccaccacgcccagctaatttttgtacttttagtagagatggggtttcaccgtgttggccaggatggtctcaatctcctgacctcatgatccgcccgcctcagcctcccaaagtgctgggattgcaggcatgagccaccgcgcccagcctgatattttttttctcagtggtttagttttgcaggacagaactaaagggtaagttgagaattaaacatactaactatgaatgaatgttatgcatccttcctactgtggggtctttgacctaaaactttgtcaggtttcctaaccctaacctcttgtgtttcctcagatttctagtaaggtggctgctcttggtttggtcctaaggtcttttcagaatggactgtatagccaattatttggtagtagataacgcatgaacaggtagagttgttgaactgacagactgagcctgagtttggatgggtcaccatagagtacttccctcacaagaagctcatcttaagaagagtcatgagaggccaggcgcggtggctgacgcctgtaatcccagcactgtgggaggccgaggtgggcggatcacgaggtcaagaggtcaagaccatcctggccaacatggtgaaaccccgtctctactaaaaaaatacaaaaaattagccgggtgtggtggcaggcacctgtaatcccagccacttgggaggctgaggcaggagaatctcttgaacctgggaggcagaggttgcagtgagccaagattgcaccattgcactccagcctgggcaaaaagagcgaaactccgactcaaaaaaaaagagagtcctgagagttagcagggcattttgtaattggatttttggtgtagttgcattcaggtcattgtgtaccagtctgctggccagttagttgctgcctctaggatggacatgagagttcattggtcaagtgacattcaggctggtttcttctgagatggctcagcattcaaaatctagtacaatggtaaaattttttgaaaacgttactaccttcattctgttccttggcagggtggtaaagatttttaaattctgaagcagaatctcttttgccaaatagagttgaaagacagctgtgcttaacagtaaagatactttgcatagccttctaagtggctaggaaaatcttcaaaagtgatattctcaactgctccatccctagtggcttttgtattttggctaattaatcagaaactagtttgggagtcactatacagaaaaattggaatattgacacttcagcatttgctagtgctgaacttgatgaaggaatatataaatatacatgtatctcttgggtcctaaaagtaagcctctagagaggcatttcatgtgtttttatgcagaattgacaggggaattaaatgcagtagctcagaaattgggctaaatccagagtaacaaaactaattttaaaagctctgaagtatatatttagatttggctggttttttaccaatcttattccattttattccaggaaacaacttatttttatactttaaacagatcttatcttggagagtgtaccggagatttgttccttaggagaattttgtgtattcttttttggcatatgatttaaatgcctccttcagggtacctgtggtagggcacttacctaaaaggaaagacaaagcctcttttgcattttggcactaacaggatctctggatagtaactggcctggtgcagtgctagctagactcaggaagtcatctgccctgccaccctttccaaattcagaggcttaggtaatttgttggaaatgacaatcggaaactggacttttgctggattttcccaaaaaataaatagaactttttcctaggcctggaattgtaaatttctcggaaaaagaatgagggacacctggcacagaaagttgtaccctgagaacactatttgaagttcctcatggtcactagtctacttgttgccagcctttgtggcctttcccttccagcatgcacatccagcctgatcagaattcaagtcttgcttttgtcatttggcaagcaggctctgagggatgctttctacctctcagaaaaagacaggaagtgtattcctccacactagtggtatgggcatatcagctgagtactggagaatgtctgatagaagccatcatttcaatgcttattccatgaaaagcaataggaccagtaattatgcttttggagattagcttatggtgaactagaattcttttcatattctaagattttaaagtcaagttagtaactaaataaccaggaaaagttaagtggaaaccactggtttttatatgttcagggacaaagacacaagcacctgcctcttaggcagttgtaaagatgtattttgagggccctttctgcctgtttgcatgtgtgggtatgtctgtaggatattttcctgaactgggaacactgagtccaagtcagtaattttggtagacattgccaaactcttctccatcagggtagtggcattttatcatctaccagtgatggagaggagtgcctgttttcccagagtatgttgtaaacttgtggatttctcctgatctgataggttaaaggtggtatctgtgtctgcttatgatgacataaaaagatgttctgaggtcagaacatcttttcttaatgttatagaccatttgattttcttatgaagtgtctctttatgtcctttacccattattctgtagggtcattgagcttctcaatttctttacatactagggagagtagcctttcatctgtgattaagagttgaaatattttctccagtttgtcattggaccgtgttttgtggggttttttccaccatgtggaagtttgtttttacataatcaaattaatcaatcttgccttttatggcttctagattttgagttataggtagaaagcccttccctactcgaaggttataaagaaatttacctgttattttctgagtatttttacagttacatattttatacatgattttttcttatttgttgagagctcctcttgttgtatggtatgaaagaatgatctttttttcctaaatggctatccagtggtcccagtggcaattatttccttttttacacccctgatttaagatgctacttttatcatatgctaaatgccttgtatatatttggatttattccgaacttcctatgataaatagtactttggaagagagaaataatctgatgctcaaaagacatcctagccagaaggagagtaaaaaggcaatattgcttgattacgtataacaaagatgccaatgaagatggagggctgtttgggtgtgtttgtttgtttaagctttatttaggagagagaactgaggagaagcaaagacatcagagaatctaaagaatagtcccagtcaggcacagtggctcacgcctgtaatcccagcactttgcggggcctaggcaggtggatcactagaggccagtttgagaccagcctggccaacatggtgaaaccctgtttctactttaaaggccaaaaattagccgggaatgatggcacacgcctgtaatctcagctactcgtgaggctgacacatgaaaatcacttgaacctaggaggtggaggttgcagtgagccaagatcacgccactgcactccagcctgggtgacagagtgagaccctgtctcaaaaaagaaagaaagaataggcccaagccagaaacgtatcgttgaccgagccttaaatatgttattttccatatacaaaactaatgagtgctaataagtcaccactggtttataaataccccatctcattgtgaataccacatgtacctgtgaattagagccttggagacacttaacagacacaagaaaatgccaacagttacgtatctgttctgtttaattccttaataccgaaaagtaaaaccagtaaaagttaaaaagcttcttaacccctttgtagaataaaaaatgttttctagagaagggcgattttagaagctttgctctagaaatttccatttgggataatcttgactccttcccttcctttttggatatttttccttcggggaacaaaatctgttcaaaaggggactaatctaacccagttgatggtcatttcttttcctacttaaagcttggtagtgttagcatgagaggcagtttgtgaaataggtgaggtcccaggctgggcattggggctcctcagccatcatctttcttttgccactaattgtcgagagggcttgctaatcagtgtttattcttcctgcctgcaactggaaacagcccttgcctattcctgtacagtgtgatgatactaaaccagctagggtagaagcacttgctttctctcagcaaggcatgtgctgcatagcctctttgaaagacagaagaataaattacaaagataaattaagcaggatctttgatttgaactcataacctggtaggggagccagatacattaatgaatggtaaaatatcatagtagaggtttgtagaaaagacatggcagctccagcaagagagcagtacctgcctgggtttgttggagatggtattaggaggcggtatttgagcagcagtagaagggcacgcaggccacatggctgtgtaaccatgccttcagaactcctaaaacaagagaccttggagagtccttggcagcatcctcctgctgtctatcatcttggaaggcccacttgatgaatttggattatccagttttactggcattgctagaaaatctacttctgttcttgcagatctggctgagagagagaagccttgtattacttgtctatttacataggaatgtatggactgtagaagcttcaggtttggagattggaacatagaaggaagggcttcctttatgagcaccaagacaactcagcttctttcattccattgtcttctgtccgcaagaagagcttaagtttgctctaaagattttattgatgaattctaaatagcaacaggatcctcagtgaaaaaagactcatgcaaagtcccagagcccagagaaagtatggtagtttatcacctatgttagtgcaaaggaaaaggattatcactacttttcatcacattttgaagatctgacttattaagtactttgcagtctctcccgtttgaatctgaagtgtagtggtagcagctagcacttgtcatatttcaggtttggtgtagtttatttttaacctcctgctggtctggagggctacaaaggtcacaccacatagaacaaaccctatagcttgagttgccactcatcttacacccacttctcttctggttgcttttgctttgtcttggcaggagttcaaagaaggacgcagagccagccacacagccccacaggtcctctttagccacagggaacctcctctggagctgaaagacacagacgccgctgtgggtgacaacattggctacattacctttggtgagcagggtgcacttgctgcttttgtgccgctttaatgagttcacacagcagaatacctaaatctgcacagaaccttggttaacattttaaggtaggcaaacgcaggcataccaacttgttcctgttgccattgcagtgactaaaggagggatgtcacagggtattaattacagagcaggccatatgctatttttgtacagtaatcctttcctttttttccccatttttcttaaatcttaaaaataagactgaattctgatatcaagagttaaggtcccttcagtagttcagctggtagagcagaggactatagctacttcctcagtaggagacgtccttaggttgctggttcgattccagcttgaaggagacaagtacagttttggctgggcacggtggttcatggctgtaatcacagcactttgggaggttaaggcaggtggatcacgaggtcaggagatcaagatcatcctggccaatgtggtgaaactctgtctctactaaaatacaaaaaaaaattagctgggcatggtggcgcacgtctgtagtcccaggtactccagaggctgaggcaggagaattgcttgaacccgggaggtggaggttgtaatgagctgagatcgtgccactggactccagcctgggcaacagaacaagactcttgtctccaaaaaaaaaaaaaaagagttgaggctgggtgcggtgtctcacgcctgtaatcctagcactgtgggaggccaacatgggcagatcacctgaggtcaggagttcgagaccagcctgaccaacatggtgaaacactccgtctctaccaaaaaaataacaaagaaattagctgggcgtggtggtgtgcgcctgtaatcccagctactcgggaggctgaggcacaagaatcccttgaacccaggaggcggaggttgcagtgagctgagatcacaccattgcactccagcctggatgacagagtgagaccttgtctcaaaaagaaaaaagaaaagagtaaaggataggcggggcacagtggctcatacctgtaatcccagcactttgggagtccgaggttggtgggtcacttgggtccaggagtttgggaccagcctggataacatggtgcaggctcatctctacaaaaagcaaggggccaggcacagtggctcacacctgtaatcccagcactttaagaggccaaggcgagcagatcacttgaggtcagaagttcgagaccaacctggccaacatggtgaaaccacacctctactaaaaatacaaaaattagttggacatggtgacatgtgcctatagtctatagtcccagctactcgggcaagcgaggcatggcaattgcttaaacccagaaagtggaggttgcagcaagccgagatcatcctgctgcgctccagcctgggagactgtctcaaaaaaaaagataactaggcatggtggtgcatgactgtagtcatagctacttgagaggctgaggtgagaggatcacttgaacccaggaggtcgaggctgcagtgagctgtgatggcaccactacactccagcctgggtggcagagtgagaccctatctcaccaaaaaaaggagttaagaagagaaccacctaagcagctagatgggggttctctgtcatttggcaattcttggttttttgcttattaagcccaagctccagccgtgatccacttactccactttttcgcggaataaattcaggtcttccttcagttgctccagcctcatgcactggctgattatgatagcttacagtttggaattaataagcttgttcacactgcacccaatgccactggaatgtctcctttgtgaaatgtaatttaattcacctcagtggtaaaggtgaacctgtttattggtgatgaatctgttgatttaccaaatttcattaaatctaaactatacacttttttcttttttctttctctctgtcacccaggctggagtgcagtggtgtgatctcggctcactgcaacctctgcttcccaggctcaaacaattctcgtgcctcagcttcccaagtagctgggaccacaggcgtgtgccaccacacccggctaatttttgtatttttagtagaaacagggtttccagctgggcacggtggctcacgcctgtaatcccagcactttgggaggccgaggcaagtggatcacgatgtcaggagatcgagaccatcctggctaacacagtgaaaccccatctctacaaaaaatacaaaaacttagctgggcgtggtggtgggtgcctgtagtcccagctaccctgaaggctgaggcaggagaatggcgtgaacctgggaggcggagcttgcaataggccaagatcacgcgactgcactccagcctgggcgacagaacaagactccgtctcaaaaaaaattaaaaaaaaaaaaagaaacagggtttccatgttggccaggctgatctcaactcctggcctcaagcaatccactcacttcagcctcccaaagtgctgggattacaggcgtgtgccactgcgcccagccagctataccatttttttcaagtttttgtctttgaagctgggatgcatcttacaattcatagcatgtcacactttaattggcagcatgtttctcttgtggtacataaaattatggcagacttacagtcataagcaccttagattctttgaagtatagttgtcttctgttgtggtgttcatttactttcaggccagggcacattgacacagaaattccacacttccttaggaggcattccttttcatttcaacgaaaacttcagacaactgacggggttttgcagatagtgagtagaggaggtgcagcaggtaaaaacgattccagaaaaccagggcaagaggggcatgcaggcctgctgtagtgcaaaggactttgtgatgagcacacaggtctttttttgagatggagtcttgctctgtcactcaggctggagtgcagtggcaccgtcttggctcactgcaacctccaccccccgggtttaagtgattctcctgcctcagcctcctaagtagctgagattacaggcacacgccatcacatgtggctaatttttatatttttagtagagatggggtttcaccatgttggccaggctggtctcaaaactcctgatctcagatgatcagcctgcgtcagcctcccaaagtgctgggattacaggcgtgagccatcgcgcccagcctcacacaggtctttaggtggctggtgtcacagggtggacttcagtcaggcccagtcagagcagctcctcctgcctggcctatcatgagggttcaggtccttacaccttattgtctgttttcacagtgagaatatgggaaattctctggcatctgttttctgggaaggtttactctatttcagcaccaaggacctaagacaggcagctgcatttcctaatcctgattccttaaagtaaactgttacagccagttagtgtgatcctggagtgtgtccagctgcagaggcaagagctagtacctgtgtggcagaccggaaatagatttcaaaatgcacagctgcagaattcaggagtagaatgaaggcctagggtcaagccctgtttttcatcgtgggctcctccattcacgctcgttgacacctttcctggccatgctgtttaacttccatgtcaagaaaaaaccctgacaaagcctggtaatactgacacaagtggagtgtacttaagcagagagggagtgatgttcactaggctgttgttcttccccaccctttggcatttgtgtcgtgtcctgacgccttgtttgtgtcttccgccttcagtgctgttccctcgtcacaccaatgccagtgctcgagacaacaccatcaacctgatccacacgttccgggactacctgcactaccacatcaagtgctctaaggtgaggggggtgccagcatctcagcctctatgctctgggtcttttcctccaccagaactcctgacagaaagtcattccattagtctacgctgtggatattgactcttaggtaaataattctagaggcttcaagaaaccatggtctttcttcatcaagccactgtcccccatccctccctatagcagagatgaatatttgtttccagaattgctcaccttcctgcttccctgcagggcctgggtcaatcccagggtgtatgttcccaaccgcccttgatgacctctctgatgaaagacagcaaagctgtctttctagaccatgactgtgctttagtacctgttatgtttgttcccaggcctatattcacacacgtatgcgggcgaaaacgtctgacttcctcaaggtgctgaaccgcgcacgcccagatgccgagaaaaaagaaatgaaaacaatcacgtaagttaggcagcaccccagcgaccaccttcctctcctgagtcaccgagaaggaagcagtgggcgctggtggcctggtcctccatgtatctgggcactggctacatatgaggtcagcagggctaagtagataaaccaaaggtgggattccatgttctcactgccatataggccaggatgggtttccttgtttccgtatctttgtgagctatgagaatggcagctaggaaataaacaaagtttaccaagagactgttctttttgggcctgagttatgaggtcagtcttgtgcttttggtggtctttctggagagatggagtaagttgcttagggacctttaattgggtaaataggcctgaaaccaccccactaagtgttctttttcctggtccactctcagcaggaagtttgcatgcagaggaaggttctctttatcagggatagaattgaggagagccgtgacgggcgctgtggctcacgcctgtaatcccagcactttgggaggctgagatgggtggatcacagggtcaggagttcaggaccagcctggccaagacggtgaaaccccatctttactaaaaatacaaaaaaaattagccggtcgtggtggcaggtgcctgtagtcccggctactcgggaggctgaggcagagaattgcttgagcccaggaggcagaggtcgcagtgagccaagattgtgccactgcactccagcctgagcgacagagtaagacttagtctcaaaaaaaaaaaaaaaaatttgaggagagccctaaataggggtgtggctctgcatgcaggaaaggcgagcatggcctagagcctagagagttccatctttgtgaaaggtgccagaccttggttcttctgatgaaattcaggcagtcctgtccttaagataaggtaatagtgttcatttgctggtttttgtttgtttgtttgttttttggtgggggtgttgggggagacagagtctcactctgtcgcccaggctggagtgcagtggcgcgatctcagctcactgcagcctctgcctcccaactagctgggactgcaggtgcacaccaccacgcccggctaattttttgtattttagtagagatggggtttcaccatgttgcccaggctggtctagaactcgtgagctcaggcaatccacccacctcggcctcccatctgctgtcttttgtaccagttgaactaaaagtcttgaggtcataagcctccctcacagccagtgttatttgccagcaccccagtactgttgttgttttgttttgttgttttgtttttgttttttgttttttgatacagagtttcgctcttgaagcacaggctggagtgcagaggcacaatcttagttcactacgacctctgcctcctgggttcaagcaattctcttgcctcagcctcccaagtagctgggactacaggcgtgcgccactaagccccactaatttatttgtatttttaatagagacagggtttcaccatattggccaggctggtcttgaactgctgacctcgtgatccacctacctcagcttcccaaagtgttgggattaaggagtgagccaccgcggcccagcccagtactctgtgatccccagccaggctcaacctcctgggctcaagcaatcctcccatctcagccccccaagtagctgggaccacaggcatgcaccatcacagctggctaatttttgtatttttgtagagacgggatttcaccatgttgtccaggctggtctcgaactcctggactcaagtgatcctcccacctcagcctcccaaagtgttgggataacagacatgagccaccacacctggcccagcactcagtactcttgaggcaaagttttagtgggtgtggtacgcctagggctttacactctctctcttgcatttgagggctcttctaccaagttagtttctgctgtcatttgaaaggatgagaaagagatcaaggacttgagcagtaggtgagggttttcagacattgtcaaaaagcagtttaaggccaggtgcggtggctcacgcttgtaatcccagcactttgggaggccgaggcaggcggatcacctgaggtcaggagttggagacctccagcctgaccaacatggagaaaccccatctctactaaaaatacagaattagctaggcatggtagtgcatgcctgtaatcccagctactctggaggctgaggcaggagaatcagttgaacccgggaggcagaggttgcggtgagctaagatcgcaccattgcactccagcctgagcaacaagagcgaaactccatctcaaaaaaaaaagcactttttaagtcacctcgacttctttaggcaaaggcctgtctctgtagcagctcagagaggagtgtccaaatgccatgcaatgaaatggcagcatcgtttcttttctgcagcttcttgggcagatctttaaatgggcaaagtgaccaacaaggtgggtgggcaggtgagaggatgtgcttgctgcctctccagaacctggtctccatcctggtgtctacattttcccctttccctgcttgctctacacaggagtacttttctcaccgggtacttgtttggtgacctggagtgtgaggcagtgaatttcatgctgctttcagggcccagtagacaggcagttcagtagaggccaagaggtaaactggcagccaggtacagtgagagggaagcctgacctggcagcctgtgataaccggactggaaggctgggcatcataatagtctcagggctgccagcatcacctttggcactggtagctgcttgtgcatccaggaggaaggcctgttaggcagctgctgcccgattccacagccagcaggcagtcgtgggagtccctgcccagtgagtgcagttgtgtagcgggcagggatagctccctgtcctggtgagagacccaggaagggatgaatccttaaaatgaacagactgttcataagcctcctctctgggacttagaaagagcaactttgccttcttctgtgctgcagcttctctttggcagagttgggccccagaaaggagaagcaggagacaaacagctgcatccaccctgaaaaccagattatgttactaatggtgggtaggagttaagtgactcagctgtgggcagaagccaggaaccctcgatgggccgcccagaattgaacactcaggagcttttcatttggagagaaggataataaggtgtagcttcattttggaataagcgatacatccaagacagggaaaatctagagcccatgtttttgccctgatttcccatagttctcagctctagcttccaggctgctttcccagatactgttaggtaccagttagaggctctgtccttgagaaccacctagcccatctggagaaatactgggtggaacaggacaccacaattcaggagcctcgaaccaggcaggtgttgtataagccagaggaggagtcaccacgtgatagcagaaatacctttagccttggaagttctgaggattgctctgaaccagccacctgccttcatggtgagagataaaggaactgctatctgggagccctgagaggtatacactgtgtaggaggagctgacaaatgaggtagtactaagaagacggtttgagcctagtcggaaattcaggtacgtctaggccatccagaaattgtgaacaagtgattcttctatctaacttggtacgttgaatgtccttgtgggcttaacactgatattcccgggcatccaaagtatccaataggaaggaagagctcgtgaaaccattctgtgaaagccagattttagccgatgtcctgtggttccagtgcctctgcttaaggaatctagccctttccacctctcatttggtgtttctttgggatcccatctagtctaggagtgtggggtgggaggaaagggcagccagaaactgaccttcgcacttatctctccttttgaagggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttacatgagaatttgctgggtttctggactgcgagtccaaagtgagaagagaaggaagaaggatagacctatactacccttgaacctgcaaacctaagctgggaagccctagtttcaggagcccatcaggtttagatcctcaccttccctagaggagagaatggctggccagtgagctatatttaaactttttttttttccccctgagagacagggtcattacctcctgggctcgggtgatcatcccacctcagcctcccaaatagctgggattacaggcgcataccactatgcctggctaattttttttatttttagtagagatgaggtttcgccatcttgcccaggctggtctcaaactcctggactcaggcagtttgcttgcttcagcctctcaaagtgctgggattataggcatgagctatggaacccagcgagctattaatacaaacttacatgcttccttataaagcttggtccctgagactctgtggctgctcctgaagctccctggtcaatgacagagaaattaaagggttttctggtttatctttttattgtgaataatgtgtggaatttcccaaaatgtgttccttagtgtgtggtcctgcaggacattgatgagtattcaggtgtgggtctgatgcagactaattggccacagtttgtctttctcacatggcagcccaaaagactgctctcagggagagcagttgtcaaaaacagtacagagcctagtagagcagctgtcccccagcaggactctggtccctgaaatgaaattgcttcagaaagtttgcttggtgtaaggaattaagaggagaattttaggggcacctgcaacggtctgatggtcattctaatggtttctgccttccatctatggcagtgtttcatactggcttgggacccattaattgtggtgtgactatatcacaacaagcatttttgttttctaaacttttgattttgagataactgtagatttaaatacggttgtaagaaacaatacagagagatcctgtataccttccacttggttcccccaccatgctaacatcttgtataattgttgtataacatcacagccaagaaaaaatcattagtatagtccacacaccttcagatttggccggatttacgtgcactgtatgagatgtacatctgtgcatttttatcatatgtgtagctttgtgtgacgccagcatttttaagcaattgaatagtatcagagtgcattacatctgttaagggtaagtgttgatgtggaaacgtattttagttacatatgcacatcatgactggattgtagaaatgtctcttgactgtgagtcacagtggagaattttgaaaaccacaggtcgttcagtcatcagacttgattttatttcactaaaatgggctgctagagagctcaaggtactctgatttctaattggctgctcagggtgcccctgaccacttacttctggtacttggaaaacctagattaattggatatattgacagcaacatgtgcattctctaccccatgagttatttaaggggttttcaagtgtaattttgactagaagcagtttttgctctttttttgttttaattttagtttttagagacagggtctcactgtgttgccgaggctgtactcaagctcctgacctccggagtagctggaactacaggcacctgccactatgtccagctgagtttttgctttcttccttagtagaacataactaatgttggagctcactgtactcttttgccagtagtaggaatccg

SEQ ID NO: 17247 - DNA, 10433 bp, Human
gcaattgagtatttccagtaataggaatagcaaagctggtctgagggcatcattagtaagaaaacagtggttattcagagagggtggttatggtttacagctgctgcatgaccttaggagaaacaatgctttctgttggtgaaaaaaagaagacatcctaagacaaaccttgcacctcaaaacctctgtagatagagaatccccacttggaagctataggtgttgtgcagatttagtcttaaaaattaacactttgagtgctgataatataatatgatgatgtaaaatttaggagatacaggaggaaataaaggatggggataaaggaaaaagaacagtgaagggacaataaaggtatgcatatttttctgtctttcctcttttcttcaccttaagttaggctcttttcttataacctagtataatgtccagcatttaataggtattcaataaatatttgtgaatgaatgaatcattcaatcaatattggtcctgaaatgccagggaaaaagagatgatgaactggcatatattgagaaccatgtctatgtcaggtatagtgtcaagcctttcgtgaaagagtaatatggaatcaactcctctctctcagctgatctgcagcttaaaatgcatatatggtgaactgtgggaagcggagtttgaatgacacaggtcagccttatgttttaatttatatcttcatcttgtagttgttcaatgtattccattttactatagaaacaggaaaaggtcgtcaactttttcaagcaaaatttcttttcatatctgggaaattggaattccttttttatatctttattatctctctgatattctcttgctccctggccaagcccttccaggcaactttggttaatatattattgagatgttagaggtttaaaataaatcactatcaaaggatagaattttaagggaagactaaattatgtattcattagaatcataattttgttcctaagacagattcgtgatggtataatagaaacagtgtcttagcctgaagtattgaggatagtcctaagattagggaacgatcagttcgttcttaatcataagcataagagaatgactcaaacgctgctgtttgatctacctgtacttacatttcttcttaattttaaattcttctctgctagtattctttagacccaacattggttgtttcccctatttcttcaatatttctatttattttccatcctttttacagggtcatctaaataaaaatatcttaaagcaataaaccattgttattgagtcagtacctcagtccatgcagcttaataatatggagagcaaaaaaaaaaagcctctcgatttattttttaatattacacgatcctagttttttcttcccagaaaacgtgccacaaagtttgcaagaaagagcttttggggcggagccctggctgcttaggtcctttccattggttctacttggtgaccacgcccacggccccgcctcctgggcggaagagccaattgggccgcgagttgtggtttaaaccaggagtgcgccgcgtccgttcaccgcggcctcagatgaatgcggctgttaagacctgcgtgagtgaatgggagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttgtaagtatacaaggctgcagtcggatacactggtattgtggacgtggcctggagctggacgagacatttagtgtactttttgggcaattggagtcgtttgttattggtcctttttcatttttaatatcttaatgagatgatttaaggaagttactgaatctctgctattaggcctatcatagccatgccactaccaaaagtggggggtgggtttgggggtgagaggtcaagtttatatacacagtatttaagttgtacaggtattttgctgctggaatattcttatggtaagactttttcttcagcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaaggtaagtgttggctataaagacactgtttaaacacttaagcacttttgactcttaaaatgactattggcatcatcctacgtagctttcttccctctgagtagaagggaaatagaggttagcaagcagagtagtggaggagactcagattgtccttgtggacttcttggtaccttgagattggaaatctcagatgcagctaatgcatatttttgcctcatgcatatttttgcctcacctgtccttcactagtgtcgtgaaactggttggtggtgtctacttacagatacatactgagagagagggtgccttaagagaaactggttggtggtatccacttacagatacatactgagagagagggtgccttaagaggttctgttgctgctttaatagcacaggtgctgccattctcttagccttccagggcaagcagcagcttgttaggtgacaatttgctagcatgttgatctttgtgtgagtgtgagtcacaagctacaggtctgtgtatcccagatgagaggactttgctgtgaaagatgacattagcatgtggattaacactttatttgaataactgttttgtttaatttgcattaggaaacaactagtgaattacatatagtgcaacttaggacaaagatgtcttctttaaaaagtgaattaacttaaagaaaaatattaaatacaggaattgcaaagacatggcaaaaacaatgagacacagaaccgaagtgtgagaaccccatagggaattctaggcatgcatatgtgaggtgagataaagcaggaacatgccggcttccattgtagcacccttctatagtagactgtagtagacctgtcaactccagactagaagattgcccatggtgtttattctaaagtccttgacagtgtcttgctgcctcttactcagtgtgtgtatttgaggaacacaaacttgtttttaatattaaccaagcaaataatttaaggtaacacttgtggaaaaaatcacactcctataagccaaaaatggctttgatgattagctactatcctgggtgattcatgcccattttctcctctgttaggttgaataattgcattgattagctctgaattaactgcattcttgatcacttatgctgacaggtgctggtacttaaatttcagattttaacttttgagtcatgctactcgaattacatttgaatcatattatttgaagtatatttaggtgcaattatgaaaactaaggattatggcttcttagaaggcagcatgaaattgacaaatttaaaaactaatcagctaataagacttccactctcactaacccatattttctttggctgttctagatgactgagaagactgttaaagcaaaaagctctgttcctgcctcagatgatgcctatccagaaatagaaaaattctttcccttcaatcctctaggtagtatcttttgcaattgcgaaaagtgcttttggcctttagtttcttagtattcagctcagctgtaacttgttatgaatataatatatgaccaaaaactatgatgagactgtctgaatctgggttgctttggacaagtgtacttgttgatggaattatttgcaaggtatcatcttaggtcaggaggggaataggaacaaagatgtagaagacattgttcctgtctgtaaaagcttatcacctagaggaggtaagatgtattcatgaacattgaataagtcccattgtggacagtctttctcacaaggcttttagaagtgagctttatgtcaagttgagcaatgcctgagagtaatttggtaggattatttctttggtttgaaaaatctacataagacagtgaagacgtgtttttcaaatttcttcaacctgctacatgtatctgaagtattttctgttttggaaacagcttttcaagctttaatttactcaaccatttcaggagaagctactgtgtgtcaggcatccttaggtcctggacacactgtttaacaagatgggccctgcctatgggagcccataatttgaagggaaagtcagatgctggacaagtcatctcactgtgagtgagccagaaaaaacagcattgtaggtcaaagtggtgcaaagatcgtgaggtaggaaaagagactaaagtggttctaggaaaaatacaggcagggtaaaggaggatacaggtgaggtgtgggatcagatcagggagggccttacggatttctgagctggatcttttacccttttatttagccaaagaggtcatgtagttattttactaatttgcattcagattgttctggcttttagaaactacaaacatttctatgattagtattcttgaaatgatcttgttgtaagtttgtgagtacatctggagggaaactttgagaaggattgctgagttcaagggcttgtgtgattaagttttaaaattataaaatgtggtgcatccgtgctaataattaccattcagccattgaggaaaatgaggtagatttatgcatattgatgaagaatgaagaccacaatatcctgtgttacaggaaagagatattgctaagtggcccttcaaaatagtgtaaattgttaaatccgtctacagtggatgaagatgtctgcttcctccaggttcactatcaatgttttaaaactctaatctttatcagaaaagaaatatttcattgttttaaatttgttgtgtgtatggtgaacatatttgattattggccacttacagtttttctttttttattaacttccggtttgtgtttttctttgattaaagagctctttgtagataaaattagctccccttatattgcaaacttctttcctctggagtcttctgtctatggtttcctttacaattcagtggttttaagttaaatagtcacatatcattcaattcctttttgacttctgggttttaccaggcttgtaaaagagcagactaattcttgagtacttaggctttagagaactttcacacctacggacaaagataaggaaaaccatgattttctaatcttttgagaaaacagctccttgaagaaaattcagtgttaaatcctacttttgttactgtacagaaaaatcactttttaaaaataattgctaagaagtaaggtacttggattttaagaatgaatgttacctaacacaatggttctccatttttttttgttttgttttaaagacccttttacactcttagaaattattgaagaccacttttgcttgtgtgatctgctcttttctgtattagaaattaagactgagaaacttaagatatttattcactaagtaatcacattacattaatgtaaatttttttttaacataaaatattttttgttctggaaaagtttggagaagaatggcatggtttatatttttgaaaatttgctttatttggcttaatacaagacaactggattcttatcaaattctatattcactcttacatctgttaaaatatacgaagaaaacctggcttcacacagatacgtttttaatagtcttttcagataagtgtggataggtttttttgccactacactaaaacccacaagtggctgtttctgaatataaaattgcaatgtggaatctgaaaccgtatcaatgagcattttgtatcttgacagtaaaatccattggtctattttgcacttggaatgtatcttatattcttgcatctatcttgcattgaccattcagaaatactggttcactgagatatgtagatacccacatgttgagatgctttattatacaatatcaaaagcacattaataccacaactgatctcatcagaaaagtctaagcacctgtcaagctaatgactgcagataagttttccaaaattcctttttttggccagatgcagtggctcacgcctgtaatcccagcactttgggaggcaaggcgggcggatcacctgaggtcacgagttcaagaccagcctggccaacatggtgaaaccccgtctgtactaaaaatacaaaaattatccgggtgtggtgggcgcacctgtaatcccagctgcttgggagactgaggcaggagaatcgcttgaacccaggaggcagaggttgcagtgaacggagattgtgccactgcactgcagcctaggtgaaagagtgagactctgtctcaaaaaaaaaaatattcattttttaatttttgacaaaattttaacgttttatattctgccattggcaacaaaggctgtcagttttccttgaggtgatagacttctttcattcctttaagaaaaagtgtgacaagcacccaggtctgagtgaccatgggatttcttgcagttgttaattcaagtaaaaacagtattccaggaaaatgttctctagttttagcttgcaactcagatagttgcacaaatccttttaatcgtattttggtgtacagtggaagtgctttatggcatacttctcattttatcacacagaacattaaaaagacatctcaaggatggagagctaataaaattaatactttctactgcatatggtgaagtgacagtaagtgaaactggcatttttaaactacaagcgaagaaggatgcagaacagagagactgctaatatggtttactgtcactgccttgatttgtgttgaggcaccagcagctttctccaccgctgccttggtaccatcattacaaatgtcaacccagtggaaaaaggtgtgaatattgtcttgaaaatagttttgacctcatggaccccctcaaagggtctcagaccacaagggatctacagcccacactaagaactgctgccctgacaaaaacgctttctctctgtaacagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccagtaagtgagcaagtgcccttctggaagggctgcaaacaatttgtttcataacacttccattaccatgggaagagttgtgcgggaggtgagcctgtgagtaatttctgtccttcaaatgacaaggattagttttcagaaaaataaactattctcgattaatattgcttttcagtcccaaatgccccagtaaaattgttattctggaaactggatagtcttactacagccaaaagattaattctcacttacatcttcttaggctataagttgaagcatatataataaacttgcttggaatgatgattccatgttatatccaaagctaatataagatcaaaacacctgtgctgtagcatagactgacaataacttcttactgcagaaggtctgaggtcttcgtttgaactggtagtcaaagccaacattatgttttctgtttgttctgatgtgggataatttgtcctaataagttacattagtgagactgttaactcttactttggtctctaagaacaatagagattcagatacttctaaaacttacttcctaatgaaagtcaattctggggccacagacacattccaaaaaatgtgtcaggaggggatgcaggtgattgatttgacaaagggaaaaacatgaatttttgattgacagctaatgtctatgttgatatggacaatgactcaaggatttgcagaaattttaataagagattcctgttttctagatctgttgcagtctccttcaagcattctgtcgaccctggatgttgaattgccacctgtttgctgtgacatagatatttaaatttcttagtgcttcagagtttgtgtgtatttgtattaataaagcattctttaacagattcttcctagtattgtggttgcttttccatggaggttacttaaaataacatgaaagctagctgaggtgtttaacaaagagtctataatgtgacaatagagatttgtctgatgtctaaaaacttaaatctttttggtttaacagcttattttagaagctgccactgttttttcctgaaaagtatacccctcaatgtgtactttattgactttttgtggccattaactagtgacagttattagatctcttaattagaagagctacttccaactcattaagtatctattgctgggcattctttattgccggttctacttagtttctaatgactttaatactcagtattgaaaggctctaaatctgagaattcagcctccttgggatcttcaattagattccttaaagatcactggagataatttactgatagtaaggtctacactccacctataggaaactgtatttagttgtttaccttgtgttggacatgagtatttgagaagcattattatgtttaatgtttgacactttcccaggtaagacaatgaagcgcagaagttcattgatttgtcaaagatgtgaagagctagaaaattattagagctggtattttgatctcagttctgaggttggaatcaaaatagagatggcaaatggttgctcataggttttctttttgagggagggggtggatattttaaaaaccttaatcatttccactatttaaaattccagtgtttcaccaatctggctttggagattctcttgaaaagagatgtgtccgtagtagaccctgtttccaacacttgctggggctggaggtagattgcaggctgctgccttttaggtggagtataggctttctatcccacagaccctgccttaaatggcctcagtgagaactgaagtgatccttttacctttcatgtctcttctgagacctagcctacttaactcactttactcgcttgggccatgtagtaacctgaatttgacccttgcttgatgctaagttatataagaagtctttcccttgatatatcagtagcttctatggtcaagttagaatgtgaacactttgccattgtcattggaggaagctgaaggatattaggcatgaaatactaagaacacctacaaccgcttatcctgactttaaaactttttaccttctaaatacaactgaatcagtgtgactttctggaattagtggaaaggcagacttctaggagaagataataccataagactactagggcacttggctttaggggagagtaataggtttagcatcctcaggtaaaatagggctgctaagaaaaccaaagtataggttggacacagtggctcacaccagtaatcccagcacttgagagtttgaggtgggaggactgcttgatcccaggagcttgggttcaacctgggccatgtagtgagacccttgtctctcaaaaattaaaaataattagccgggtgtggtggcgcatgcctgtagtcctagtttcaggaggttgaggcaggaggattgcttgagcccaggagttcaagcttacaacttgagtggctatagtcatgccactgggtggtaaagtgggtggtagagtagcctgggtggtagagtgagatgctgtctcacaaaaacaacaaaaaaagcaaagtgtagttctgaatggctttcatactctgcaacacaaactgaagctttggaaaattgtcttttgtggtagagggaaccaagggctgggagcaaggggactagtcagtcccttaccagttaattgccgtcctctgggtcagaactgagtatagagggatctgatcttttcatctgctgttaatcagattgcaatgtgcataatgtgtgctgagactgagaactttaagcagatgctcctccattaatacagataatttgcatcttgtgggggttgttgctattttgttctgacactttttgaaataagacagactttattcatacctttacaactctgt

SEQ ID NO: 17248 - DNA, 61198 bp, Human
  misc_feature (1)...(61198): n = A,T,C or G
aagcttgtgaggtaggtaccattgttaccgatcccagtttttatacatgaggtaaatttatacattaaaaagttggctgggccctgtggctcacatccataatccctgcatgttaggaggctgaggcaggaggattgtttgagcccaggagtttgaaactagcctgggaaatgtgagaacttgtctcttaaaaaaaaaaaaagtaaaataaaaaccttagaagcataagtaactggccccaaaatcacactgctactcagtggcagagactgaattagaactcagtaatcaaataagccacctaaagcatttttcacagcatgcggtgcttaataagcgtatagtctatgaatattagcaatgggaattattgtttagagttgtacagctagtaaaggaagctgagaccgtaactcaagttttatgggtttagttacttatttatttagctccaaagtttacagtctttccattacaccagaattgaattaacagggccacttaaagaggcttaaccatttgcttttttttttttttttttttttaaatatagacagtctccctctgttgttcaggccaaagtgcagtgtcgtgatcacagctcactgcagcctctgactcctaggttcaagcatcctcccacctcagcctcctgagcagctgagactacagatatgcgccactgtgcccagctaatttatacacacacacacatatgtatatgtatatatagatagagatgggttttgccatgttggtcaggctggtcccgaactcctggccccaagagatcctcccatgtccaccttccaaagtgctgggattacaggcatgagccaccacactcagcctccatttacactttttaaattctgggggtattttttaaaattcagaaatactaaaaccaaaataggatatatttttgatgttttcttttagcatataaagctttcaacttacaaaaaatacaactgtatgcataatctcatttagatggaaattcaaaaaacaagtttcatactcttcctgaaaaagtctcttccagctatctatctctgcaataggttctgtgaattacagaaaacgaattctctgctgtcattgctggttacctgtctggctaccttgaggatgggtactatatttcaattctgtgatcccagcacaatgcccagggtctaataaacattcagtgaacatttctcgaatgaatgcatagggcaaccactcttggtctcagggttcccttacggtcttaaatattattgaggttggtctgagtgcagtggtgtttacaactaactgatcacaaccagttacagatctttttgtttcttctccactcccactgtttgacttggctagcccttgaaaaataaaaatggaccgggcgcggtggctcacgcctataatcccagcactttggtaggccgaggagggaggatcgcttgagcccaggagttcaagaacagcctgagcaacatagtgaaactccgtctctactaaaaatacaaaaaaattagctgggcgtggtggcgcgcacctgtggtcccagctactcgtaaggctgaggcaagagaatcgcttgatcccaggaggttgaggctgaagtgagtagaggctgtgattgcgccactgcactccagcctgggcgacagactgagactctgtctcaaaaataaataaataaataaataaataaataaataaataaataaataaataaatagtgaaacgaacaccacagggacagacttccttttgtccttttttctcttcgtgcagagtaacgcggagtcttgccgtaacccaagatggcaaccatctctcaaatgtcacgccgtacaatgacgtcacacagcgactatgcctttcctccctgagagtttcgctacatttcccaggatgctttgccaatagcgacgctattagtcgtcatcgacggaagtgcacctgactgagcggaagtaggagctctcagaggctaagaaggtggagaccggagaagctgtgaggttgtgagtaaccccgtgggtctaagcgtgttggctgtgaggaacaaagctagggaataatctgctgggaagcgcgaggcatcacttccctaactgtaggagctcaaactcctgtgttcttccagtagacctgggagcgaagagaagcaagacattgctgtggaggcgaagtctccgtattaagatcttgctggttttttaagttttcttggcacatactagggcaaattcagactcttgtcgtgatacaagggtcgttggcgtgattttgctgcgactagagcaatttacgttcttgcaaatctgtcgcaaatttttgcaaatgtctgggctgctgatgctctgactcagcttctacagcagtggttcgcaattggctgcatatcagaatcacctgggatgaaaacataaataaataaataaataaacctgatgcccttgcttgacgcgacactaataaatcagaatttggtcagggtctgagcagtggtattttctaaagtatctctagtgttctcttgggcagctagggttcagagtcacgctttctaatgcctgactctggcccccacggtaatcctgattagggtcacctgcgccagggttccccttccagtgtaagctgagtgggctctaccacacgcatttgggttaaagtgatcacaattttggcacggattttattttgaagtctactagaaacgtattcttgggcttcctgtggtggtgctaaaaagacggaccgtagtttcttactcgtgccttggttattcattctgaatggagattagggctgcttcctttttcttggcactgttttagtttctgcctaatttttgctatccaaacagaacacgaacggtggaacgtggaagagttacattaaaaacggcttcttttgttgcttttaagaagttctgggccaggcgcggtggcaggcgcctgtaatcccagctactcgggaggctgaggcaggagaatcgcttgaacccggacggcagaggttgcagtgagccgagatcgcgccactgcactccagcctgggcgacagactgagattaagtctcaaaaaaaaaaaaaaaaaaaaaagaatctggtaccagatttgaccagaaaaggggtctcagttaaaatgacgatttgacattattattacttatgataagctgtatttttaaataatgaattccagtgaaaggaaattacggtgtgttttttggctgtaatgcagaggtttgtttaggtttgaaacagaacttttaaaaatacaagcaccattatatagcagttttgttttgttttcccccagctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacaggtaagtattttatttattgtgcaagatctgccacttacactgcattttaaaatgtggtcgatactgtatcatagaccacctcatctgtggtaaagaataacttgcccctttgtcttcttatggctttagtagtgttggatctgagataaatcggtggcgtgacagggaagcacttgagtgtgtctgcttaacaaagaaattttcattattttctgtgaaccttcagttatgttcatcttgtacttcaggagtctgtaatgtaacagtctttttgtttattttcaaaatgtatatatactttttagttttctgttatgaacttttctacggttggctgctgagatttctgtaatgaacatttttatgtttatgctacatttatgtttatgaacatttcctgtttatgctaatcccttagttagcaaaatatgactgcctgaatatcttggtggggttttggttgcagaggtcttgagaaacagaattgtgtatgattatagctagctatcctttgttgaatgcctacaatgtgccatccactgacttaaaatgttacttgtgttttcattaatcatcacaacatgcctatgagatacatactgttatttcccataaggaaacagcttagagggatgaagtaactagcccaagatcaaacacctaatgaattgcaaaactaattctcaaatcaaatctgttggattccaaagctagagtataatgtataatgtaataacaaaaacatctgtcttcctacaaagcagatagactaataaaatgtacactctcctgtttctttgccctggggccacacccttaactgggcaagccttcacttttggagactgaagtcctgctgtcctacttccttctgattgcacaagcaaggtagtctctgaagagttactgtaatgtcttgagtttgtctacaaagaacttgaactagattgtagtttatgccactaaggagctcactcactgaacaggttgtgatacattggtattgagatgagataataaatgttcagcctaagcctaacagtgggggtgggaaggtagcctggggtgggtaggagcatcttctctttctctctccttagacgcttttcattatcaaatcagttagctttaatgtgaacgtgttcgtttttgtgctagtgtgcaccaccagaacaggaggaaaaagggcaaaagtgagccaagttcataaactaccacagcaaatacagctcaaaaaaattaactactgttccataacattataacaggtttcaggctttttagaaacactgattatgcatctatgttaaaaagttagtagtgcttttctgataccttaatatattttgccctgaaattatattaattttctagtgccctctggatttgacagttgaatggtttggctcaaggtgtcacaaagtctgatccctacctctaatttagtaaaactttttttgtgtctcctaggccagaaaatcatactttaagttctataaatacttttatgattttttttttttttaagacaggatctcactgtgtcatccaggctggagtgcagtgatgtgatcacggctcactgcagtttcaacctcctgggctcaagtggatcctcccacctcagcctcctgagcacctgggacaacaggcttgcaccaccctgcctggctaatttttgtgggttttttggtagagacagtgtctcaccatgttgccaaggctggtctccaactcctgggctcaagcagtcctcccactttggcctcccaaagtgctgggattacaggcgtgaaccaccacacccagtgaggataattatttttattgcctgtaagtttaatattctaagtagaacaatactttttttcacttttttcctccttttaaaaattgagatataatttagtgaaactgtatatcagttctcatgtgtagaatgcagtgagtttgacaattgtatacacctgcatagttcacgtttctatcaagatagagaacatttccatcatgtcagaaactccatttgtgtgctttatcagtcattcctttcccaaccctgccagtctctggttaaccactcttctgattcctgtcccataggtggttttttcctgttccagacattcatataaacataatcatacagtagtattcatgtttaaaacataaatattttctattcatttatatatcagtctaagtgttttcatagctaatttgaaaatttgtaagaatatctcataacagtaacatactgcagtgctagtcttattatttagagaaatgtaagccactgactctactttaaggaaacaacctataagagtgcagattgccttcagctaactgtggtactactcttattaggtgtttgtatgctattttgataaatatctttccaaaattttcaagaagccagcgaaacagattgaagaaatgtcttctacatatatggtttggctttaatagctcatcagaaacaggatagtgttatatttgaatcttttaaaataaagttcagatagttcaacaatgactaaaaaaaaaaaatggccaaaaaatgtgaaaagactcagcctcattaataatgatgaaaagtacaggctgggcgtggtggctcatgcctgtaatcctagcactttgggaggctgaggcgggcggatcatgaggtcaggaattcgagaccagcctgaccaacatgatggaaccccatctctactaaaaatacaaaaattaactggacgtggtggtgtgcgcctgtaatcccagctacttgggaggctgcggcaggagaatcgcttgaacctgggagatggaggttatagtgagctgagatcaggcctctgcactccagcctgggtgacagagcaagactctgtctcaaaaaaaaaaaaaaaaatactaactaaaacattatgtctcatctatcagatcagaatattgatctgatgttgacaaggagaggatgttggaactcatatactaatattgagaatttaaattgttatgtcacttcatgggatgcagataccaaatttttatgtgaccatttctttagatagggctatcaatagactcttctacaaggataggaatgttctacatcctgcaccatgcagtatggtagctgctgactacatcaggctattgagcacttgaaatgtggctattacggctgaggaactgaattttattgtaattaatttaaatagtcatacgggatggctcacacctataatcccagcactctgggaggctgaggcaggcagatcacctaaggtcaggagttcgacccgagaccagcctggccaacatagtgaaaccccatctctaccaaaaattaaaaaattagccaggcctggtggcgggctcctgtaatcgcaactactcaggaggatgaggcaggagaattgcttgaacccaggaggtcgaggttgcagtgagccgagattgggccattgcactccagcctgggagacaagagcaaaactccgtctcagaaaataaataaatagtcacatgggccaggcatagtggctcattcctataatcccagcacttgggaggctgaggctggaggatcacttgagcccaggagtttgagaccagcctgggcaacatagtgagaccctgtctttccaaaaaaaaaaaaatttttttttaattaaaattttttaaaaagcctttaaaaataaaaataatcacgtgtggcacaagcctgtagccccaccactcaggaggctgaggtgggaggatccctggagcctgggaagtcaaggctgcagtgagccatgatcacgccactgcaccccagcctgtgcaacagagtgagaccttgtctcaaaatgaataaataaataattttaaaatcgtcacatgtggctagtaagtaccatattggacatgacagcattaacgctgattctcttgtagccatttatttcaaggaaattattagaaatatacacaaatgtatatacatagatgtgttgcagcatcattcataattttggaaagctagacaatgttaaacagggtatttgtagtatagtaaatttatttggtctttgtccctggttcctgttacagagccactagaacccttggaattttctgatagtgtagtgtatttttttgttattcttaatgtaccccttttgataacacctgagttcatcctaatgagataacttttaggatctggcctatctatagcctaaggaaggatggggccagtcaccaaaaagactaagtgattagagttttagagggttggaacttttggcaccacctaccaaaatccaggaaaggaggagggcaagtgctggagattaagctccattaaagcttttttcttcttgtgttttgagccaagtctcgctctgttgcccaggctggagtgcagaggtgcgatcatagttcactggaggcttcaacctcctgggctcaagcaatcctcctacatcaatgtcccaagtggctgggaccacaggcgccttccaccacaccttgctaaatttttttgtgtttgaaatgaagtcttactatgttgcccaggctggtctcgaactcctggactcaagcaatattcccatctcagcttcccacagtgctaggattacaggtgtgagctgctgcgcctggcctataaaaactcttgaactagaaatctgatgagcttccaggttgatgagcacatggaagtgttaagagggtagcacccagagagggcgtggcagctctgcaccccttctccctctacctttccctgtgtgtctcttcacctggctgttctatatcattcataatgtcctttgtaataaactactaagtgtaagtaaagtgtttcccagagttctgtgagccattctagcaaattattgaacccacagagagggtggtaagaaccctgtgctaaccattcagtcggaatcataggtcacaacctgggacttgtgattagtgtctgaagtggggccaggcttatgagactaaactcttaacctgtgggatcagacactgtctacctggagatagtgacagaactgaattgaattataggacactccgttggtgtccattggagaattgtttagtgtggaaaacactctcatctggtgtcagacctattgggagggtatagtaggagagaaaaatgtgttcttcccagagtattacttaaattttgttgttatatttatgtagtatacaatgcagttgttaaaggtaaatcttggccgggtgcagtggctcatgcctataatcccagcactttgggaggccaaggtgggcagaccactcaagaccaggaattcaagaccagcctggccaacatggtgaaaccccatctctactaaaaatacaaaaattagccaggtatggcggtgcacacctatagtcccagctacttagaaggctgaggcacgagaattgcttgaacctaggaggcggaggttgcagtgagccgagatcacgccactgcactccagcctgggtgacagaatgagactctgtctcaataaataaataaataatttaaaaaatttttttaaaaagatgaatcgtaggtattgacctgggaagctgcctgtaatataatgtcaaattaattaatcaggttatacaacagtgatgatttcttttaaggctatgtgaaaatatgtttatacatacaaatttgaaggatatacaccaaagtataagcagtaagtaactttgagaggtatgattattagggaattttaatttatatgtaatgcaattttgtaatatttgctttttttttcagtaagcctgtattacattattccattttaagaatataaataaataaaaattgattactttacaaccaaactgtgtgccctaccacaaaagcacatgaagctgacccctgatgatttgggaaagaagtgctattccgtacagggtctatgtagtattaaaggtttcttgttggacacaaccaaataatagtagccaaagtctgttaatcaagctaacttcacttgtcctgtggctgggaagataattcacgctcaagtgtagtgtcacttctcagcaggactcataaatcaagaataattgagggaggaaagcagttaagatttggtaaaaacaggaaaagctctcagagagtatagtgtattcgtgtgtttatttcagcagtaaatcttaactatttgtgaaagcttaaatgtagatataactacccacaggaatggaattttagctaacatttgagatgtactaggtatgtgaagcaaataactggttctgagaggcttggctaaggtgaaggacaaatgtagcagcagaagagaattgcaataataacattatgatacaaaaattctatcttagtgtgttggagctgctataacaaaataccttagactggataacttataaataatagaaatttattgctcataattctggaggctgagaagtccaagatcaaggtgccagcaattttagtgtctggtgagggcctcttccttacagatggcaccatttgtgtccctacatggcagcaggggcagggcagctcccttcaacctcttttattaggacactaatccattcatgaggttggaacccttatgacttaatcacatcccaaaaggacgcacctcttaataccaacacaatggggattatttcaacatgaattttggagggacacattcagaccatagcaagtgtttatagtattaggacctatggcacatactgcagaatgctagtattgattccataagaaaatcgccttttatggactgcttgtcacagtgcagtttcttaggtctcatgtgtaaatttcctaggtaattcatatgcacatgctgaggcttgaggaccactgtcacaggttttgcacaatcttccttcattaaatagctgttgaatgaatagcatctttttctcccccatgagagccaataattggccttataagttacagaaatttttttctcacatttattcaagtaatatttacatttcttccacccactagacattgtttgaggccctgagggatacagtggtgaacaagacagggtttctgttctctcattggagaattaggacaaaatgttaacatgaaggatgggttgggttggaaggatggtgctatggtttgaatgttttcctccaaaattcatgttgaacttaatcctcaatgtgtagtattaagaggtggagcctttagaaggtgattagaagaattagtatccttataaagtataccaataaaagacttgagggaacctgttgggcccttctactccccttccacaaagtgaggatgcagaaagaaggcaccatattgaagcaaagaacaagccccttaccagacgcgaaatctgctggtgccttgatcttggaatttccagcccctagagctgtgcaaaataaatttctattatttataaattactgagtctgttattttgttatagcaacctgactaagacaggtggagaggactgctttagattggctggtcaggaaagcctctctggagaggtggcctctcaacagagacttaggggagggtggcactgggagcagccaaatgtgtgaccgtctgagagggaagcattgcagacaaagagagcagttgaataaagccctaaagtaacaacaagtttggtgttttggcatgttcaaggaatggaagagccgatggctgaagcatgatgattaaggaagagagtgggctgatagtaggcaagggtctgattatggaatagttcctaagccgtagtaaagaacttgaagttttttccaagtgcagaaggaaacagatggataattttaagccagggagagacggaagttatttacattttaataagagaattcagttcttatacagagaatggaggggtatgaggatggaggagggacatgaatagaacatttgagcccaattaggctctaatgcagtagcccagtgaagatgatagtagcttgaactgtggatctgaagagaagtgtatgattttgggatatatttcagaggtaaagcagaccacacattgcagtggattcgattggcgggatggagtgagacgttagaatgattccttgtcttcagctactggatggatggtgtggcctttattaatatgaagaagatgaaggaactttgaacttatccaggttctggtgatttaattctttcctgcaaacaaacattttttatttgtaagccaaaatgcagatttagtcatttcaatgggtttgctccctttcactagtggtttgcaaatggtattcatttacatgtacacataagggatccaaaagtctgttgcttggtgaacatggattcagaatgcctggtatctgggattttaaaacattaggctctgaaagttttaaggattattctttaaggtcattttctctttaggaaccattatcaaagcttagaagtttcagtttagaacagatgttatatttcagtctcttccctctgtcatttttcctaaattccacattacttaatcttttggatttccatgtttctgccaccctattgcaccattttcataatctaattaatgttgtggctgtggatgtgtttgcagggaatactctcgattgcttccaaaaagttctcagtaacttcttccatagtggcctgcatagtcctgttaacgtcatgagcaacctttctgattttgttgtttcccttttctttcattctttttttttttttttttttttttgagatggatattccctctctgttgcccaagctggagtgcagcggtgcgatctctgctcactgcaacctccgcctcccggattcaagcgattctctctctgcctcccgagtagctggggctacaggcgtgtgccaccacacccagctaatttttgtatttttactagagactgggtttcaccatattggccaggctggtctcgaactcacatcatgatccacccacctcggcctcccaaagttctgggattataggcatgagccactgtgccctgcctcctgcctcccttttctttcatttcttgttttctttttgttgttgttgttttctgtttgtttattttgagacagagtcttgccctgtcgcccagactggagtacagtggcatgatcttggttcactgcaacctctgcctcccaggttcaagtgattctcctgcctcagcctcccaagtagctgggattacaggtgcccaccaccacacccagctaatttttgtatttttagtagagacggagtttcaccatgttggccaggctggtctcgaactcctgacctcaagtgatccgcccgccccagcctccttttctttcatttctaatgggcatcctttggaactaaggtggtcagttttaccaacttcttagagttaccactgttgaacttaatgctgtctacaaacgattaaatcaaatcctagaaggagcttagatttctgatcccaagtttgtttatttttatttttgtagaggccctttcacttggcctcccaaagtgctgggattacaggaatgaaccaccctgcctggcctgatgctaagtttaaaccagtggaaataagggttgcttgctctaaaacaggggtcgtcaacccccggccatgtactgataccagtctgtggcctgtaaggaacccagccacacagcaggaagtgagcagcaggctagtgagcgaagcttcatctgtatttacagccacttcccatcgcttgcattactgtctgagctccacctcatgtcatatccatggtagcattagattctcgtaggcttgtgaaccctgttgtgaattgcacatgcaagggatctgtgttgcctgctccttacaagaatctaatgcctgatagtctatcactgtctctcatcacccccaggtaggaccgtctagttgcaggaaaacaagcttagggctcccactgattctacattatggtgaattgtataactatttgattatatattacagtttaataattataaagtacacaataaatgtaatgtgcttgaatcattatgaacacccccttccccaagaccctagtccgtggaaaaatagttccccacaagagcagtccctggtgccaaaaagggtagggaccgctgctctaaaacatttggaagttagtgaggtgtgtttacattatttgctggcagaaaagttaaaatgacgttcagtatttcctgtgtttattaagaaaggtcactttgtgtagatcagtggtttccagactttattgtgtctaagcatcacaggaaatgtattaaccatgcacagcctgagaagtgtctgacaccacacacctgtgaggcaacaaccaggcatctgttttgttagcaagcctcccaggtaattttgatataggaagaactgtggccacaccatgggaaacagatccagatggacacagatgactaagcttccaaaacaagaagtattgacctaacccgtacattgactgcatccaacatcggaagaactgaataggaggttttcttttacctacatccgttgatcaaggtctaaaaacaacttgttgggccgaatttaagcagtcctgacatagaaaatttatttctgttaaagattgagttttgggaaatagaattttctgatttaagaaacaagggactatttccaagattaattcctcatagatcagtcatttttttcctcagaaggataacacctactgagaggcaggttctaactgtggcttagatccaaagatcctccctcatgcctcccctagaggacctgtaaaggtgacttgtggaaagaacagatatgtctttatgtatgtaaagcaagtgatatctgatttcaaagaagacaaaaccaaaagcttatttttttaatgataaggaattcccttcaaaataattatagaactgatgtccctagcccttccagtatttgcattccaagtgtagttttcttgtcccacctagataagactaaagcagaaagttttgttgcatgtgcctccactttccagcagttgagcaagtatgtacctctctttacgctctcttttactccagctattgatctctgggtactgtgatccctgggtactgtgcttggcataaagtgtatgccgttttattttgtagcaattacttcacaaaactgcagagggcagcagagagctgctgatagatttataatatggacataagcttgccggagtgagagtcttggttttccccctgtttgtctgttgagcacatgcttaccataggattatttaaatatgagattattttttaaatgtatttcatgcaagtttttaactatttaataatgatagatggggtatacacttataagctcaaagtcaagtgtgtttatgttgtattcactgacctaaagtaaaagaaataccctactcagccactgcattgtagtctgctgaagagtggtttatttataagggactagagaagcactttctaacattttgccatgctacccaggattttaaattatatcagttgaagttctctagcttggatttttgggttttttggagggtggtttttttgttgtcaattaaaaaattatattcaagctacttctaatattttaagaaagtgaatcaatccatttgaagctcttagcacaatgtttggcacataataagtattatgagttttagctcattgaatgagttacacagccatggaatcaggcatctaatatagtataggtaattaagcagataggggtactatgttagtaaataggaaattacaaggtaagattatagccaagtcatggatatttgctttacaggaagactcttcacttagcaatagtagcataccatttccatttttcatcctaactagtatttacagtaatttgtcttctttatagaatatcttctttatgtaaagaagtttataatatttaaatccttgatttgctaattttattcagaaaggacacttgtaatagtttccacctttatttctttgttagttaaatgaaaattaacccacatatgctacagattcggggtaattctagaaattgagttattcattcagcagacatttgttagtacctgcaattaatagacaaaattggccgggtgcagtggctcacgcctgtaatcccaacactttgggaggccgaggtgggcggatcacctgaggtcaagtttaagaccagcctgaccaacaaggtgaaaccccatctctactaaaaatacaaaaaaaatagcagggcctggtggtgtgcgcctataatcccagctannnnnnnnnnnnnnnnnnnnnnnnnncactccagcctgggcaacagaacaaaacactgtctcaaaaaaaaaaaaaacaattaggcaaaattggttttctttcttttttttttttttggaaatagagttttgctctgttgcccaggctggagtgcagtgacgcaatcatggctcattgtaacctctacctctggggctcaagtgatccttccccctcagcctcccaaatagctgggactacaggcataagccaccacgcccagctaattttttttatttttaggagagacacggtcttgctgtgttgcccaggctgaagttttcttgaagaatatggttttctctgtcaagaaacttataattcagctagggagacatgtaactctgcttacctttttattttaggtagtttcgtgttttatcacgaaacagatccagatggacacaggtgactaagcttccaaatacaaggctcaatggggacaaagccgtgtgcacaaggcatgtcacatgttgcctaatctttccactcctatgtgcttcttcttgtgcttcttctttttcttcttctttgctgccttgctgtcttttgatgtgtgccttgccctcttgcctgtatcattctcagagtctgagctgtcagagtcagatgacttccaattctttttcttctcctcctttctttttctagaaggattccttgtggggtcaggcttctcaaactctgctgactttgcctcttccttttcctcttcctcatcaggtatcagagagtatttggtcccacctggttgcatgaaacaatcttttgcaaagtggcctttacagccacacttcttgcaggtagtgttcaatcaatatactctggttagcatgtaagtgtggggggatgggcaatgggtagagccttctctgtgctgtgtacatagcacagtgcctacacattctgtgccataagtatgttgaaaaactctcattactgaggtaggggtttaatgtccttactggagactatatttagctcttgaaagataaaaattatttcccaggtggagagttctattttaactttttatttttgaaataacatttttcagaaagtagcaaaaaatagattccagcttcccttaattttaacagcttacatatccatagtgcagttatcaaaaccaggaaataaacattattacaacactataaactgcagaccttattcagatttcatcacattttccatgaacatcatcttttctgttccaggatccactgcatttagttttcatgttgccttagttttctctagttgatgacagttcctttatcttttttaagagagacagagtagcccaagctggagcacagtggcataatgatagcttactgcagcctcaaacttacgggctcaagtgatcctcctgcctcagcctccctcatagctgggaatacaggggcttgccatcacacccagctaaatttttttttttttttcaggatatggggttttgctttgttgccccggttggtctcaaactcgtgctcaagtgatgctaccacctcaagagtaacagtaataataatagaacagcctaagtcctgtggtccaagcccttgattcagtgaggaagaggtttgtttttgttttgttttgctttgtttttttgaaaccaggtcttgctctgtcccccaggctggggtgcagtggcacgattccataattccactgtagcctcaaattcctgggctccagtgatcctcccacctcagcctccagagtagctgggactgcaggcatgagccatcatgcccagctaatttttgtatttttatttttatttttttgttttgtttgtttttgagacgaagtctcactctgtcacccaggctgaagtgcagtggtgcaatctcagcccactgcaacctctgcctcccaggttctggtgattctcctgcctcagcctcccaagtagctgggattacaggcgcctgccaccacacctggctaatttttatatttttaatagagatggggtttgaccatgttggccaggctggtctcgaactcctgacctcaggcaatccacctgccttggcctcccaaagtgctgggatacaggtatgagccaccgcacctggcctaatttttgttttttagtagagacggggttttgccatgttgcccatgctggtctcaaactcttgagctcaagcaatccaccctccttggcctcccaaagtgctgggattacaggtatgggctaccacaccaagtgagatttatttttaacataggtctcgaaatgactataggtcagagctctggaactgaataacatgttttggagcagtgtcatccccttttcaaatgccctagttcttgacaccaagggaattaaaagtgactttttctttagaactatgaagcatataagttctgtgagttcacctttttgcagcagcttctgtgcattactcagttctacttcctgcaaacaattctttatttccacacctgtggaagacagtatggtcttgtagttaagaggatgaactttgttgttttgttttgttttgctttgctttgctttgttttatttaaaagatagggtctagcttcgttgccagtgcaactcctgggctcaagcgattctcccacctcagtccctcaagtacttgggactatagatgtgcaccacctcacctaaaaatatgaacttggaaatgttagatctgtcctagctctatcatttaacttggcgtaaagtgggatcataaggattaaatgattagcaggtaaaagcaatccggaactgttaactatagctagtaagtcagaattcggtgagcatagaccataaaatatttcaggtctagaatagaacttagaagagctctttaaaaatcatttttagatacttggttttctaaaggttgcaagcatacattccacagtgttatagaagtatgacaacctcaattatttagctccttcaagttatgaagaaaagttgtttggctagggatgtcggggtgagagaatttagaaaggagtacactggaagcttctgaggttctggcagtgttctctatcttaatttgtatagtagttttgtgaatgtatattttgcaacagtgtactaagctgtacatttctgtatgtttttccatatgtattgtacctctggttgtttaaagaatttctgatattggggtattgaaatcttcaactaatgttgtattgtctgttgctcctctgaattcagtcagtttttcctttatatattttatggttctgctgttagatacgaatacacttatagttgttatattttcccaatttgttgacctttttaccgttatgaaatatccccttttttggtctccagtaatgtatcttgtcttaaagcctgttttgtctgatagcacttcagctacttaaggttgctgtttacacagtatcttttttttatacttttattttcaacctgtatatgtctttgaatgtaaagtatgcatcctatagtcaacatataattgaatctttttaaatccagtgtgataatctctgctctttgagttgtttagtccattcatattttatctgcttgttgatatgtttggatttacattagtcatttgtcttttacaagtctcatgtgttctttattcctgttttttactgcctctttttgtattagataatattttctgcatgctattttaatactttggattttattaactatgcttactttttagctattttcttagtggttgctgtaggaattgtaatgcacatctttttatagtctactttagtttttcgggattcttttttttttttctttttctttttttgagacagggtctcactttgttgcccaggctggagtacaggggtgcaatcatggatcactgcggcctccacctccctgggctcaggtgatcctcccacctcagcctcctgagtagctggactacaggtgcacaccaccatgcccagctaatttttgtattttttgtacagatggggttttgccgtgttgcctaagctgttctcaaactcctgagttcaagcgatctgcctaccttggcctcccaaagtgctgaaattactggcaggagccactgtgcccagccctactttagtttaatagtacctaatttcagtgaaatatattgatagaagctttgctttagcatagctccatttcctctcctccacttcgaactatcgttgtcatgtacattttatcaatatatgttgtaaacctaaccactgagtgtcataattacagctttttataatcttttgtcttttaaagaaattaaagaagagagaaaataatattagagtcttatatctgcttaccgtttctgatgttcttcatttcctcctgtggttttgagtgaccatctactgtcatttcctccagcctgaaggactttaatatatttgtgaggcaggtttcacagcagtaaattttctttgttcattgtgaaagtctttatttttccttcatcttgaggtagttttgttaaatgtataatctttgttgaaaatttttctcattcacattttaagtatatcattacactgccttctggcctccactgttctggtgagaagtcagaaattaatagtcttgttctcttctatcatttttctcttgtggctttcacattttctctttgtctttttctctcaccactctgatactctggtgtcttcagatgtagatcttctattctacttgaggttcactgagatgagcttcttggatctttagattaacatttttcatcaaaattttaaagttatcagccttggccgggcgcggtggctcatgcctttaatcccagcactttgaggggccgaggcgagtggatcacgaggtcaggagatcgagaccatcctggctaacattgtgaaactctgtctctactaaaagtacaaaaaattggcctggtgtggtggcagttgcctgtagtcccagctactcgggaggctgaggcaggagaatggcgtgaacccgggaggcggagcttgcagtgagccaagatcacaccactgcactccagcataggcgacagagcaagactccgtctcaaaaaaaaaaaaaaaaaaagttatcagcctttatttcttcagatatttgttctgttcttctctttcttcccttcttctgggtcttccattcatgtcaagagggccctgttcatttttcttcagtctttttgttttcattctttggcttggataatttctttcgatacaacttcaagtttacttattctttttatttttattttgaagcaaggtcgcactctgtcacctaggctatagtgcagtggcacaatcatggcctcaacttcctgggctcaagcgatcctcccacctcagcctccagagtagctgaaaccacaggtgcgcaccaccacacatggctaatttttttggctttttgctagaaacagggtttcgccatgttgcccagaatggtctaaactcctgactcagccagttcgcccacctcgacctcccaaagtactgggattacaggtgtgagctactgcccctggcctgcccagttttgtggttggctttagggaaaaggatttgacaacctccttacttcaccacatcagaaattccacctatttttgaactgtataaataatttttttaattttcaaaaaatcagaaaagatgagaaaaaaactaagccttaaaattgaccataaacagaaacaagttaacataacaatcatgaatagattatatagaaaagataattccattaactttggacacagactcttgactgcaacaaaaccttgaactttacatagtaggttcattgttggtaatgatatttgtatagtaattttggaactcttgtttcttgtaggatagagcaaattagtaaagtggctattctgagaaccagagttttcactgtggaggaatgtgaggaagaatcctgggttgttggatttcacttgtatgtgttcttttgactcataagggtttcattttgtttaagatgtatttcctgggtttcttcactgaaagggcctaaaaggagtaataccctagtaacagtgaacacactaacacccagatctttgtttctaaacactattccacactaaaagaatccaggactcggctgaatggggtggctcatacctgtaatctcagcaccttgggaggctctggtgggaggatcacttgagcccaggagtttaagaccagcctaggcaacatagtgagacccccccatctctacaaaaaaaaaaaaaaaaaatagctaggcgtggtggtgtgcacctgtggtcctaggtactggggaagctgaggtgggaggattgcttgagcccaggaggttgaggctgcagtgagccatgatctctttagcctgggtagtaaagcgagaccctgactataaataaataaataagtaaaaattgatctaggactccttggagatatggcaaagtacagaatacaaagtacaaagtacaaagatatggaggtaggcaaagtacagaatactacacctggaatattatgtaaacctgcaacaaagttcacccttgggagaataaacccaggtaaaatgcccatgcagatcctggaagtgggctagggaggcttgaactggaaatcctagagaactcagtacctggagcatagtttaaaagggccgtatgggatatgggtggggcccaccagagaggagggccttgacaggagcctcttctgcccaggtctgagggccaaaaagcgctctacaacacatgaaaccatttaagcattaagtaacactccaaattttttgcagtgcttttattgtgtttataatttaaaacaatctgtgaggcagaattgaattacaaaatcaaaagcagtatgtacagtctgcattcaaagaaaggtaatgtgggaaaagaactgaaaggtggccccagggaggagctgtggtttgtactagactttgaaaactacagaaaatttggtgttagagaattaggaggaggatatggaagagttattccatggaaggacatgggggacacataagcaaacaaatggaatgagggataagcatggtaagctctgagagacaatagtgagatcagactgtctagcagagaggacttgtgttgcatagcttgagtaggttggaatagaagcttgatgtagtgtgaacaagagatttctgaatcttgatttttctcgtctgtaaaatgagtcaagacctccatgcccacctctcaaaattatcttgaaaaacaaatgagctgatgtatgtgacagcagattttcagcagtgaagcgctgtactggtataggttgtaatgaattttgaataccatgttgagaagtttacagttgtggtagtaactgttgaaataaactccgttcatcaagagcattggctgtttggggctctccttggcagttcctgtgatgatttacaatgcaggataatgtcactgtttccccctaagttttcagtgatggagaagaaagtactgagtaaacagccctataaaatttctttggtttccatttctatggaagtataattcaagatcagatgtttccctgtgaggcctctctggaatgtgttaaaaggcattgtggaggtatgtaagggttttaaccacattagaagcttctgttcatagaacagaacctggaaagactttcctctgatagtgctgcagaatatcagcactgccagctcacatatgtgtgaatgctcctggcacctagcacgctaaggaagacctatacactatctatcatatctatccttggattccaataatattgtactatatacctgtcatcctttggagaaagaatgtattcagcagaaaaaaactccagtctttgtactgggatcatcaattcagtctcggcacagctgggaaatagttcaactttctcctcaaagtgctatttttagctgtttccaaggagatgttcagcatgatactgataattgcattactcttaatttgcacaatctgtggagagggaagcagcagttctttttcaatgtttactactcagtgggccactgggttgtgatttatccgttgaaacaataggatgcctcacttagaataattgaccttagctcacacctgtaatcccagaactttgggaggccaaggcaggtgaatcacttgaggcctggagttcaagaccagcctgggtaacatggcaaaacccccatctctactaaaaatacaaaaaattagccaggtgtggtggtgcatgcctgtaaacacagctactcgggaggctgaggcacaagaatcacttgaatctgggaggcagaggttgcagtgagccaagatcatgccactgcactccagactgggtgatggagtgagactctgtctcaaaaaaaataaataaataaataaaaaataacctcagaattacattctggagcctttcgctttgctacctcaactttcagtccttcaagttataaaggcaagatgagggctgggcacactggctcacacctataatcccaacacactaggaggctgagatgagaagactgcttgagcccaggagttcaagaccaacctggccaacacagtaagaccccatctctactaaaaacagaaagaaattacctaggggcagtggtgcttgcttatagtccccgctactcaaaaggattgcttgagtccaggagttcaagtttacagtaaactcttatggtgccactgcactccagcctgggcaacagaaggagaccttgtctctgaaaataaaaataaagacatggtaagtatttctcgagctggctgctcaggccggcccgtagcactgattcctttctgtatacttgagacgtggttttgcccattgggaacttgatgttataaatttcccaaagaatgattggtctcctaaaacatgaacacacatacacacgcttacttcacaagagcctaatccggcaatctgattgattcatctgtgttcatagaatattcctaatgagttggctctgaagagaagattatagatcagaaaatagcttaagatttacagtcaatgctaaagaaattgaaaactcttaaagagtgggcattaagatctagtaacttgatgatttaacccctctctaaagaatttgtttcttaaataactgttaactgaatttgttatgttgtcttggctctccaacatccaacaccccttcctatttggaggaattctcttgtgttgtgatcttgttgagtggcagtaccccatgtctctcacttcatcctctgataaccaaggcttgtgatcgatgcttggtatattagatgcttctgaccaagatcttaaatctagattgagtgaagcaaagacaatggaatggttagagttgatttgctgtcattgcagccctgtcctggcaagtctttcactaaaagacatgcattctgcttcttaacagagcctccttgagttctacctgctttcttttttttttttttttttttttttttttttgagacggagtctcactctgtcgccaggctagagtgcagtggcgcggccttgactcactccagcctccgcctcccaggttcgagtgattctcctgcctcagactcctgagtagctgggactacaggcgcctgccaccacacccagctaatttttttttttgggggggtatttttagtagagacagggtttcactatgtcggccaggatggtctcaatctcttgacctcatgatctgcctgcctcagcctcccaaagtgctgggattacaggcgtgagccaccacgcccagccaagttctacctgctttctaagcctattcgttaagcctctcactgattctgtgagcactgataccttgccagtaaacctgccccctaaagttttttgcttaagatagtcttttgcttgcatccagtaaccctaatcaatacagtagagatcattacaatctaagcatctttcttatgggtagtactaggtaaatatggccatattcttatattttatttttttctgaattcctttagaatagcccttccctcagatacgttatatcttaaaatgaattgttatttgtacctgctgtgtgtctggcacatagtacgtaccataaaaattagattcactctatacttaccttttagtttcctcactgagattcatcaagtgctctgtttaatccatagtgtaataataagacatttgggaaatacccggtctcatcaatagcatattgacaaatcttttccagagaaagaatgtttttattttggttcctgtattaatccattttcacactgctattaagaattgcctgagagtgggtgatttataaacaaaagaggttgaattgactcacagttccacatggctatagaggcctcaggaaacttaacaatcatggcggaaagtgaagagaaagctgatggttttaaagtgtggcacttgaaaaccatcagttctcatgaaagtgaactcactatcatgagaacaacatgggggaaccgtccccatgatccagggtccgtcccttgacccgtggggatatttgggtaggaacacagatcatatcagttcctcatgttaaaaggaccaattgtttaggttccaggcttctcttgtgcatgaaataccctgctaactgtatttcctccctttgaaattacttaatcagaatgctaactgtatttcctccctttgaaattacttaatcagaagcttcaagaaggaggaaagagcccagcacagtggtgtgcacctatagtcccatctactcaggaggctgaggcagaaggatcacttgagtccaagagttcaaggttatagtgtgtgttgatcacatctgtgaatagacactgcactctagcctggacaacatagtgagaccctatctctttttttttttttttttttttaagggactttggtagattttctgtttttggggtttttttgttgtttttgttttaaagcactgtcaaaaggtggcaggcatacagactcttctggtttggcttgtgccagttatattgttaagatgttccacaaaaaagtgcacacactcagcatgcgtctactttgctttgcaggataacattctctcagcctttgtgtttgatgagtttttggccatctatgtgagtttctgagttgtttgaataagctaagaaaagacagacttatttatttaggtttcttcacattttcctatgttaacctgctaacagtatactgccctaaccctacagacttggcttgtacccacaaatgtgctctcctagcatactgtgtctccttcatgacacaaaccatgaagggttcttataaggattaaagtacttatttcacagaaaataatagcttatttattgagcccttatttgctagtcactgtatgggcagctttatgtatattatgacattaatccattaaacagtagtccataatactattaaagcttcatttttgaaatgaagaaactaaggctcagaaagattctgaaacttgtccgaggccacataactagtaagtactagaagctacaatttgaatttacactggtatgcacaccagtgggtatgttatttagtttcatttctgagtaagtagaaattaagtgatactgtaattatcattccattgcaaaagatagaaacatagaaagcaaaggacatgccaagaagacctacattttttgttttaaacatcaagaatgcaattgataattagcctgatggtcatgtgttttttttcctctatcactgtacaaggttttggtgaaactgatgcagttctcaaaagtcagactgttgcctattaaatagacttgtgcataaggaaagctcacctttttgttcacttataataatattgtgagaaattatgtaattctctgatgtctttcagaaaagaagagaagagagcactagactaaaggaggagggaaatgaacagtttaagaaaggaggtaagacgactttcagcactgataatctggtcatcttgactcctcatcctgttgtagagtctgtgaagaaaccccaaagaacatctgaagaaaccccaaaaccagacttcacaatacagtgttgcttcccagtaccttggcattttgagtttttaaccaggccaaattattcatctgatggtgaccagttaccatttgtctcttggcacatgcatagtctttctgtaatccactatctgttagtctagaatcaggggtaaaactcttgagctcttgctttggaaaacactaacctggaatattaaaggttatgtgctgcattgctgtgaaagcagagtcgccgctcctcacttgctgtggggctgtgaaagcagcctgactgctctggtatggcctagggctgcctgtcctttggttgctctttctttctttctttctttttttaaattctccaaactgcttcagaaaggttgctctttcatgtgccattttctttggatgccttaagtagggagattcttcatgtccttctgcattttctacatttgcttagaaataagttggtggggttcattctgataatttggggtaactatttgatcttagagcaaaagtcttctgtcacatcttaaagtgtatatgcttcagaaatctaggagtgttaacattttccgctagttattttcaggtttttaatttttttcttattgttttccaaaagttaccctattacctgatttcagattttagggtttttttttttttcctatatcttggtttagtaatcattaatactgttttctaatagaataaacacttctaattttggaagcatattttttgtatgttaatattaaatatttcaaacctgagaaaggagtacataggcaattttctattagtatcctgaccataattctctttttcaccattttctcttttaaggtcttgatttaaatattgatttttacattgttccttttagctctatcaaatgtctctcttcaaacatttcacggatgctgttttagccaggttgactgtatgaaagcacaacagatttaatgaaaacaaatatgtataatttttttctttatctcaggccatggatcccagagtttagtctctttcctctgtccagttctgtaacctcctttgaaaactcctttctgaattgcccagccaaatgaaaactgaacattgagggaatgccaggactcctgagtattgagggcttgtcactgacagcatgttcagctgtcagttcaccaagcacagcctgtgagattggcacaagcaagcactgttcctttaaagagagaagaaaagaagaaatgatttttactgcgccagacttaatagactgttaccatcttttaactcaaaaccttcatcctatgaatggaaaacagtgcttctgagatcctgtggaatatagtagtatcaggaataaaatcaaaatgaccattcatcctttctcttatcctcagattatatagaagctgaaagttcttatagtcgagccctcgaaatgtgcccatcctgcttccaaaaggagaggtcgattctattttcaaatagagctgcagcaaggatgaaacaggtatgtatctgtgaccttttctttttaaaaagcacatggacttgcagtcttttcataccatagtttctctccagaaactagcatagaggttgctgcctcccttttcctgcccatatatttccctgatgtaaaggccacagggagaatagaaaatcttttgaaaaacttgagtcagattactgttaacattccccattaaagtagctgagtgaatactttcatggaaggagggctggcaaattttttgctaaactaggtcaggttaatgaagcaatgagccaagcagtgcatgtcctagaatagctctagatccttattttaggcctctggaattctagataaacatgcaaaggcacagggaaacactggtaaaaactctgggctttaaagcatctttaaagatggttattcccaggattctgacttttctgttcaaagtatggacacttggagaaatctccaacagctgggataaaaggtacccttaaatgcaaaataggtgtcaaggaactttgaaaacattttgtatttccaaaggactgagaacctagtataacaaggtgagtatggaataggtgagagtacaaatatatttgttttataccatgaccttattaaaagttagatttgggccagatgcagtggctcacacccgtaaacccagcactatgggtggccgaggcgggcacatcacctgagatcaggagttcgagaccagcctggccaacatggtcaaaccccatctctactaaaaatacaaaaattagccaggcatggtggtgggcacctgtaatcccatctactcaagaagctgaggcaggagagtcgctgaagcctggaggcagaggttgcagtgcactgcactctggcctgggcgacaagagcaaaactctgtctcaaaaaaaaagttagatttgtttctgatttgtctgattttcctatttagtcttcataatccttggattgaaatgagagtggttttttttttttttaaaccataccactttttaaactatggctacttacatccaaagtacaaaggataggttatttaacatacctttaagcaaccatgatgctggctcaagattggaagtggcagtgttttcatttgtttgtttagatcagatatctctttgatactgtctgaaattctcaaatgcctctaccacagtcactttaggtgacaaggttttttttgttgttgttgttttttttaaaggccccagggcagggttgcgggggtgggtgcttgaatgcttggacatgcagaaaggttacggttttttttttttaccagaacttgtgtaagattcaatcttcaaagcagagtatttttggagtatttcatgtggcatgagagaagaaataattttatagtatacaaaccaacattttgtattagagaaaacaaaacaattggtttaactttatttaaaacaatattcattaatgtgtcccaccagcaatcagaattaacatctaacagtttttacacttacctggaaaattctgatcttttagatttgcttctcccttttgccacatttttagactggacattgtcattgtgaaataggatcaaggatgtgccttcagtatcagaggaaatgcaccatacccagttggctcctgggatttgggattctttgtttctacagttgcccaagttattgatatttctaggtttgggctcacataaatagtctggttcttgagttaggaaaatgtatggtcttgttagtattttgtctgtcacatctgaggagaactcaaaagagcgttgctctatgattgttgcctgttcaaagaatagttttgttggtgaagttttctgttcttttaagttgcgtttctttttttttttttttttttttgagacggagtctcactctgtcacctaggctggagtgcagtggtgtgatctcggctcactgcaacctccgcctcccgtgttcaagcgattctcctgcctcagcctcctgagtagctgggattacaagtgcgcgccaccacgccaggctaatttttgtatttttagtagagacagagtttcaccatgttggtcaagctggtctcaaactcctgacctcgtgatccgcccacctcagcttcccaaagtgctgggattacaggcgtgagccgccgtccccggccttaagttgcatttttaatactttatgaagactctaaaatgagagacttgataacttctaggattagtaccctgacacaatttaaggagcatattatattctaagtttttcaaggaaatgatggtttaactgctttaagaggtaaagatgaagaatttctgaaaggcaggtttgcaagctcagcatccctgactcagtgcccctggccacgcttcacatttcatatctggagagagaaaaggtaacctggagctagggcagagtttcagctctaggtctcgctagctatacaagagcagagccctaaaagagtaggttctctttttttttttttttttaactactgtccttatatattatatacattgttttatatgtatagttagatttgtttgtccttatatgctgtgtacatttgttttgtcactatatattatgtatactgttttatatagatagatagctacctatatataaaaattatgaaagaatggtaaagttgtgatttttttttttttcccacacactccactttggggactaccattgtaagcagcagacaacacctgggtcctctgaggtattagtagactatgagcctcaaacaaaagtttctgcaataaaattccataattccttgatttgaggagacagtggataagatgcactacagcttaataatcacttctaggcacacaaagaataccatcacaacagttgtacacataaattgtaaagatttatttctatttcagaaactgtgaaattgtgtgtctttgacttatagaaatgtgataagttgaaaaaatattgacttatataaagttatacagattacttacaggacttcttagagtttttgatatttgaattggtatgctgaacattgaaagagaaataaaaaaaggtcccagatgaccctgaaaccttttttgttttgtttattgtggtaaaatacagataacataaagttggccattttaaagtacagtcatgagtcacttaacaacgggtatacattctgagaaatgtgttattaggtgatttcatcattgtgcaaacatcatagagtatacttacacaaatctggatggtatggcctactacacacctaagctatatggtataacctattgctcctgggctacaaacctgtacagcatgtttctgcactgaattactataggcagttggaacacaatggtaagtatttgtgtatctaaaaagaaaaggtgcagtaaaaatgcagtattttttaaatggtgcatctatatatatagatacataaacacacacacatatgtatacacacacacacacacatacatataccgtgtatgccatgaatggatcttgcaggactggaaattgctctgggtgagtcagtgagtgagtggtgagtgaatgtgaaggcctaggacattacactactgtagacttcataaatatcttacatttaggcttcactaaatttatttttttaatttttctttaataaattcaccttggtttactgtgccttgttttctttataaacttttaaatttttttaaactcttttataataacagcctaaaacataaacatgttgtacaactacaaaaatattttctttatgtccttttctcttctgagctggggcagggtcttgctctgttgcccaggctggagtgcaatggcacagtcatcgctcactacagccttgaactcctggactcatgcgatcctcccacctcagcctctccagcagctgggtagctgggactacagacctgcactaccactcccagctaattttgtttggttttcttttaattttttttttttaatttttttagaaatggggtcttgtgtttcacagattagtcttgaactcctggcctcaagtggtcctcctgctttagcctcccgaatcactggaattataggcgtgagctactgtgcccagctatatctttattctatatacttttttctattaaataattttttttttttttactttttaaacttttctgttgaaaactaggatgcaaatacacacagtagcctaggcctacacaggatcaggagcatcagtatcactgtcttccagctccacatctagtcccactggaaggtcctcaagagcgacacatacatgaaactgtcatctccatctcctatgataaaaatgccctgttctggaatacttccatacttccgataggacctgcctgaggctgtttgacagtacacttttttttagtagaaggagtacactcttaacataataaaaagtagtgtatagtaaatacataaaccaataacagccatttattatcaagtattatgtatgtattatgctttctttcttttttttttttttttggagatagagttactctgttgcctaggctgtagtacaatggcgctgtctcagctcactgcaacctctgcctcccggtttcaagcaattctcctgcgtcagcctcttaggtagctgggattacaggtgtgtgccaccatgcccagctaatttttttgtattttttctagagatggggtttcaccatgttagccaggctggtcttgaactcctgacctcaggtgatccgcccaccttgacctcccaaagtgctgagattacaggcataagccaccatgcccggcctgtgttatattttcacatgacttgcagtgcagtaggtttgtttaccccagcatcacaccaacacctgagtagtaggttatgccatgatgttatgacggctactatgtcattaggtgataggaatttttcagctccgttatactcctatgggactactgttttatacacagtctatcattgattgaaacgtcattgtacagtgcatgactgtatacaattctgtggattaaaataccttcacagtgttatacagccaacaccactatctagttccagaacttttccatcatcctaaaaggatcctccacactcctgaaactttttttttattttctgagatggagtcttgctctgttgcccaggcttgagtgcagtgtcgtgaactcaacttactgcaatctccacctcctggtttcaagcaattctcctgcctcagcctcccaagtagctgggactacaggcacccaccaccacacccggctaatttttgtattcttagcagatacagggtttcaccatgttggccaggctggtctcgaactcctgacctctagtgatccgcccaccttggtcctccaaaatgctgggattacaggcatgagccgctgcgtccagccctgaaactgcttttgattgaatcctgaaacagtttggctgtcactgctgtgaaatattctgcaaaatatttagtatttgctacagtaggcattgtgagaatattgaacacttatttgaaataccttatttctgtaatacaaaaattcctaatttcaggaaaatggacattttagacctgcaagacatcttatataacatccagtctaccccgctcctattttagatgagacaaactgagccctagagaaggaaaatagcatgggcaatgttaaagagcaggttattgtcaaagccaggaccagaattcagttctttgacatccagtgttctttccgctatgtcatgcttctagattcagaaactaattgagttagatattttgtttaagagttgtgtatttttgtttgatcagtggataaattaaggtttataactgagactacatgacaagccacactgtgtgtctgtaggtggagcatctgtatactttctgaaatataccactttggggtatgatagtataaccactagccagagaggagggtaattcagttattcacatgtcagtcatttgccctgttttaggtcacaaagtttctcagtgtcagcattctaatgtaaagtgtcttgcaaatgtaataggtcagttagaacaaaagacactttcagaaaaaagcgacttgaataagtgttaccaggaggccttcagatcagagccatccccatccccgtgttaattttgagttttgtcttggaagtaacattcaggtttttacgtaatttctttgaaaaccattctgtatctccataagcagttattagtgatcagatcatgtcattaagcctttgggccattaagataaaactagggcaacacatattaatactgtttttctttttaggacaagaaagaaatggccatcaatgactgcagcaaaggtacagctttattatcttattacatgttaacatacaggagcattatgtcagacagaggggctttgggtcaggtgtgcacttgtacatgtgtacccttcctctggggccttgcaagaggcaactttataattattttcaaagatactatataatagagtaactgcttttgaatggatagttcaatcagtttctcctctactggtaaatacatgaagaaaaattcagtgctctagcctgggcaacatgacaaaaccctgtctgtaccaaaaatacgaaagttaggcatatgtggtggcatgcccctgtagtcccagctactcgggaggctgaagtggatcacctgagcccaggaggttggggctgtggtgagccgtgattatgccacttactccagcctgggtaacagagtgaccctgtctccaaaagaaaaaagaaaacttcagtgctctcttggcaacagaactcatggaatagaatttacctcctgtagtctctgaattacattctgttgagattcaaagtgaagatcatagctgctattagagcatttggatctgtgtgttttgagaagggggacaactgtgatgagggacagtttctgttggtgaattgatagtcttttcaagtgtcataattcttccaaacctacttcacatcatttttttttaaccctttcagattctacacaatgaatcaagcctttgctatatgatatctaagttctattaaggtcttatcaccccactaacttttatagggacacctcagacatagggtcactacagtttttttgtgttttggggttgttttgttttgtttttcaaaaattgcctgataggccagacaggtgccttgcctttctcaccaacttcatgtgaagaatgtacataatcactttttcttgcggcttagtctcagaagtttttctagcaaatcactatttttgtgttttctatttttttagtttttcttctttggataatagtttctgggacaattatagagtgcaagagaaccttatatgttatctagatcccctgtcacgctaagcatatattcccctgctgttaccaaaaaggggtcctgatccagaccccaagagaggattcctggacctctcacaggaaataattcagggcaagtccataaagtgaaaaagcaagtttattagagaaataaagaaacaaaagaatggctactccataggcagagcagcaatgtgggctgctcagtaaagtatacttacagttatttctcaattatatgctaagcaaggggtggattactcatgagatttccaagaatggggcagagatttcccagaactgagggtccctcccctttttagaatatatagggtaacttctgaatgttgccatggcatttgtaaactattgtggtgctggtggggatgtcttttagcatgttaatgcattataatttgcatttagggagcagtgaggatgaccagaggtcacttccatcgccatcttggctttggtgggctttggccagcctctttactgcatcctgttctgtcagcagggtctttgtgacctgtatcttgtgccaacctcctgtctcatcctgtgactaagaatgccttaacctcctgggaatgcagcccagtaggtctcagccttattttacccagcccctattcaagatggagccactttgattcagatgcctctgacactctaattttttatttaattaatttggtgccctctctactggctttcttttctttatatttggtatttccttatagtatctgaatgaaactctttctatattataatatagaagaccacttctgatgtgttaccaagttggactggaactaactctgaatgtactgttttgtttggaagaagttatttaacctatttcctttatgtgaggatgtgtgggtttgggaagtttaaattaggaacaagctgctggttttcaaagcttctttctctgtaaccaaatggtgaaaaaatgccttgtaagcgtgattagcatggtatgttgtaagaaatagttcatttccatatgaaacagtttacttccagctgcagcccgaagtgtaggagccttgcctagaaaatgagggaaaggagaagaaagtgttttccaaccaaagtgttttccgcatttgtttttggatttgcttaaactaatatttatgtgggttagacatggtcattatggatacatgcattgtattcataggcaaattacatttatatcaatatgggttgtttgtattgagagcccccgacatcccccaccctccacacacacacacacacacacacacacacacacacacacacacacacacacacacacacatacacactctctctctctctctctctctctctctctctccccctcccctctctcaatctctcaattcataaaccttggcaaagaacttagcttatttctgaggtcatattggagctccagggttttcatccttgacataaagtttaagttcattctcacctcagtctcctaagtagctgggactacaggtgcacgccaccacacccagctaactttttttattttttattttttattttattttttgggacagagactcgctctgttgcctaggctggagtgcagtggtgccatcttggctcactgcaacctctgcctcccaggttcaagcgactcttctgcctcagcctcctgaatagctgggactacgggcgcatgccaccatgcccggctaatttttgtatttttggtagagacagggtttcaccatattggccaggctgctctcgaactcctgacctcgtgatctgcctgcctcgtcctcccaaagtgctgagattacaggcatgagccactgcccccagctcaagattagggttctttcagaaaaccttctcctgacccaatattctccttcaattgctgtaccatttatctgatccctttcattgaaataattgtctatacttggctgtctctactttgtcttatcctatttttctccttacttcacttccatggagcatttgttttatccatgccattgaaacccatcttgtaaaggtcatcagcagtttcatcttgctcaatttagtcgttgcttctctagcctaactttacttgaccttacctgcatttaatacagtttatcattcctttctcctttaaaattctctctcttaaatttaatgaactctattcattttttccctgcttcattggctattccttcttattctcctctgttagcttttatgtcaacttcaacattttggaagtctctagatcttagttgagcgtgggaccctcttctttttttttcccctctgtattttctccctaagtgatctcattcagttctgaagctttaaatactatctataaattagcacaatgtagccattccaccttgtgtgtatatttcaaaacatgttatgttatatttatgtttatgttatataccataaatatacacaatttttatttgtcattttaaaagttaaattaagacagaaggaaaatgcacggattttttaacctaagaaattagagcaacaggccgggcacagtggctcacgcctgtaatcccaacactttgggaggctgaggctggtggatcatgaggtcaggagtttgagaccagcctgatcattatggtgaaaccctgtctctactaaaagtacaaaaattagcagggcatggcggcacgtgcctgtaatcccagctactcaggaggctgaggcaggagaatcacttgaacctgggaggtggaggttgcagtgagccgagatcacgccattacactccagcctgggtgacagagcaagattccgtctaaaaaaaagaaattggagcaacaaaaatgcaattaagggaaacaaaaggagtattttcataaagataaaagccaaaattcatgaattttaaaatataaaactaataaatacatgccatgtgtatggcagagtttctgtcttcaactctgacttctaccctgtagtctagtgtcctgtatcccactgcaaagttctttcttcttggatgtctggtaggcacctcagatttaacgtgcccagcccccacacacacacaaaacttgcagttagttttttccattctaataaatgacattaccatctgtccccttgcttaagttaaacctttggagtcatccctgattgttctttcgtgtcacatggctaattgattaattagcaagttccatgggctcaaatttaaagacatatttaatgtaatccggctgctgttttccatctctactacttccagcttagaccaagccaacatcttctctcatctggaccactgcattagctttccagctgatctcacagctttcagtcttgccccacccgccaacactacagccaaagcagtccttcaaaaatgtaaatcagagtatgtctgaagcttgcttgaaaactttccagtggcttctcatcacactgaggaaaaagtccaaactcctttccctggccaggaaggtcctccatggccctacatttcagcctctgatccccagcctgataactcacatgccagagttattcttgttggtccctcttcctggcacgctcctccttagcctttcacatggctggcctctctcacatagtccctcttcatattctgagaccactttctgaagttacctcatttctcgcttcacttgtatttccatgaccttgttttatttttcattatagtactatggctattgaaattatatacctgtctgttcttgcctactagaatagcataaggcttcatgagaacaaggactgtgtctgtcttgtttcccactatagcccagagacatactacattggacgtatatattaagtactaaataaatgttcacagaaagcatgaatttaaaaattaaggatagattatgagaaaagaaaaaagttctagagccaagacattgcctttttttttttttttttttttttctttttttttttggagacaagagtattatctctctgttgcccaggctgaattgcaatggtgtgatcttggctcactggacgcaacctccacctcctgggttcaagtgattctcctgcctcagcctccagagtagctgggattacaggcgtgtgccatcatgcccagttaatttttgtattattaatagagacagggtatcaccatgttggccaagctggtctcaaactcctcacctcaggtgactcgcctgcctcagcctcccaaagtgctgggattacaagtgtgagccaccgcgcctggcctttgttttgagatggagtctcactctgtcacccaggctggagtgcagtggcatgatctcagctcagtgcaacctccacctcctgggttcaagtgaatctcctgcctcagcctcccgagtagctgggattacaggtgcccgccaccacgcccggctaatttttgtatttttagtagagacgggggtttcaccatgttggtcaggctggtctctaactcctgacctcaggtaatctgcctacctcggcgtctcaaagtgctgggattatgggcatgagccaccgtgcccagcctgtttttgtatcttttgtagagatgagggtctcactgtgttgctcaggctgatctcgtgctcctgggctcaagcgatcctctgattttggcctcccaaaatgctgggattacaggcataagccattgcagccagccagctatattttcatccaaatgaaaccttgagattgagcacagacatgatgactgccagtccgtttcagagactaggctggaactcagggctactgagtttgtgctcttttttttttttttttttttttttttttttgacagagtctccctctgttacccaggctggagtacagtgacatgatctcagctctctgcatcctctgcgccccaccgggttcaagtgattcttctgcctcagcctcctgagtagctgggactacagacacatgccagcacgcctggctaattttttgtattttttagtagagatggggtttcaccatattggccaggctggtctcgaactcctgacttcgtgatccgcctcggcctcccagagtgctgggattataggcgtgagccactgcactcggccacacctggctaattttaaaattttttgtagagatgggggtcttaccatgttgctcaggcgtggttgaactcttttttttttttttttttttacccttgagacagagtctcgctctgttgcctagnnnnnnnnnnnnnnnnnnnntttttttttttttttttttttgggacagaaatattatctctctgttgcccgggctgggagtacagtgatgcaatcgccactcactgcacgcaacctccgcctcctgggttcaagtgattcttatgcctaaaccacccaaatagctgggattatagacccacactgccacgcccagctaatttttgtatttttagtagtgatggggtttcgccatgttggctaggctgacggtctcaaagtcctgaccccaattgacctgcctgcctcggcctcccaaagtgctgggattatgggcctgagccaccacacccggccagcactgctttctagtagaaaaagaaacaacttggaagaaattagaagaaatgcagtatgttgaaccaaaacatagcaaaggattattagaagggcagctgatgctggataaaggaaaagatattatgcatcaaccacctcatagtgctggagcagtagtttgagggttgaaggaacagtgaggatttaactagaaatataatcttagtactcaagacctagaaaaaagagaatgatagtctgccaccagattggtttcccttaactctttaatttgtatcttcaaattctctctcacctagcctggccaacataatgaaaccccatctctactaaaaatacaaaaattagccgggcatggtggcgcatgcctgtaatcccagctacgtgggaggctgaggtaggagaatcgcttgaacctgggaggaggtggttgtagtgagccaagatcacaccactgcactccagcctgggcgacagagcgagactccgtctaaaaaaaaaaattctctctcactctttcactgcgcacttgaactctgttctggcctgtcctggactgggcaaatgacaagtaggcaaaaaccaggacttggagtatagaccaggatatggcaaactacagccacaagccaaatccagcctgccacctgtttttgatagcctaaaagctaagaatggtttttacagttttaaatcattggaaagcaaaatatttcatgataatgtgaaaattatgtgaacttaaattttagtgtccataaatagtttattggaacacacctatccttttttgtttacatattatctgtgcctgctctcgtgctacaatagtatcattgaggagctgcgacacagatggtctgtctgacccacaaagcctacaatctttactatcttgctctttatagaaaaagttttccagcatcaggtatacacttggcaaatgactcttcctttcgtatccttggaggatgattgatgaaggaatctgatatagccaaagatatgtaggccatttttctttgtgataaaaattatttcttctctttttacagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatggtaaaacctaaaattttaaaaatatttttccttctattctttgtgttgctacccagtgagtcctaaataatcctttcagacacaattaaattccatttctgtgcttttgaggagcttatcaagatatatgggaggccaggcgcagtggctcttgcctgtaatcccagcactttaggaggccaaggaggagagatcacttgaggccaggagctcgagaccagcctggccaacacaacaaaaccccatctcttctaaaaatacaaaaaattagccgggtgtggtcgtacacatctgtaatcctagctactcgggaggcaggagaattgcttgaacccagaaggcagaggttgcagtgagctgagatcatgccactacactgcagcctgggcaacagagaggatcattgagcccaggagttggaggctgcagtgagctgtgactacatcactgcattccatcatgggcaacagagtaagactttgtatcttaaaaacaaaccaacaggctgggtgcagtggctcacgcctgtactcccagcactttgggaggccgaggagggcggatcacctgaggtcgggagttcgagaccagcctgaccaacatggagaaaccctgtctctactaaaaatacaaaattagctgggtgtggtggcacatgcctgtaatcccagctactcgagaggctgaggcaggagaatcgcttgaacccaggaggtggaggttgcagtgagctgagattgcgccactgcactccagtctgggcgacagtgtgagactctgtcttaaaaaaacaaaaaatacaaatgaatttaaaaaaaagttaaaaatacaaatatagcactgtaaacatctgatatgtatcctttcaaacttttttctgtatatatttatttgttaaatttgtattgatgccctcctttagtgtagactttctattaagaactggaaacagagccaaacaaaacttttttttttttttttttttgagaaagggtctctgactcccaggctggagagcagtggcacagtcatggcatactgcaccctcaacctcccagattcaagcaaccctcccacctcagcctcctgagtagctgcgactacagacacatgccaacacacccagctaatttttgtatttcttgtagagacagcattttgccatgttgcccaaggtggtctcaaactcctgagctcaagcgatcctcccaactcggcctccaaaagtgctgggaatatgggcaggagtcactgcacctggcccaaacagaacttttgtctttatgtagcgcaccacaaacataaatacttggggtttttttttttttatttaataggatcatagacatacttaacttgatcttatttccacattaggattcttgtgtttctcaaattcaaaataaagggaaaggttttggttttttttttttttttaccaacccttgtttctcctcttttcctcagagattacctaagcaaattgaagaacgtaatgaaagactaaaagaagagatgttaggtaagcttacttcttactttgcttgatcataaacagctaggaacctagggtggggacatagcgaatactagaggagaacacatgagttagaaagtttcggactctaccacaaggctactgacttctgagttattttgaccccagaaggggcagcgtggcttagagagggtattggctttttttggaaaccagatttcctttttgattttcttggaaatttttcttgcctgcaagaatttaagcataattcagttccctgggattatgcttaaatgggatttaaaatcctaggataccaccaacctcgatttcagataacaattacataaaaacagtttagtttcttcattaaataatcattccttgaggttcattaggatgcagtcaagatcatgagaatttttatttagaaaatggcactcaaagtccctttagtgtttgagaacacacgagagggcaggaattaggagtaaagagaaatcagactgggggtaggggtagggcaaatggattcatttgatccatgtttagttatttctcatatttgccaaagcattttagagttggaacctcccacgagcaatctgcttaagtaagaggagtgagggttcctgaacacagacttaagtcttttccacatgtaacctgtctgatatttcgctggtgaagatctgccatgtattttcctttttgagtattttctaaatctgttgtttgaattacattttataaactgcaatcatgtggccctaaaggaaaaatcatttaaaataaattgagcctgtctggcatttatggccttcagacatcagcatccagacaatgggaacaaatttcccaaaggatcattctgatagccaagttgattgagaggaggccattaacctagactatccagagactttggcccctgccgggtagactcagactgtaaagacggctgcttccgattcaggatagctctggagccttccccagattttccaaaaaagggagggggatgggggagcttttcccctaatttacatatttaattaaacttggccaggcacggtggctcctgtaatcccagcactttaggaggccaaggtaggaggattgcttgagcccaggagttcaaggccagcctaggcaacatggtgaaaccccatctccacaaaaaattagtcaggcatggtggcatgtgcctgcccatagtcccagctacatgggaggatcacttgagcccaagggttagaggctgcagtgagctatgatggtgccaccacactccagactgggcaacagagcatgaccctgtctcaaagaagagggaaaagagcattttctcacctatttttactaacaatgatgctctattttagcaaaaaaaaaaaaaaaaaaaaaaaaaaaaactgtttgcatttagtatttgaatttcttgctaaaaaagatgaccttgtgaatggccatagtggatctggaaggcattggtctcttagtccatttttttaaagccagtccagtaaagggactggtgcaaactgaatcttactgcctattgttagttccagatggaattaaaacttccatttgtccttgtctttataaattctaatgcaccagaattttctgtctccaaggctttgggtttttcttatgtcattctcttcatttgaaaaaattcaaattgaattcattccctcggttgcttctaaaatgaattcacctgccattagacttaaccaacttaagttgctttgtaaataatatgtgttgttacacatgtgtagtttgaatggctagattccttttttcccttaatgagtataaaaatcatgaataagatactgctctaggtgttaccccacaatagataacctagaagagagaaatcactctttacatggaatttcagcccccacaagagcttttctggtattccttcctccttgttgctgatgaggtaactttggttcatgttctgtgagattccctagaggctagacattctgaatgcaaattaatatcacttagaagttctgagcaagcttttcacagtggactgcatcatctttatgctagttcctgttaaaatgatggcttctatggagaataagcagttaaaaattttttaaattgggtagtgtgggctgggtgtggtggctcacacctgtaatcccagcaatttgggaggctgagcccgagttcaagaccagcctgggcaacatggcaaaatcctgtcactaaaaaaattagccaggtgtgctggtgtgcacctgtagtcccagctacttaggaggctgctgtgggaggatcacttgagcccaggagatcgagacttcagtgagccacaatgatgccactgcactcaagcctgggtgacagagtgagaccttgtctttaaaaaaaaagaaaattataaaatcaggtagtgtgatgcctatgcctgtagcttttgttctttttattcaggatcactttagctttcagagtcttttgtggttccatacaaattttaggatttttctatttctgtgaagaatgtcattggtgttttgacagggattacattgaatctgtggatcaccttgagtagtacaaaatgggtttttatttagatgtgttcagtattctttaactggtctttcttccatctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctttctctctaatggaatgatttcacagttttcttaaatagctgggaaaaaagttggctgggtacagtagctcatgcctgtaatcctaacattttgggaggccaaggtgggaggattgcttgagcccagcagttcgagaccagcctgggcaacatggcaagacccccatctctgcaaaatctttaaaaattagccaggcgtggtagcacaagactgtggtcccagctacttgggaggctgaggtggattgccttagtccaggaggtcaagtttgcagtgttacgatggtaccagcctgggcaacagagccaagaccctgtctcaaaaacaaaaaaagaaagaaaaaagaaaagaaaaatctcatgtgaaaccacaatatagaaaaaaaaaaagtagcgttttatataaattcaaatgtacggtatagcatttataatcagaataatcaggttagtttgaggaacataaagatttgaagtcaggtttcatatggcagacacggcctttatgagtatatctaagcctttatgggtatatttcattgtttcaattttacagtagtaaatttttgctcacataggtaaataggaaaaaaaacatttaaaagtaaaactgacgagacactttcagctaccctgaagctcctctgctcaactgtaagatacttaggacaaactcccagggttactgctctgccctcaggagtcccttgagaagtgtggctgtgtcaccttatgggaggagtgccttcctgggggttggttctttgcacatgagtcattatttatggcagccatgctgggagggcaagaggtttgtactgggatgatgatacaggtctccaaacaagctttgattccagatagaaaagaatatagggtaaagacatctgtcatcatttgcaagttattttatcccgtatgctggcccagccaagaagtctttcaagcaagtgaaattgtcaataaaatctgtatgtatatatttttggttcttccttgatctgtcatctcagcttattgaactataaggtagcagatagagtcatctactttctccaaaaagtaacctaggctgcatgggctacttttcacattgtctaacggggaagccctacccaggcagctttagccctctaatcactagagatgggtgtttacaattcattttttaatataagctctctcatcaagattctaatcaccagttgcaaagcaagttaaccttttggagctgcatctcagatatggtgcccagaacatcagcacctgagaacctgccaaaaccatgccaaaaggcatgatatcaggccctaccccagacctactgaatcagagatttaagatggagctcagcaatctaagttttaacctctcaagtgtttctgatgcacactcaactttaatgaccctgatgagttgagagacggagtatagaggcagctcaggtgaggggttagaggccagaggagggcatggctaagaggggcgttcagctctgctctgagagacacctcctgagcaaaagcagccatggcactgagttttatcttttcttctttgtgttgtagctgcagcagagaaaaactagaaagcaaatatttcagaatgtgtggtcttccaattcactagagttcagatctcagctctctatttggacaagttgccactggaggaatagagtcagttacattactacttactgggtgtgcaggggataacaagcttcccttgccccaggtgctgggtagggactaggtcccagaacacaagtatggcttgtattctgaccattccatgctcttcctaacttaaccaagagctgccaggtgcctatccctaccttgacctagagcagttacttgaaacttatctacttccctcaaagaaaccataacacaaagacagggcattgccccagtaatccaccttcctttcaccagcacctgctgctgctccctgccctggccactctggcacacatgtgggccttgttcataatccaacccaggttttccactcataccttcactttctaggaacatattcctggtgtcctgattcttaaagtcactcagttgttcactcctggccactagcaatctgatgagggcacattgtgagctgaattaagaataccatctggagcttggcatggtggtcatgcctataatcctggcacattgggaggcctatgtaagaagatcacttgagcctgggaggtcaagactgcagttgaagagttcaagaccagcctaggcagcatagcaagaccctgtctctacaaaaaaataaaaaattagcccggcatgtggcatgtgcctgtagtctcagccacttgggaggctaaggtgggaggattgcttgagcccaggagatcaaagctgcagtgagctgtgatggcaccacttcatgccagtctgggcaacagagtgaaaccctgtctcaaaagcaaaatatatatatatatcatcttgtatgagtgccatattcaagagctatatatggagatagaattaacatgtcattgccaagttcagcatattcttctggctatacctggacattgtgtgcttttctgctttgcaagtagtagaaggtcctagaatcagcttcctcactgaggcttacaagaaagattgacttgttaccacccctcttaaagctgctgaagccatacatgtaggtacagaaacccagtctttttttttttccacatttctcttcatactattctgcctgatatctgtcattacagactgtacacttgcaggattttgcactctggccacatggcacaagaaaccaattccttgttgtggttggttgttccctcagtagagaatatcagtagcttttcagtgctttgcttttgtcttcatttcctaattgctatcctgaggcttctcttaggagaatagttcccacttctttgaaagttcttggtaaggcttctttcagccctcgaatttacccaaggtcaaatacaggcgtacctcagagatgttgcaggttcagttccagaccagcacaataaagcgagtcacaagaattttttgtttcccagtgcatacagaagttatgtttatataatactgtagtctactaagtatgcaacagcactgtgtctaaaaaaaaaaaatgtacataccttaattttaaaatacattattaaaaaatgctgacgatgagcccagcctttagggagttgtaatcattttgctgctggagggccttgcctccacgtggatggttgctgactgatcaggttggtagttgctaaacattggggtgtctgtggcagtatctttaaataagatagcaaggaagtttgccacatcagttgatttttcctttcatgaaagatttctcagtagcatgcagtgctgtttgatagcattttacccacaatagttcttccagtattggactcagtcctctcaaaccctgctgctgctttatcagctaaggttatgtaatatttgggggtttgtgcgtgtgtgtgtgtgtgtgacacagagcctcattctgtcgccaggctggagtgcagtggcacaatcttggctcactgcaaccccgcctcctgggttcaaacaattcttctgcctcagcctcccaagtagctgggattacaggtgtatgccaccacacccagctaatttttctatttttgtagagatgggttttcaccatgttggccaggctggtctcgaactcctgaactcaggtgattggcctgcctcagcctcccaaagtgctgggattataggcgtgagccactgtgcccggccagtttatgtaatattctaaatcctttgttgtcacttcaacaatgttcacaacatcttcaccaggagtagattccatctcaagaaaccactttttttgctcatccacagcaagcaactcctcattcgagttgtatcatgaaattgtagcaattcagtcacatcttcaagcgccactcgaattctagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctcagcctcccaaagtactgggattacaggcgtgagccaccgcgcctggccaaataaagtgtatttcttaaataataagactataaagtcaaaattactccttgatctgtgggctgtaaaatggatgttgtgttagcaggtttgaaaacaactttaatctccttgttcatctcagagctcctcagtgaccaggcacattgtcagtgagcagcaattttttgaaaggaatcttcttttctgaacagtaggtctcaacaataggcttaaaacgctcagtaaattattctataaatagatgtgctgtcatccaggctatgttgttccatttctagagcacaggcagagtagatttagcatcattcttaagggccctaagatttttggaatggtaaatgagcactggcctcaacttaaagtcaccagctatattatcgcctaacaagagagtcagcctatcctttgaagccaggcattgaattattctttcctgttgctttgaaagtcctatacggcatcttctttcaatatagtgctgtttcatctacactaaaaacatgcttagtgtagccaccttcatcagtgatcttagctagatcttctgaataactttttgcagcttctatgtcagcctttgctgcttcactttgcacgtttatgttatggagatggcttctttccttaaagcagcttcctcactcaaccttggtaggattgaagaaagttagggccttgctgtggtaatccaaggctttggcttaagggaatgttgtggctggtttgatcttctatccagacacctagaactttctccatataagcaataaggctgttttgctttcttattcatgtgttcattgaagtagcacttttaattttgttaaagtctggctcttccctttacttgaacacttaaaggtcattacaggattattaattgacctaatttcaatattgttgtggcttagggaagagggaagcctgaggagagggagagatacaagggaatggctggtcagaggagcagtcagaacatgcaccgcacttaccatttcagttagctgtcttatgcaggtgcagttcatggcaccccaaaataattaaatagtaacctcacagatcattgattacagatcaccataacaggtataagaatagtgaaaaggtttgaaatattatgagaattaccaaaatatgaaagagacatgaaatgagcacgtgctattggaaaaattgtgctgacaaacttgctcaatgcaggattaccacacatcttcaatttgtaaaaaacacaatatctgtaaagcacaaaaagcacagcacaacaaaataaagtctgcctgtataagaatttcaactgggcatgaattttatcctttctatgctgggctctcttgatttgccttttgctcggagaaaagctagagttagctgcatgccttagtttcctgcctcacaggaggaaatgtggtattaggatttagttgtatgcaatttgtttcatctgaacagaggagaaagtcccaaaggagccattccatcgaatccatgcccgagtgatcttaaggagatgaaaacacagcattcctggttatgctcagggtaaactgcctgatgcacagtcagtatctccaaagagaaattatgtataacaaatcagttgggtaatggtgatatgctacttggcagagaaattaatatttatcaactgaaccgagtggcaagcactcggatccctgtctctaaacattctggtctaagcacgagtagttctgtactcttctctttgccatgggatctagtctgatagacgagatcctaatagttcaggacatgtggacatattcaggctgagtgatggtgccacctgtgctgtaggtggaaacaaggaaacctcattgattactgtccagatagggaagacagaatttgacagccagtggaaagtgtggcagataggctagtttggcacatgatcctatttggatacaaggaagctgctttagcctctgagcacccaacctgactctaaacagcaggcagaaaaacgtatgcatgtgcatatatttaggagactgagctctcctgaaggctgttgcttctctgtcatcggcacaaacagcaaaaggtaaatttttcagtcaccaaaaacttgttgattctaccatactgttttgccctgttctttgtgttccactgaccacactctggcttcagagcccatctacccaagcattgtagaaattttaatgtttgttcagtgaataaatgggctctttcccacaatgtaggactaactttctgtcagaaccacccccagggtctccccttctggttcattcttcattttgccacaggattactaaccctgaaaactcagttctcaagctgtcagtggcctcctgtggcacgggaaccgtaggctgacgggcctggctcaggacagcctggcaggaggcacctgcctgccccgcttcagccccattggacacacagctcgcctgcctatctctgtgcattggctcacgctgtttgggcttgcacggacagcacctctgtctcatatggttgcagtcctatggcctttggtgcctggttcaagtgtaaactcttagacaaagatagaccaaatctcttctttcctccacccctttcctgtcttcctgccccagccaaaggaatcttccccttcctgactctcgtagcattttataactcagctacatatgaatttggttttgtgtgtatgtcttttcttccttgtcaaattctaagcttgttttggtgtatagaccatgtcatgtatctttgcatctctaccacacatagcaaggtgccacacacatgtaattagtacatgttggttgaattaatctatgtcaggtgaccttaggtcttctctaacgcagagactatttatttgtgtgccttttattatgtgtctactacctgccaggtattatatatatgtaatctcatttagaaagcagaatttcgcattttcttttttttttccccccttaagtgatggtcggtgaaactaatgtgaaatgttataaaggcagagatactggaattgaaggaaaaagaataattatctatgtgttagtttgggtcatccaaaaaacagatgccaagataggattaaaagtacaagagatttactgggggaaacacctgcaagggaaaatggggctgggagctggaggctgttggcagagttggcagacccctgtggaggaggaaaggccgggggagcggggacgttttccactggagtgtggtgctgagaaagtttcagcaaagccattggggagccagtgctgcccctcagacgagtccctcccatgctcaggcattggctggaagcagcaggtgggaagggtggcctctgcatgaatgtgctgatggattttagagtgcagccactctgtcccctgcatttggagaaatacatcttcatgactgccacaccatagaatcaaccaagctaaaagttcaaaggtggcttgtggcacacaggccctttagccagttaggcaaaacgagggcctgggaaagagaattcttcctctcgtcggcagtttgaatatttgcagtcttagcttggaatggtctttctgcactagagggaaacctcctttagtgcagaccagcctaaagccaagccattgctgcctgaggaagctgccatctctggagcacggtgacatgccaccaccctggacctattcccatcccccggagcactgtggcatgtagcctcttcgtgccactgcaaggtcagaaagcacctctgggcacacctccgtcttttgggtctgcctccccactagactgagcattgtgcatagaagctacttttattctttacatcccagtggctcacatgatagatgccaagtaaaatttccagtttgtactttaaattgtttttctggcactggagatgggcttgcagtgatccctccatccatgtaatggccctgggctcagtggaccatccagagtaggcttctccaccatggagctgcccctcctcaggagtctgatgtgagtggctcttgatactcattctcacttcactcactccatatcacaagagccaaggatttcccagtaccaacattttcttgggctgcttttgatggttttttttttcccccttcctgtcctctttttccaaccccagaacaaactgccagcgttcctggttggtgttgctaactcaggtcaccctgaggctgccctgtctttctcttgcttgttgtgagcccctccctctacgcccatgtgcccgaggctgtgccgctgccttgtgcaggcacccagggtttatgccagtgatttcctgacacaagcagcagcacagaacgtgtgtgtcccaggtttaggtttgggaggcctgcctggagaacagccatcccaggttctgggagctttctcaatttactgttttatccaaagatgggttggcctttctctggacatagtgagcttccttgggctagttcttaagcctgagactaaaagttctcaccatgagttattagggaggcctgtaaaatgtaaaggccatgcgtcttttttgctctgttacccaggctggagtgcaatggtatgatcatggctcactgcagccctgaactccttgggctcaagcaatcctcctaactcagcctctgcatagctgtgacaacaggtgtgtgccaccacacctagctaatttttaaatttttgtagatacagggtctccctatgttgcccaggctggtctcaaactcctaggctcacatgatcctcctgcctcagcctcccaaagtgctgggattacaggtgtgagccactgcacccagccaaggccatgcacctttaagttctttacctgggctttactctaagatgggaggcctcagagtgagaaaagctgctaagaagtgggaaggagcctgtacctctggtgattagggatttctcttttcgtccacccccattctcacctccactggaagtagacctgtaagaaaaattaaagcagtttagaaagggttgaaactgtttattcacccatccctgccaaaattttctggaacattcctagtttcagatgttccttatatcttaaaacagcataagaactgttttttgtttttaaaaaaaaaatttgtagagatagagtctcactgcgttgctcgggctggtcttgaactcctgggctcaaaccctcctcttgcctcagcttcccaaagtgctgggaatacaggcatgagtcaccatgcttggcaagaaccgctggctatagaccatgacttttttttttttttttttttttgagacggagtctcactctgtcacccaggctggagtgcagtggcgcaatctcagctcactgcaacctctgcctcccaggtgcaaacgattgtcctgcctcagcctccctagtagctgggactgtaggcgtatgccaccaccctcagctgatttttgtattttttgtagagatagggtttcatcatgttggccaggctggtctcgaactcctgacctcaggtgatccacccatctcggcctcccaaagtgctgggattacaggcgtgagccaccacgcccatcctatatacctcacccaagtcgtgtaaataaagcctgaaacttgggaagaggaggctggactattgaggtcttattgaggttgctgtgcaaatcaagatgatcccatttctaagaaatggctagtctggtatagaagctaaggatttgtttaggaaagcaggaagctcttgaatatgaatccaagctcagtggaaatgggctgagttgaattacatttagcaggtggctgctgccgttctagagaggagagacttggagggacctctgccctcactaccaggcagacctggcttggcagggtgccttgagcctcactggaacagcagttggttttcccagaactcaccccagaagcctgtgtcctctgatagcactggccagttaggacaggaggctttgattcccagagagagccagcaggactccactctcatctatgcaagcacaggctgagggtggatggcattaaagtgactgcactgctgagtggggaataggggctgggaactctcctggaagctttcatcatattaaaagtaggcatttctttaactgcaaagagatacttttatattttgtactcagtggtaaggcaagattaattggtaccttcctgcttctgttcattcctgtattcatttgagtttttgcttttacattacaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgcttaggtctgggttaggttgtgaattttgtcacgtaacgacaactaaggcagaagccttctctggctttgggagcagtgttggtttcaagcagggttactgattccagattccacagatctgcccaaagtttttgttgccttgaagatttatcttgaagagttgaccattctaccatgtactagaattcagaaagtccaccttacaagctatcttgggcccctccaggtttgtatagataattataaatctgtgtttgaccaaatgttaatatttttaacttaaaatagcttcattgaggaatggtagtatatgaaccccagaacaaaaccatattcttttaaactacatgaacctagaggtgtcaaagatagaatttttttgtgctcatcagttgatgctagtgagaagcttgcagttgctctggtttgagtctcaaaagcttgacatgcaagtttcatcttggatgtaaattacacatataattctgtaagtgacatgcagtagtcagtcatactcccagtgttaaggactatgtggttcttctcatctgttcctaaaagctttttatcttttttcttcttttggtcaaagtgaacctcagaagaaactgttaaatctggcatccaattttcctgaaaatgtgtgtgtgaaaaatcacacaagttgtatggaaaccgtgtggaatgctggatggtctggtagtcagtgttcggtgcttcctgtgcagccagcattatgctagaaagtggttctcatttttttttttttttttttttttggggtctcgctctgtcacccaggctggagtgcagtggcgcaatcttggctcactacaacctctgcctcccaggctcaagcaattctcctgcctcagcctccagagtagctgggattacaggcatgcaccaccacacctggctaattttttgtatttttagtagagacagagtttcaccatgttagccaggctggtcttgaactcccggcctcaagatgatccaccccaccttggctttggattacaggcgtgagccaccgtgcccaaacttttatttcagcagcccttcatagtctggaaaaaaaaattttaagagcatttccatttatgtgcattctatcaatatttagtatattaaaaattaagatagaaagtgttaaagtaatccctttgaaaaataacatgtttcctgttactataaatacttttatgtcaggccaggaacgatggatggtttatacctgtaatcacagtactttgggaggccaacgcaggagtattgcttgaggccagagatccagaccagcctgagcaacatagcaaggttccatctctacaaaaaaaagtttaaaaaaaaaaattagctaggcgtagcggcttcatgctacttgggaggctgaggcaggaggattgattgcttgagcccaggggttcaaggctgcagtgagctatgatcccactgctgctcttcatcctgggtgacagcgagaccttgtctctaaaaaaaagttttactgaaatttttacaatttttatggaaaaatcttccaactcaaagacacattttagtgagaagaatgacatttttgcacatctctttaatgcatggcttgatagagaacagcaagagtctcacatctcttatattcagtttgtcctgagatcacagtgcagtcactgacaagataacagtgaaaaaaatagaccctttaattttgtattatgaaaacagttttcataagacaaaattttgtcttatgaaaatagctttcataatacaaaatacagatagacaccttgaaatggtctccagaacacctatggatccttggactacattttgagaactactgtcacatcgtgccttgagctcaatggctgagacttagcaaaatcagggctgagattccagaaggactatctgtgcctccaaggaataggaaatagacttgttcgtctagaaacagctttggttaagagaagatgcccgagactaccattgcc

SEQ ID NO: 17249 - DNA, 35337 bp, Human
  misc_feature (1)...(35337): n = A,T,C or G
ctctagaacctggacacacaccccaaggagagttgattacttcattcttattaacactgtccccgtttccaaagaaaaaaacaaatgaggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtggtggcgggcgcctgtagtcccagctactctggaggctgaggcaggagaatggcctgaacccgggaggcggagcttgcagtgagccgagattgtgccactgcactccagcctgggcgacagagtgagactccatctcaataaataaataagtaaacttaaaaaaaaatcaaagtcatgcaaaaagaacctcttcttagaacagtacccaaacccaaagcaggattttctaggaccatttaggatgcagccagtgcttcttccttagaattctccctcccagctagtctcacctctaccttaacagtcacttctgagcactttcctgctggtctccgtgaagagcaggatgtaggaaaactgcccatctcatgtccctgctttccacactctctgcaaagccttaggaactcatcaagcctgggtgacagattaagactctgtctccaaaaaaaaaaaaaaaaacagaaagaactcatcagatattatgtggatattgtatagatattggctacatctaaatgatgccaaaatgaccagcaaaaaggcaaagaaaaaatcagctgtttatataagccagctcgtgaagtaaggtaaaaacaattactataattacacaacaccaaatgacttgtctgattttttttttctgaatggacctctgtgtgtgtgcacgtgtatgtctgcaccacgcagacagagccagcagctgactgaagaaatgtgctctgcagtgatacagccacagcccaaacaggcagtcagcaggacacacaatgttcagctcctcgatggtccagcatagatggggcactgggaaatgtgtggagctagaaagtgcttatcccctgggacttttatgtaatccaccacagcggacaaagtaatgcccatcctacctttgtgatttacatttgcccaggctggttcgctttgcttactgcttactgcttactgctttctgcatctcctttctctttcctccatcagtcttaaaactgcttccaaacagactgccctcttaaaagtctgctgcagctctgtcctcctggaccaatacgaccctatcatatggggcattaagtccaagacccttattcttgagtgtttaaagcatttcttatttctcttccctcattctcccctctccctttgggaatcacaacatcccaacgcgtaacaccagaaatacttgagtccacactgagactaccacaggaccccggccagactctcctgcactttgggaggctgaggtgggaagattgtttgagctcaggagttcaagactagcctgggcaacaaagtggagacccggtctctaagaaaaataaataaataaaataaaaatttaaaaggacattaagtaatttggccaaagccgcagaggtcgtaagtaaatattaacgcactcgaaactgctaaataacttattgtatcgatgatgctcgttttaattgaaagcatggaggctgtggtctggctgctttcgcttccaacaaagtgcactgctgcgctccaagcagaagataaacagggagacaggtgtgacttcaagagagcgacggacactgtaacccgaagcccccgcgcccgccgcggcccgggaggctgccccagccggccgggctgcgcactcccgcggggctggcgcggctctcgcttccaaagttggagctctccggggtgggagggggcggggaggacggcggggcggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccagggtaggtgtcggcattcttgcttttgctgcgaggtggggactccggcggcgtccggggggacgcagtggatgccccggggccgagggcggccagaaagcgcgcgagggcgggcggacggggcgctgctggctcccgggcttcggcgcccagctccgggggcggcggcaactccgtcaagtggctgcggagcggctcagagatttgacaaagtccgctctaaaggtgtcccatcctctgggtccgcagcgactttccgaggagagccactgggctcagggaaggcgaggctgccaggctcgagtgcctcctcccctttaggttttaaatgttttatatgtgataacagaaataaaacacaccccatcgcccttccgtaacaaatgatgggtcccgggtgggagaggcgagggactggcaccccccggcattccctggagctggcgcgcatctgagcgtttttctcgtccggatgaaaagttcagcagcgcgctgttcgcggggcacgacctgcgttggccaaactggagccgctcctatcagcccagacaggggaagtcttcctaatgctcactcctcagtttccaggcattttgagcacgttttccaaagctgagaacttggcttaggaattaccaacttctaactctagctacaaagaaaacgtggcagacagtttagtttacctgatgcaaagtaaaccactcagcctaaaacggaaaataatgctttaatgtcaaagtcaagctttacttggtgttctctactgtctaatgagaaaacaaggtaaaaataaaacctcagggtttctctcctgtcagtaaatttgtagaattaattctaaagcattatttggtctagctggtttttttctaacacaatgtttttcttcatagaaaattaatgtattatttcagttatcacatataaaacatttaatacctaaaggcgtaaacttccagaatattatacttttagttgcagagtattatactttattttcttgtattcttctcatgccatattttataattgtatgtgttataatctgattgatctgctcatacagattttgaacaaggtaataccttttaaattctgttttatttatatatgcctatgagatttgggaaccaacatccttttaaaaatatgtcaaaatgtgtatcctacagacgcatacaatggaacgtttcaagccttgttttacatttttcaaaaacatataaacacatctgacgtgtttttatatgaaacatgaaaactgttcaacatacccccaaaaacgttcctaagtaaagtaagcagaaaatgcttcagtgacctgggccaagcaattcctattatagatttaccaacaaaaacagtttccgttatatctactaagaaatattttagtttctggagtatggtttttatttaaattgaataagcttttgaatcctaacacagaataaatcatatttatattaaattctaaccaaaataattttgtcacgaaaacttttaaggtgtttataaaagaaatattttgctattatagtataatcgtatgtcaatataattaatcatatgcttgaaattttgagttgttgacattataaatgtttattttaaagcagtacttacattccagagttggactacaatagctattggtaaatatatttgatataatggcagttattattagggaaaccaattctatctggaatttctaactcataactaatttgtatcactcatttttgacatttggttcaataacagtttatgaccaaatatgatttcacttgattatggcttttctctttaattaattctaggacagcaggtaaaaccaaatcatttttgtatcccaagtgtccccaaagccaggtatatagtagattcttattgaataaataagaacatttatttattcaataagaacttttatgctttagtgaacacctaattcagaatattttcactgaaatgataagaatattgaaatttgttaaggaaaagaataaaaagtattacagaaaagtattacagaaaaataactatcagtattgttaaatggtgaattgttgtactgcttttaacattttaacaccattttgaaaggcagtgtgtgaggttgtaagtgtgttattgtactctcttgcttgccaggcattgatgggaaccttttatgtgcacgaactcactgaaatctcacaataatctttaggagagtagcagtagtgacatccccttttgcaaatgaggagaatgaggcttcaaaagatttattaacccgccgatgatcacaagcagtgggacaggctctgacgctaggtctgtgtgcctccaaagcctgcattctgaaggccacatgtgaaaatggacacctgttccaatatttctaaagagttgttttgtgccatcctgttcatcactggccttattgatgctgtcttcaacatctgccactttccattttttctactactgtccctcttcaagatttcctagctccacgcctagacatttggctcccccgtccaattcacacagcatattcttaccgtctctggaaaatgccaaattgctcctttctcattcttaaaaatccttcagcggcatcactggtttgtagagagtgaaatgcgtgtctttgcacaacattcatgacttttcaccatctcctatcccaatttgagttgctaacttcatttctttcctctccctttgttgtctctccctttcctccccttgttccacacgtaggcagtggtaccgccctctggactacttacgatttccctgacgtgtctttgctcctgataccatttttccccacaccacaccactgtcctctgtgcctgtggaaaccactcaaatgcctctccccaagccttctttcagtaacaaccatctcatccggttgattactgtagctttcggcctgtataacccctccttatgtcatgcctgtaccagatgttccactgcatctgtatcccaccagattgcacattccccgaaggcagaaaccttctaatctgggggccattcagggcctagcacagtgcctagtagagcatatgtgttgtagaataaatatagacacagtatgaatgattgactagattgttccctttttacatgactttattataaataggtatagaatgtgttctcaaaaatatttcacaaaaagataagtgagaattgttttattgtgagttgatttgtcatgtttttgttttgttttgttgagacagagtctcgctctgtctcccaggctggagtgcagtggcgcgatctcgcctcactgcaacctctgcctcctgggttcaagcgattctcctgcctcagccttccaagtagctgggactacaagcacccgccaccatacccagctaattttttttttttttttttttttttagtagagatagggtttcaccatgttggccaggctactctcaaactcctgacctcaggcgatccgcccacctcagcttcccaaagtgattacagtcgtgagccaccacgcctggctgatgtgtcagttttaaataagttcttaatatacaaagaattgaaataccaatatctacacttaaagccacaaaaagtcccataaacgagatgtgtttaatcgagtccccattaaatcagcttttgtcctcctactagctatacccttcactccccgcctcacactatacaaatacagacgacagcaatactgctagacaatggggctccaaccagagtttgtaggagagtgacaaatatgactgcctccatcaattgaaattacagttcacaaaattaggacacagggccctcatgcccgtaattgtttacaatccaaatagccagatgaatctttgtattataaaaaaatcaaaagtaaggtaaatcaaacaccagacattctcaaaacaaatttttagcaactggttgtgataaacacaatttttaggaaagcagtttctaggcaataagtgtgatagaccttgtgcaatataaaatttcagttttggatgttcagtttaggggagggagttgttatttcaaacaccgtgtataactggcctaagcatttcacagaagaatttgaaggttcacttcttcaagtgagcatcttttctttttataagaagcttctaaagagtctaagtttttggaccatccagaagctagatctactctcacagacaagttgcaaatcgtttgctttgacaagatttcaatatggaatatagtaatcccctctcatccacaggggacacattccaagacccccaatggttgcctaaaacctacattagtaccaaaccctatatatatatacgtgtgtgtgtgtgtgtgtgtgtgtgtgtgtgtgtgtgtgtgtgtttctatgcatgcatacctatgataaagtttaatttataacttgggcacagcgctcttgcactttggggccattattaagtgaaataagggttgcttgaacccaagcactgcaatactgtgacagccgatctgataactaagacttcgaagtgatttacaggtgaagagtgtagcatagacaaggtggatacgctggacaaagggatgatccatgacccaggtgggacagagtaagacttcatcgcgctactcagcacagctgcaatttaacacttatgagttgtttacttctcaaatattccaattactatttgtaggctgcagttggtctcggataactgaaactgcagaaaataaaaccgtgaataaggggaggctagtgtacagggcaagcttcttttgtgtacatgatataaaatgattgtctatatctgatgccagtgtgtcttttctcactaaaatgtcttccccctcttcactcctccctccttcctatgcagagcacatccaagatcaagattattataactgagaatgctatatgagcttgagtaccaatatagaaaaagttagtgtgttcctaatttgtacaggctttaagatagaacagtgtatgactttaacataaactacttttgaaatttcatgtaatataaactacatttgaagtttaaacttttagaaaggactgtttgcaatggaatgcaattcttttccagggtaaaacacaaatgtagtggaaaggttgatgtaaataaaaacctgttcaattttgttctaacacagaccgtgtctacgtggaagtactggttcatgtgtaactcatacatcccacaagcatctactgtgtgcagaatgtctcgtatgtgaaagacactgtgggcatataactgtggcttagatgggcttctaacccctgagaagataatatatcagcagaaaaaaaggaacatgtatatgaactgccatcacacaacctatccagaattccacaagaaaagtatggtcaaagagctaggaggtgttgaaggaaagattacctgcaggagaggcaatgcgagatgatagaagattctgagctatagagcgaggcggacccagatgggaatttcaggttttctcgggatgtgggaccctaaccaagcttcttatactttccaagcatccattttctcattttaaaaaagagataactatgttgtaagattgtcttaagaattatgtgagataatagttctcaatagtaatacggtgatggttcccagccctggcagcatgttaaagccgcccatgtgacttctgaacacagccatgcccaggtgcatgcagagattctaatataaccggtgtggggtgtggctctagaaatgtctttggcaggcaggtgctgcagggctgtggatgccaaggaggcacgcggagtctatttgctagggatggagaatgaacaatggggtttctcatgattttggtccgtgcctaccgtgcagtgcttcagtgtgtgcttgtcttgctccataactatttcagtcgtttttattaacagaaacatcatctcaggaccatgtcttgggcttgccttacgtctccacataaataggacattatagatgctttatctgtgttttcagttagcttttttttccccaacagatccaagtaatataagttgatgtgaataacagaaatcatctgaggcgcttgttgaaagcataaattccctggctcctctcctagagattctgttcctgattccgagcatctggaataggactggagcctttaacgttcagcaagggccccaggtgattcttataatcacacaagtttgaaaacatggtgctaagtgattcactgcagtaccgtgttcaatgatctctctggtacttttgatatttgagaccctaatgaacctaaataaaaaataatccgctgacaaacactatgcctcatttcagctctctcttctaatttgggaaaacagtaataaactgtgcatgctaatacaaagtaatatgataaggaaagaatataataatgcaataaagtaataatataaagtaatgcagggaaaacagatcgtttaacttagtaaaatcaggccaatttcgcagtcattttctgatcactgggctcgctgaacttgaaaacgaggaaaaagtaaagacatcatgttttctccttctctctcattcctctctctatttcctttttctcatcaactgtctccttagaggtctcaggacagcaataaccaggttgaatacaaaatgagaagtgggatctggccatcactatcaaccacctgtcctagctgacttctgaaggagctggtgacatagctgtacagctgctcagcagcaaagccgcaggttacttagacacctcttctcctctgaaagccagagccagttttccttgtccagcctgtcttagagagttgtaatggtcaaacgtgtgagaaggagctctgcaaatgtaacattttgcataagtataagatggtattatttagtattaatattgttagtaaattttagtaatattcagtatctaagatattcaacttagatatccaatagttattcattatctaagtccaatatcaggggtatggctctagatatcaatagatattggacttagataatgaaaagctattgttcagatgtgtgtttaaaattagtgtggacacatgcagaaacaaaaccccactcatcccaccttacactcatcctaaccagagctaaaagaaaagttagacttttccaaatcagaattgagtattacataacttaactctattaaggtatattagaaaagctaagttaggctctaaaagcaaatatgttgagatacacctgcttgtgtgttttgtttgtttgtttgtttgtttgttttgttttgtttttggtgagaggaggaggtctacctctgttgcccaggctggcgtgcagtggtgcaatcatagctctctgtggcctcaaactcctgggctcaagcagtcctcctccctcagcctcctgagcagctgggactacaggtgtgcaccattatgcctagctttttaaaaatatatttttttgtagagacagggtcctgctattttgcccaggctggtctcaaactcctagcctcaagcaatccttccacctcagcctcccaaagcactgggattacaggcatgaggcatcatgcctggccctgtgttttaactcaaagaaaattattctagtcttagacatttaaaaatagaaaatactgattttgacaaatgagagaaaattaaaagtttaagattatttttatccttacaagtcactttggggatggaaacttttgttctactaacagttctgggtctgagaatgtttctaaatggaaaacggctatgaaatgcctcccaaaggctaagatataataatccccagttgtcttcacccagcttctattaactgttcctactgggaaatcattgtgatagctacagtgaggtgatcatagaaataaagtgagtacaataaacattttagtaatgagacagaagatccaggacacaagacaacttattattttagcaatttttatttattcagatgaacttgtatcttccttagaaccgcaattagatagctagaataagcaaatacagaaaaagcaaatgaattactgatccctaaataaagcattagaaataatctagtttcttcctggagcagtttgagatttgatagtagtatgtattgttctgctctagtagaaactcacaaacatagcaatgacaagttgacattaaaagccataatctttgggtatatagggactagttcttttttatataagctctgacaaatgctttttaattgattcttcaattattctaaatactggggtatacactgtgaagtattaaaaatatacatcatattgtacatatcctcaagagcatccagtctagttgggaagacagacaatacacgagtaaataaacaaacataaaagtacaaataactttcattaaggaaataggatgtaatggtgaaaaatgatgaggggaggactagagaagctacttcagatgtttggcgaagtctttctgagagtgcagcatttgaacctagacctaaaggttgagaaggagtgaagagtaagggaagcatttcaggcagaaataagagtgcatgagaacccccagaaagggcacaagcttggcctacatgaggaactaaaaggaaatcagaatggccacagcaccatggatgagggagagcaggaataatgtaagatgatatgagagaagtaggcaaggtaagacccatgtgaggtctagacagaggtgtatagttgggatttgcccagaaaaattgggagtaggtatactggtcaaaagaatcattgactttaactgaatattcaacagtaataattacaaacttcctatttttaaatattttaaattatgggaaaccatatttttcccatattctgtattcttaagtatttcttttattcctgcccctgaaaaacatgtggacagcataaaattggatctcacttcttcacctagtttgatagtctctgttttttaagtgatgtgtttagatgatttacatttaatgtaattgctgctatggtttaattaaaatctactgtcttgctagtttggtttcatctgtccttcattcgtggagaagagaccatgagtgaatacaaacttcctttgtctctggtttccgggagttctgtacgctcatgttaactcacactggatctttagcaatttgttaataattttagctgaattcttcataacagctagtatgggagccccatcttcctccatgccctgctccatgcaggtgagcctgtgctcatgtcttgcctttgcttgaaggcacctgtctttccttagatttcaagtttattgccctgtgactttagctctctgaagggttcaagagaagttataattttgtgtattatctggcctcttcttggtagtctctacagatttctaaacaaagtgcaatagactgggtggcttataagtaacataaatttatttctcactgttctggagaccggaaatccaaggttaggataccagcatggttgggttctggtgaggaaactcttctgggttgcagacacctcacttgttattgtttcctccttattggaggcaagagagctgagagctctctctgaggcctttttcataagggcactaatcccattcatgagggctcctcacttctgacctaattaccccccaaaagtccctcctccaaataccatcacattgtggttaggatttcaacatttgagttttggggggagataaaaagtccattgcatgcctcttacgtgaattttaaagatgataaatagtaaggattgctatatttggattgaaagcagtttcaacctgaatgtaaaagatgcctaaatatagtaaaactctattcccaaatagagacttctgggtgatgaaaaataaaaaataattttttaaaacaaaaaaatgtatgattcacactgggaattatgtaagatgttttaaaagagagtaacagatacaaggatatgaaatgtggttagtaagaaacaaaatcattcagcaggatgagaaaatagacctaactcaactgaccaactaagagttatctttagttagatttacagtctttctgcccaattaaacatttaaaatgttaccaggctgaaacacaaatgtcaggcacaaaactcaagatactgcgggatgttggtttttaaatagtgccatgatttcttccagattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggtgcttcttaactaatggtgcttaaatctgatctgttttgcaggagaacctgaaccagaactataaataacttcatcctcccagcaaggagggccacagacctagtattttggctgactttttatatattagctacttaattctttactaaagtcagtcaatctagcagttgttgacaaatcatttctaaaaaggattctctggaatgttagaataataaaagaggctaaaagaatttgttccagtaataacccggttaattaactatgaaaatagaactattagccacataaacactgaacaacacaactagttatatcactgttctcagtgtggtagagaatggaatggaatggaatggaatggagagattcccctgaaataatctcttgacttgcctgactgtaattatattaaaactggttgctaatatcctgtctgccattggctgttttgtacagaattcagcccagaagaatgttacaggtgtgagagtgcatatgcacgtgggcatgtgaaatactgagatgtttctgaccccaccccccaaaaacactaagaaattgagcctgatctcttgccatcagatccctgatccaaaactgaaccatgataataataatttgttatagtggttgttagtgtgtgtttatcctgttatgattgtactcacagttttccgtgctgtggtacagaaggatcaatcaatccaccaatctgctgtttccttggggtgaaatagattctttcactctctatgcataacctgtgttcatgctgagcacacagtcccttaggagccactaggtcccaggcagatgcatgagaagggttggacaaagcacatttccttgatgccagtaacacatccacctggcagatcactcactgtcttctgcagtggcctcagtaggactggagggaagtagggaggtctagggagcttgcctggtggtcatctgcagagtgtgcctgcagagtctccctctcctgtttcccacatgccttgcaggcctccttcctccagaaactgtgcagtgtactccaggcaatttttatctagtctgccatacccaaaaggacattaaaaatgtacgacttcggccgggtgtggtggctcccgcctgtaatcctagcgctttgggaggccgaactgggcggatcacttgaggtccagagttcatgaccagcctggccaactggtgaaaccccgtctctactaaaaatacaaaaattagccaggcatggtggtgggcacctgtaatcccagctactcgggaagctgagggaggagaatcgcttggacccagaaggaggaggttgcagtgagtcaagattttgccactgcactccagcctggttgacagagggagacaacattaaaagaaaaaaaaagggggggggaagactaattatgtgggaaaatacagaataatcagcaaaaaaaaaaaaattgtttttgcataagttaatgagggttgctagtattttcacaaacataatgggaaactaaagtatgctaaaactgaaagtaccattagaatttgaagtttacaaattttattttatttccaggggagaaactcacttatggtctccacaagtatctgaagatgggaaagcccatcctttcaaaatcaacttagaatcagaaccacaggtatgcgttttagagcaaatgatacacattgtatttccttttaaatcatggggatgccttccaaggggaggaagagacaaatagaaaaattggaacaagccacctatgaagctgttgtctgtcattcctctccgagattaatttatattatccgtgttttcttacatcaagaaaaagaagtgttcctatgtgaacatcttgttgaaagacaaaatatgctcccatcagaaagaatttggctaaatctagagtccacttattattttttcatttcttatgatggacttctgtgaaatgaccgtgaggtaatctaaggagtttaagttgttaaaacaaagcaaagcaaaaataaggtctaccatttgaaacaggtgtctccaatctacggttactgtgaatttcaatccttcgaggtcttcacccagatctcattctacattacaatactacaaatgagaaaaaggagattaaattgttttttttaaggttgagattaggttaagggctatagcagccagtcagatggagccttgaaacattccatgactttgcgtcatgactaattcttactgacatcctctccaagaggccggtgtttgaaatgctccaagataagaacaattcagttctactaatgaaccaaaggatttctactccttatgagactcttaggccagatttctgcacggccagtttatgtaacttggtacttcaggacagacattccctacacaaaaataactaaattgcagtgtatctcctgctatccaaaaatcctttagcgtaaaccagaacaaaacgtgctgataaaagtcaaacagtgagtttcacttgtggactgagactagagaaaagctaagctatggttatagggttttttgtttttctaagtaatacaaagctgtgcaaaaaagatgtctttttcttttttatcaaaatgacaactctgcaaatacagcaatcttctggacagcaaatacgtgtcagttagagaaacaaatgccattaatattatcatgcttcaggatgtcattgcagatgaatagcaaaaggccatggaacaatatgaaatttgagtttttgtttctcaacccaagtcaaacttttattgtaagttatgtgacctttgacattggaataaaatacactttctcacttacttattggggaaaaaactataccatccaagcccagccacagatattaaatattagtatgtttatttctgggggttttttttccctgtgaataggtttaagctaaggagacattttcttatatggttataggaatagttgatataaaattttaatatctagattttaaaaatgtggccgggcatggtggctcacgcctgtagtcccagcactttgggaggccgaggcaggtggatcacctgaggtcaggagtttgagaccagcctggtcaacatggtgaaaccctgtctctactagaaatacaaaaaattagccagatgtggtggcacacgcctgtggtcccagctactggggaggctgaggcaggagaatcacttgaacccaagaggtggaggttgcagtgagccaagatcgcaccactgcactccagcctgggcaacagagtaagactccgtctcacaaataataataataataatttttccatgctatcatcaaatagctaagttttgtttctctgagtttagacttgaatcttaggcttaaagggcacgtcagttgttgtttagatcaactcccagcacctgaataaatgccttccatgcaatcctgaacacaatctatttttctctatttttctgtacaaaaagagacaaaatggtccattttttagtacgaagtgttgctcttgactaagagtatgttaatgaagctctttgtcctttttcaaagcttacattctcaaaccataaccctcatatttgcttaatgttagtggaacaactcaaaggtatactgtgcctgtcacaatacaagaaagatgctttcagaaacaaaaatggttcttatctaaataagaagaaagctgtctccatttccataaaaaggattgcatccttgccagagaagataatagagtttacatacacagtcaagaagagtgtgggataaagtcatttttattttcacaaataaaaagtgttttggtaactggaaggcagcccatataaaacaagctttcatagtcaccatttcctcaagctcttcccagtgagagatgggaaacacttgaaactgctcactggagaaaaaaggatgatgagggtgactttactgtttatttgaggggtgagtatgaggaggaagtgattctaaacttcaaacgtgatgaaatataatttcttcatcatgccttgatcaaatataagatcacttcatagagtttgtttctcttatatgcccaccattttttcatatatatatgatttgattttatatacacatatgtatacatattatatataaatatatatgtgtatacatatatgtgtgtatatctatgaatcaaacatactgtttctgttggagatggttcagaattataaagattatctgaatctttatctgtgagcagtctccaagtaagaagttgaaaggtgaagcctttgactgctgtcatgtctgaggtcattccaaggacatgggagactgctgtccatggttggatcctcttaacatcagcagagttctgtcaagttacttagctttcactggggcagctctagcattccattaattcaaaatgttgttccttaatataagcctctaacatttaaaataaaaattttaaatgtatccattaagggaataattacatattgaattcctaagaaataagaattatttgggtggttttttctagatagaataaacacaagagctggactatattaactgttgtatacacttttttaactggcattttcagttacttgtgatttttccaggaaaaataaaaatgaattaaagtggaacagcggacttctaattggttttgtcttttgattacatttgaccatcaacaatgatgtaagccttggatagaatgttgcccctcagtgccccacttaaatttcttggtaaacctttggtgtatacacttcattgtgctttttggaatgactctaaaagcccataaactaatgctttgcaaagcctaaataaaaatgtttgcagcctgtattagaaacacttccttttatgatctgaatgtaaaacagaggttgttggtttttttttnnnnnnnnnnnnnnnnnnnnccatttgtgatttttgcaaaaaatgggaacccaaaccgaaaattgcaaaaaaattgtttggagctgattaacttacatgctgctatttagaaattttactagagattattaatgccccaatattttcaaagaagttgccttatttacagggcccccctccctatatttaattatcatcttaaggctaagaagaaataagggcagaggtattttccataaagccattatattatgttagtttttattaattcaattctatttacaaagactttaaggcaggccttacttttttttaaaaaaaaaaaaaaaaaaaaaaaaaaaaagctaagctccacaaaacttaagtgattcagtactgcctgattctttaattagcctgagagacttgtaatccaccaaaacttaactaggcagttaggcaattagtgtgctgtcttctctcatatcaaaaaggcttgaatcatggccattgtcattacttacaattatttctagtttttcatgccataataatggctaattatactggttaatcacaaaactcagccaatccaaattcactaataaatcagctaaaacaattagattgcaccatttataaatgtttagctacacacattttcacaggatctaggattaggcatttttctaaagctacatttgatggtttgggtcattctacctaagagcagctacaataatgttaatcaactccttggctgtgagccattattatgaaggaaaaaagttaagtgaacaaggtatcagcgaactcaatcacactacaaaatcatagactaaatggaattcaactcagacctcctttttgggttcaggaggctgttaacatatgctgtccaaggttggtgagagaaatgctgttctttaccccatcacagattctcagatcccctgagatttggggtgggtggagtcaaaggctcctaggctaggatttgaagctgcaccccattgccctggcataatttttgtttttttaagtgagctttgccaataggcctagatagtagaagaaggagtatactcagaagaactgaaagaaagcgttttgtagctggggtccctacaggaagttgttcatattctcaggcacaagaatcttctatgaaaaactctggtcttacacctagggaagagagacactctcttttctttcctcctcctttttcttctttttgtttttgacagtctgttttctaacagaaaagcataacccacaacttatctgaaatgaaaaggagaaaactaaatattacaggatcttttaatgttttaaagatgataatctctttccagtattatttcaaataattatatatgtttgtacgatttcaaatctggaacactggtgccacattcacgaaagtaaatgaagttgatgtgaatgtgtaagggaaaatactgttagaaagatttatcttactaattctgccaaatagaaagatttggggctgggcgcggtggctcatgcctataatcccagcactctgggaggccgaggcaagtggatcacctgaggtcaggagttcgagaccagcctggccaacgtggtgaaaccctgtctctactaaaaatacaaaaattatctgggtgtggtggcacacacctgtaatcccagctacttgggagactgaggcaggagaatcacctgaaccggggaggcggaggtttgagtgagccgagattgcgccattgcattctagcctgggcaacaagagtgaaactctgtctcataaataaataaatattaaaaaaaaagatttggaaagagaatcagctgacctgtaattgagcattcccttttggttttcttctgttgcttagaagaaaaaagttttaaaggctttacaaaattataaatctgtacaaaaactggaaaacatgattcccacgttaaaaaaaaaaattataggattttagatcattcagacatgtttcaaactcagggttgaggactctgctgtttggtccttttcccaaggaataaagtgaaaatcctcctgtgaaccatacacattttctctctctgaattactgactttaatcttttggggactagagtaaacatgaagaggtcttcaaacacacaatatgaaatcattacaataaagggaggggttgtatatgttattcccgctttcataaaaagagtctttcacttgtgttttctaaaattaagattatagcttaatccaagttaagaactttttgttaaaaggtgttttcaaaaacgagttttcacctggcttagtttaaatgattcagtgtagctaattattcgtaaatgctcattctccttgttttgttccctcatgtctcaaaatgggggaaagtttatcaatgtatcaatagaagagaaaccatatgtaaattctacttgagaaaacgttaagtatatttttcaagccaaaaatcccatttctgacacaaaatgtctgtattcaaatgagtcattagaatttcttaaagctatagatgaagaagtcaggggcagataagaggtgcaatgtttaaattattttataatatgttaaataaggtcagttccttttcaccttaacatttgatcggtgaatatagcacatgtaaagctcagagaaaaccatggaaaagtttatggctaactcctcctctaatctttccgtcaatctcgtcgtgggtaaagatgcctttattaacagtagtgatgctgttggtttcgctcactaatggctttcttgtgcgctgtgtggctgtgtattttgtctgccattgtacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcaggtcataagcgctgagactgtggagtttgcagtgcatgcttcttaaatcagttcttactaatcatcaagaaaagtaactggtagatgtttggagtggcttttctcattgcgaagcttatttcaaaagcaaaaagaaacaaactcacttggcagagaacagaagccaaataacttgcatttccaagagtaaatattgacaagatgacagagctgtgaaattgtatgcaatcaccacgtgtatttatagcgaacacccctgaggctctggggatcccatccagaacactgtgacctttgagtcgggcagtcagtatgtctatcccaggtcaggaaagccctgccagcaggagcgagcatggaaaccagccccggttaggaggaaggaatcaggtgaacaagccagaatgataaggagcaagctcttccttctcgtctctcagtagagaaactgatcatcttcagatcatccttttcaaatatcttctctagaaattgaactccaacctaaggggaaagaaaataatgccctgtattgccaaatcaggaaacagtgacttcaggaaacctctgttccatccttctgacctcagctaagccagtcagcccacaggaaggaagctggtggttagaccggattgattccgacaggaacattgaatatgatttaccgcagctgttgcaaactgatggcccataggtggatttatttcacaggcatgttttatttaattcttttgtttaaaaaaaaaaaaagaatttaagtgcctttagacagaacatttaaactcaccatcttgtcaaaatgcacatcactcttaagtgtgtgagacacggcccattttcatacatgtgtgacctcctggcccctctagacacccgagcttatgactcctgtcataagctgcggatagcaggtcatcccttatgtatgatttccatgtccagacctttcaggaagctacaggcagagccaggtgattgtctcaaaatatgccagacaattcttgtgatatcagatccagaaaggagccctggaccagaggagcaggagaaaggcgttaagaaggcaaccatgagcaaacacatcttcccccccctagaacgtgagctcagtgtctgcaggggcctggtctgactggctcaacattatacccccagcacctagaaatgagacagaataaatgctcaataagcgaccatctacaaacagacaaaataaatgcccaataaatgctcactggataaaggaatcaaatcctgagggtgcacaacatttcccaagcaagtggcaagaagagtccagagccgtctcgctcccgatgctggcaggtctgtgtcctctcctgcttctctctatgtgttccctcgttcatactctgttctcatctgcatcttttccgtttctccactttcaacagcttccccaccccaacccaaccccaataacaaaacactggatttaaagttaaaaggatatgatattttactgttgaatatatacaacttcccaaagaagcatagtaaaattaatcacttgcattcttttcaggttagtgtgactgagtccacccacacaagctctggggcttcagaaggcttgaataaagtgatacgttagagtaacacatatcctgcctttactaaaaacctataacatttaattttataaaaagtcaggaaagtcagagaatcctaggtatataatcaccttttaaaaaaatttttcattttaacttaaacatagggataatggcaagccactcataatgttgtcatttgaagatcacaccttttaatgtagctgaatttggaagagagaaggagagaaacagaaatgagaaggtttgcttaaaaaacagatgccagtgcacaaatcttaaagaattataaggcctggtgcgatggctcacacctgtaatcccagcactttgggagacagaggtgggcgaatcacaaggtcaggagttcgagaccatcctggccaacatggtgtaaccccatgtctaccaaaaatacaaaaaattagctgggcatggtggcgggcacctgtaatcccagctactggggaggctgaggcaggagaatcgcctgagcctgggaggcggaggttgtagtgagctgagatcatgccactgcaacaagcgtgagactccatctcaaaaaaaaaaaaaaaaaaaagaattataagagtgcccccaacatcctccttctcttcctgtccctcctcactatttgctgtaacttctgaattttttgttcccaccaaactattcttcatcaaggtggaattgtgagtggctgcataccagcctacaactagatttgtttttaacttttaaaacaaatgtagtttttttcgggtgcattctacttgtacatgtttatggggtacgtgtgctgttttgatatatgcatacaatatgtaatgatcaaatcagggtaattgggggtatccatcacctcgagcagtaactttctttgtgctttggaacattccacatccactcctctagttattttgaaatatacaaataattgttgttaactatagtcaccctgtaactacactgttaatgaacttctttaatcaaaagtaagttggacatgctagtgctggacatggcggctcacacttgtagtcccagaactttgggaggcccaggtgagcagatcacctgagatcaggagtttgagaccagcctggccaacgtgatgaaaccccatctctactaaaaatagaaaaattagctgggcatggtggcacatgcctgtaattgcagctattcaggaggctgaggcatgagaatcacttgaagctggaggcagaggttgcggtgagccaagattgcaccactgcactccagatgggtaacagagtgagactgtctcaaaaaaaaaaaaagtagtaagttggacatgctaaattgttaacagctcaatttccctggggttttaccattagctatagttcttttgattatttcatcataactgaagccttttaaaagactggtgttttcatatacaaatatgtaaaatttttaagggtaaagctacaattaaatacatatgtaaggtattttagatccaaatgataaaatgcaatcctatgagtggtttttggacaagttgcttccggaagtatgccccaaaatgtctgtacacaccccagagaaattagcaatctgtcaaatgacgtatctgggcatgaagtaattgagtgtgttatcaaccttacaagtggccttgccaagtcactaagtcaaccccagaaaatctcattagcacctgcctttccaggtcatcaggaacaggtcgtggtgacccacggtgctatccccagtgatatccacagtgactggaatccatgaaaactcgtttacttaaaggatcagtttaaaagatctttttaaattggcccagaaatttataaaagttcattcttgtttgcttagggttcattactcatttatttaatagacatgggcctgattgataaaggaactgggaatgcatgtttaactaaaattacatagtacacacatatgcatatactgttgaccctgagaacacgggtttgaactgtgcaagttcacttatatgtggattttttttccaataaatatgttggaaaaatttttggagatttgcgacaatttgaaaaaagtcactaatggtagccttgaaatatcaaaaaaattaagaaaaagatttgccatgaatgtatacaatacacataggtagtagtctatttgtgtgctaatagactgtttatctgtaaaacttcggttcaacagtaggctattggtagttaagttttggaggagtcaaaagttatacatggcttttatagcagaaaaatattactaataaccgctataaaacatggcataagtaaaagttctaaattgatcattgtttatctacccagtacgggcactatgtctggcacacagtagggtgagagtagttataaatgcttgttgagtaggttcattactgggaggccgaagtctcccaggatttaactctgtgtttcaaatccctaaactgatttcataagcttcattacactcaggttaaatccacatgatcctgactaaactgcactacaactgaaaatgtactcatattcttttaccagctgaagtccatttcaagagtcactatagatcgtacaaaaatggtgaataggccacttgatattttggtatgtgatctaaacaatgtacagattgggttttcaataggttctcaaaaggcaggaagtgaaggagcaagctggtattcacctgtctggtttaggttatgtaggtagttaaactggatagcacaagaccaaaaaaaaaaatttaaacccatttagtgacatgagttctccagactaatccggctgcaacattgctggagtagagaaagttactgctcaataccttttggtttcttatctttatatgggctgaagttagcattaatacctctagagagtaaatgcagatatggggccatacttgagaccagagacaatcttgacttagcggtaaacacaccatatacatccattctctgtcttgagcttacagcaacactaactggaaagtatgataaatatttacattaatactaatatttctttttgctttgtcttaaatgactatgctttttttacaaaaatctcttggtatctctcatgcatgtggaaaaatggactttttagtcactagcatgtcagttgttaactgacccctatccagtttccaaatagaatgtacaatctccctagttcttcgatgtgcatgactggcctttgatgttttaataagtccctgaaatgtatctttaaaaggaaaagggaaatatgcctgggaatagatgcgtgcttctgaaattgtgcataaaatagctatgtaagaaatataagcatcgaaagagtgaaacaccaccttatttctcctctaatcattaatttcaaggtgataagcatttattggttttttctagggcttgtattaaaccactgaacaattgtcttaaagtatactcctcacagaactaaagagtaaaaatagaaaatgttaaaatagtaacaaaatatttacaagatagccttaaaacataatctgtaccataaaacctacaagttaccaattactattcaattaaagttcaaccgtattactgaaatatacttctgattttgaaatgttgagcccaaatatgtgattgcatcttcatgctgcatattcagtgttcactaaaactttaattttaaatgttgcacttcagaaatgtaaaaggatgtccagccaatgtaattttccttcatcacttgtgatattgaccagttttaaagtctttggcctatttttaaaaagtgaggatagctgcatcttttctacttcatatacaacttttctacatgtaaccctcaacttacacattgcctagtgaaacagagccaaaaaatgcagtatcacctgtaccttttaattttattaaacttttttcaatcatgaatttttcaccgtcttccctttataaataaattctagtgacaaatcaagatttggttttattttgatgtaattcacctctcacttttgtcttcaattccttttaacctctctgtacgtgttctctgtgttcttctgtctggactgtctggctcccggtgccatctctgtgtaacgtgtatccattaacacagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgaggtaatatgagtctctttgaaccatgggcatattaactaaacacgtgggcaatgtcagctttactggtgtcttttaacattgtcttaatggaaagaaagctatgtgaaaagcttttttaaaatactaaggatttactgcaaatatctaggcttggaaagaaagctatgtgaaaagcttttttaaaatactaaggatttattgcaaatatctaggcttggtgataaaggtgatttgaggaattatctgtagagctttatgtgtcagatagcaataaaatgaaatcaggtaaggaccaaatgtatatgtctctcgaaagctacaatgtactttacaaatatctggtgtaatacttctcaaagttatttataatctagtataccctatgtctgtcctttggggatcaaaaattaggaaggaggtgggaggtttagaggaattttatgagatgattcttctctcttctgatagcagcttgtggagaggtcattatttactcatttacaatgtttattgtgcataaaggtttttaggtgaataccctcaggctgttaatgtagatatttaatttttgctggtctctttttgactaattttttctttgttataactatttgttcacagtacttttgccataaagattttgattaaaaagatttattataggataaaatcttactgcttctttcactattacagaatcactatttataaattaaattattataatgcttcagagtgttaaatagtgatatcccaaagctatctcttgggatgaacacattgaactaatagtagtgtaagatatctcaaagccatttgcaaatatgacatagggaataaaaatattacagatagtatgttttctagataatgcaataaaatgatataaaataataaagtagtgcttaacatatagtattatgaaattctttattgtctattatgaatatatttgtagaaagcatgttaaagctgctgtcattattgtaaatgaattttaacatggctatttttaaaagacagtgcagtcagttatagcagatataaaaatgtaagtttctacattacaggctttcaaaccctgagaggttaaatttctagaatttacaagtaaaatgatacccttgttatttccaggggttaacaaattagccttaaaactaaaaacatattaaaccatatactttttgtttaatatcaaaagtgaatgtgaattttaccgacaatttgatgactgagaataatctgagtgctcactgctgcactttctgtcatgtgtatattgccttttctctgggaaaagttaattttgttcacatctatcattatgtatccatcagactcaagtcttgttcttcttaattactatttcctgacaattatcttttagtttccttccaaagtattttgccaagtggaggagtgtgggtgtgactccccgatttgttgttcaatgacatttccaaggcagccatttgaattcacattatgcttttaactatactagagattcacttgaaaatactagacctctgttcaggagtggctgtgcatagagtaatggctgagtattgatgtctctggcctcttgcacgtctggtgcctcccagcgcctgacgatgctccccgccgtgcctgtgtttcagcgagcccacagcctcggtgccccccgagtcggacgtgtaccggatgctccacgacaatcggaatgagcccacacagcctcgccagtcgggctccttcagagtgctccagggaatggtggacgatggctctggtgagcagccgctgacacctgctgaaacgtattgatagaggccactgcagggggcgggacggggacgacagcaaacatactgggaatgaaagtctaaaacttggttttcattgggagccaaatgaatttttgctcagaaggataggatatggatggtgcctcgtttaaaaaaggagattccaggacatgtccaagtagccaccaagtgaagtcacaaaaggacaccaaagacaaattgcattaatggtagtcaagggctagctcagcttacaaatcatgagatatcattttaaatgaatgttgtcaaacttctcagcctcccccccacactctggagtatcaccatcatcaaaaactaaacaatgctctaaaaacccttactgtgttccatgttctgtgcaaagtattttgcatacagtatcatgtaatcctcacaggaacttggggaggtgagcctattatttgccctacttagcaaatgagacgctgagagatgggcgggtggccttgtgaaaggccacatagccagtgagccacagacctgggtctccagcccactcccgtcatcttcagggctcctgccctgacctaggcttctccatgcccaaaagatatagactgtcctttaaaagccacacaaaaatgcaaaatgtcccattagggtggctattgtggcagacatggagaataacaagtattggtgaggatatggagaaatgggaaccctgtgcattactgatgggaaggtaacatagagcaaccctgggagaggatggcagctcctggaaaagttaaacacagaattaccatgtgatccagcaactccactcctaggaatataccccaaaacacttgaaagcagggactcaaacagattctttattttttttttttcttttttgagatggagtcttgctctgttgcccaggctagagtgagtggcacaatcttggctcactgcaacctctgcctcccgggttcaagtgattcttctgcctcagcctcccaagtagatgggattacaggcacccaccaccgcgcccggctaatttttgtatttttggtagagatggggttttacctcttggccaggctggtctcgaactcctgacctcgtggtccacccgcctcggcctcccagagtgctgggattacaggcgtgagccaccacgcccagcctgtatgccagcatttatcttattcacaatagcccaaagagggaaaacacccaatgtccattgactgatgaatggataagcaaaatgtagtatacacatacaatgaaatagtattcagtcttcaaagaaattaaattctgacacacggcgcaccatgaatgaactttgcaaacattatgtgaagtgaaagaagccagacacaaagaggcaaatattgtatgattccatttatttgagagatccagaataggcaaatccaagagacagaaagtagaatggaagttaccaggggctatgagcaggagcacggggagttactgtttcatgggtggggagttactgtttcatgggtacagaggttctgtgaggtgaagaaatagttctggaggtggatattggcagtgcttgcacaacattttggatgtacctaatgtcattgaattgcacccctaaccatggtgaaaatggtaaattttatgtatattttgctacaataaaaaataataatgccctctgctcctttgagcgtttttgtaacagtttcctccaaccacaacaaaataaatgttttcactaattccattctataatgccctatttcagaacagcgtcccttatgattgcatcagtcctgcccctctcggaatgacggtgcagatgcaacttcaggttaaagtgcacactttaaaatagaagccaagcacaggctgcggccagctgttccctagccataaatggaaacgctttgtttttcagatgaccgtccggctggaacgcggagtgtgagagctccggtgacgaaagtccatggcggttcaggcggggcacagaggatgccgctctgtgacaaatgtgggagtggcatagtgtaagtttcacttttaaccctggaatttacgatacagcttggcgacagttcatttcttctcctttaagactttatagactaaaggcaactgtgaaaaccaaatttctattcatcaacttgaaacgtaaggtccccaacatttagcacattgtgactgtcactccttagatatacctccaaattgtcacatcacatgagtcagcaattttgacttacaatttcagatagattctcatgaaaaaaaaaagatgcccaaatgtatgttgaaaagtcacgtctaagaatcaagacttcactttaaactcccccacccctgttaacgtatagtgtttagtaaatgcatacatgaactgtgtatacatttagtatacatagtatcctcctctgtataaacacagggaaacaaatacaggcaacatgaggatgttacttaaaatacattatccttacccagtgtaagttacacaaatgttgaaacaaaatattgaaaaactgtcagcttccattacaagggaacttttatttattcagagatagagccctgctctgtcacccagactggagtgcagtggcgcaatcttggctcactgcaagctccacctcccaggttcaagcgattctcctgcctcagcctccccagtagctgagattacagggacccaccaccacacctggctaatttttgtatttttggtagagagggggtttcaccgtgttggccaggcaggtctcaaactcctgacctcaggtgatccacccgcctcggcctcccaaagtgctgggattacaagtgtgagccaccgtgcccggcagggaccttatgtttaaatagccacacttgctagtgcaggatcaagtcaaccaagataattctaacatctccatggcattcgtgccatgtggccacgtccccattcccttattccattcctcctgccatgaactcacacactgatgtgtcctccgtccggttagccaggatacatcccaagaaggcagtgggggataagcctggttagggcaaaaggaggaacgtgagaccaaaaggtcaaagcagggcagggagctcggagcagagaggccctcagtaaaatacaacagtgcctgacgttaccagaagcaatcattgtgcctaagttggaataaactgttcacagtagaagccaatccacccaccccaaaggaattccatctctgctgtttgatctggttttttgttttgttttgtttttgttgttgttattgttgttgttgtttttgagacagtctcgctctgtcgcccaggctggagtgtggtggcgcgatctcggctcactgcaacctccgcctcccgggttcacaccattctcctgcctcagcctcccgagtagctgggactacaggtgcccacgcccggctaatttttttgtatttttttagtagagatggggtttcaccgtgttagccaggatggtctcgatctcctgaccttgtgatctgcccgccttggcctctcaaagtgctgggatttcaggcgtgagccaccacgcccggtcgtctttgatctgttttctcttgctccattgaatagaggctggaccacgcagacggaaagcaatcagagagactcttcattgggtagacaaccacccccgtcaaaagcagaatcttttgcagaggggttggtcttgtctccatcatgtctccctcttcaaagaaacgatggggaaagatcatgaagtaggatcctacaaattttctataaagtacttgtttgaaaatctgaaaaatagtcacacgtcaacatcagagagaaacacgggatggtttattgtggatatcctagatctccatgacaattacatacagtttcacggctgtgcctgctttcacagctggaggccattgtttcctgactgtgaaatagagaacatctgccttctctgttgggttctctcctttgtctcatatttttgctttgtggttttttaacttgagctcgttttcttccccaacagtggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaatacctaatgaagtggcattcattgaattcaaataaaatcaacatttcaatgagagaacccaatcatattttaacatgtacactaacaaatattttaagataaatgtggcttcttcaggttttataactcattactctttcttatgagcacaaaatttctgatgatagaagcgttgaaatttgctagttaaaggtagttcagtctctttcaaattaaaagtttcacttgcttcaacagagactctttcaatttaaatatctctttcagatcaatattcagtcaaattgaaggttcaaagtccatcactgctgtttcttaggctcaatggttcaccacctcctcctcttcccaagatggcatctccaggaagaaacaatttagacgacttcctaaggaaggcaggggctgctggtctcctggggtcctgcttgtatccactgttgaaatccttggtttcacttgtgatctgtggtctgttttcttgacatagttgaggccaggcaataataacacctccactaccacctccaaaactctcagctcagctttcctggagtcatggatcctctgtctgagacatgcactctgcctggccctggcgcaggcagcctaccttgcaggctctgcatggcgttaccttgcctctcacccagggtgcccatggcaatgctcctgacttgcatctctcacctactttccatgtcccccactggggacgtacaggaacttctgaaactgtcccctcaggttcaaaccatggggaaccagcagggtggggaccctcagaccctctgtctcaccaccttgtgtcacatggtcatctctaccacccctcaacccccacagctgctaacttctggcctgaaacaagtgttctcctcccataaggtcccaaatgggacacaagttttattgctctgggattcttccaaacttaactgactctgaccctgacctgttcaggattttgagaggagccaaaacacgtgcctggcccctgtaggcatttgacattgcaactcctgtgccaacacatgcattcactaacaaagctattaaaaaaataaaacagacttttgagatcaaagaaatgaatgtatccaaaatacatgtttgttcaacagtcattttcaaacattttgttctgggaaggatataaagttaaagtttagaaagcaaatgaatggtaactgactttgaaaacctgagaaagttaaaactcaaagtagcaatggagaaaaccataaaccaacccaatttactctctagaatcttaaaaaggcatggcaatgggcagcacctggcatttccggaccccaggataaaggtacgactaccataaggaaagctgagtagaagctgtttcagaagcacttaatccctagagcaggggtccccagcccccactgtggcctgataccagtctgtggccttttagcaaccaggccacgcagcaggaggtgagcggcgggctgccgagcaaagcttcatctgtatttacagccgctccccattgctcgcattaccacctgagctccacctcctgtcggatcagaggcagcactagattctcagaggagcatgaaccctatggtgagctgcacatgcaagggatctaacctgtgtgctccttatgagaatcgaatgcctgatgatctgtcactgtctccatcacccctagatgggaccatctagttgcaggaaaacaagcacaaggctcctgctgattctacattatggtgacttatataattatttcattatatattacaatgtaatcataatagaaataaaatgcacaataaacgtaatgcacttgaatcatcccctaaccatcccccactgcccccatctgtggaaaattctcttccacgacactggtccctggtaccaaaaaggttggggacctctgcccaacaggctccccctgctaggtactatctggaaaaggtaaaacagagcatctcccaattggaaggtggaagcacagttgatggtacgtgtacc

SEQ ID NO: 17250 - DNA, 32669 bp, Human
  misc_feature (1)...(32669): n = A,T,C or G
atgaattgcagaaggtacacgggttgttaagttgcaaagatagaatctgaacccaggtttcaagttaagaactccactgtctgtgttgtcaggcacattgtctttcaaagaagcaccaggaaatgcctggatttggactaatttctcagaagagaaacttcttcccataacctaggctatctccaagggaatgtaaatatgaagattatccttatagacagtgtaaaatagagattattttctagtagtttgtgggccgaggcttgtactctgtgaaacacaaaacagttgagcatcggatctttaaacctggaggattttacttaaaaaagaagtttggattgccagctacccttgaaaaatttggagattttgagctaggctggactcatattcccacatggccacaatcagctgcagtttttatctgctgttcctgctagatagatgtgtgtcctctggtttgccacagacctcactactccttattaccttcctcgtagctcatgttcctcatttatgttgcctgtttgaggtatttgggttagaaacagctggagatgttctgtctactgcatagtgtttataggccatctgctttcaacttacgtgaaaaataaaaagttattaacagtaaaagagccaaatatatcccattctgcttacccaaacctggatgtaataaagacctcactgacagtgccacatagaaagcaaattgcttctttctttactaaagcataatattctgattcattaaagaattaggatctgccagtgaattaacatttatttttaaacatgaatctcttttctttttaagtgtaatagtgaaataagcacattctactcattgccctcattttatgtttattttagtaatgtctactgtcatcattatcatgtctggaccctttataaaaaaaaaatctctgtgaacctctgtgtacatattaaatcagtcatttgaaacaatatgagattgtcaacctaacggactgcattatcctgggcatttagacaacattattgaacttcaaatttttagcttaacataacatttgtcagcagtagatattaagcatttatcataatttataagtatatatttgcttgcctcttttctttttttgcctcaccccagaatataagtttcataaagctggaaactatatctgtttgttcacaatgtatattctatgctttgtacagtgtttagcacttaacagtcaataatgaatgaataaaggaataaatatgtaaatatatcagtgttgtatatgataactcattcttctgtaatcttaagaataatatgtaaaaattctcagcaaaaatgctcatgcttttttcatttgagaattaaataggggagatatttatttcttattatccacataaatatatatccacttctgtgtgtgctatgttctatttaggatagtgcccggtcttcctgatgtgaggtcaataggcaggttacacatctatgtagctaagaataaggtgcatattaagaccaggatgcaagaagaggctgttgaacttgaacattcagcacagagtctcttctcttctatactaaaagatagtcatcctgcagtcggaagtggcagttattcggccattggaaaagtctcatgtaatagtagcttttagatgatgtctcctccaaaggggcattctgctattaacctattgctgaaagagaaataccattgtctattaatactactggaactaaagatgaatagtgaattggccttgatctgacagtgagtttgactttgatagctcgtcacttaaaaaggttcttttatatttatgaaaaaaagcatgacgtcaagccagggggaaaaattgatatcaacatttaagaccaaactcgtagggcttccaaaaaaaaggcccttatgtgaacgtttttttttacatgcataactaattagcttaggttattataagcagggcttctgtgataaagtttccggtggtgtctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgagatttattctgactcatattcagtctttgaaatataatgcaataaattgatttaatccactttttgttattgtaatagacatactgttttcaataagtataaatctgctcttttaatgctgtttattatttgatgccataagaagtaattcaatgtagttttgaacaaagtaaatattagtaggattcttttttttttttttttttggcctagtgtgtggctaaactatcttcatcagctcctgttcattgctcataagattaaattgtctttatcaagaaaaaagtgacttaaaattgaataatgttgttttttggggaaaagtatttctcgttctgaattaatgtctgtaggaaaggagaaaaaacatcctgttggcttgttaatagtcatgtcttttaaaacacatacgtgtaagtgttatgcatttgaaagaaactacttaatgtagaattgctttttatgttgagttttttcttaattacaatgttgaataatcatgtccaaatgaaaagtgggagaattaatccacaactagttgatttaatcattggaagatttatatttattttctacagccattttacacagttggttcttaaggaggtgtgtgtgtgtgtgtgtgtgtgtgtgtgtgtgtgtgtgttttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggcttaataatttattctgttggtggcctggtcagtttcatgtttgtgcctgaaggaagagccgtctgaaactcacaaataacagcgctgttttcttttccctccatggctatgttcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagaggtaattcatgtctcctctcctctcctgttttcttatgctaaataacttgtctgttgaatatgattcccacacttaactgtggactctagtttgtccttgtggccacatttaccagcctttgtccccgattcaccatcgtggctgtggcattccagcctgttgtctccatcgctgggttattgggtgtagagcacatgacgggagacctggccctctccaagtgaaatgtggaggcgaggacacttttgccacttgcttcttcttccttagctgagtgctctcttctcttccatgcctttcagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaagttatagactgtttttgcttgtgtttttgcagggattttataagtttgaagagcaaaacagggcagagagcgagtgcccaggcatgaacacacattcacgagcgtcctgtatgcaggtactgaatgacttggcagcctgaggatgaacactttgtaatgagaatctatatttgtggtggatcacaccttcctgaaaacttaagcatttttttcccccattgttttttttttttttatagagaaagctaggaacattgccattttcctcatagtatctcatgattaaataatgacaagggagaataaactaaaatgtgtttttcccctaagttgctgcaaagattaaaaacttcttaaagtacataaattttaataagatatgaaatatgtactttaacataatccatatatgttatacaaatttgtaggttagcaatttttgtattagtaaaaccaagatgtgtgtgtataatctagatattgtttcctaaatggaatctcatggaacatacattttgaaactatattaatttaataacatataatggatgctttcccaaataactaaagtttcttctactacatcctatttaatggatatataaattatgctatatctatttatatatctatgcatgtatatagatataggagagaatgataagcaacaaaatttgttgcctttctatgtttcctgtcatcaacttgcattatttttgtcataagagaaaaaaatattttaaaaatgctattacatcaagcccactaattttatttttctaagaacaaaattaaaagtggcaaggaaatgttgttcataagtttcctagcctatttgcatatttaccaactcaattagaaaatcatctcttaaagacaaacaaaacaaataaaagtggtgtcaatagaaatggaacctaacaaacagtggatagtagttattcaaaactggccaattattctttttaggggtcattaataagactccttttttgagtgtttactatgttcctggtactttgaatgctctgtacagtttgtcctgaaatcatacaagaatccataagacagtaaatattatgaacccccattttatagattgacaaactgaggctttaaaagattggaggctttgccctaatctagaaagcaggagaacggggattccaacccaaacctatgaattttggattctctcctctttaatggaagtggcaagagacagaagagcatccctgttagttctgtgatttcattgtgtaactatgaagtcctgttaagacccaagcacagacacaccaactagctcaaatacataaggtgtttatgaagaaatgttttcacaggcttgtctttgcaactgctgcaatgcacatgtaatcactgttgtttattatcataacttatgttttggtactttagaaataaaattgatctagtgggaatgtcagctccacgactgtaatgataacctcatcctggtgtactccctggggagtaccaagcacactggtagctgtacaaggagaaacttattttacaagtcactgtaagatgggtgcagggatagccagtggcctgggagccacagtgtccacacttccctgtggaacactacagacggtgttttccttctgcaagaaaagggtaggggccatcgtctttagggaaaaaaggaagtagaatgacagctgtcattcaagatgaagtgctgtggtacatctctcctgtttagggcaggcagtttagcatagttgtgaaagcatgggttaaattgtggctccagtctttcttcagtgtgtgactttgggcaagctgcttctcatttatttcacctggaaaattgctataataatagtacctgccatgatacggttttcgttagggcaaaatcttagcctatgaaaatcctcgaacccaatgcttggcaactcataatcactcattaaatgctggctacaagtattatcctcatcacctattcgtgttaatggtcttcaatactattttatacttcaatactattttagtggaaagaggacagttacttcttagaatctaactaaagaccattattgctttgggtaaaaaaagaccatgagtctctttttaggttgtgttgcatagtttatttatttttgtctctcttctcttaccctttttcctacagatggatgatgtaatcgatgacatcattagcctagaatcaagttataatgaggaaatcttgggcttgatggatcctgctttgcaaatggcaaatacggtattgataacctttttttaagtagaaaatcttgaggtgtttccagggttcttttcttttttcttaaacttttattttatctttgtaactggttcactgattaaatgtattaatagtaaaatggagaattatctcaggatcacaaataagtgactttaacatcagaaattaagaagtttttatgagtttatgaataatcccatgataaaactctacattccctggagtccacgagcagttttgatagggcattagcccttccaattcccttgacatctaatgcccaacccagtacactgcagccaagggaaccattgtgaactgcactattcacagtggtgctctagttggcctgaaaaagttggttcagtttttcaagaaggttttctcatattcttaggtgatagagggacattggagttacccttctccaacagcaaaatctattccaacctcagttcataaacaagtggtcctatttgctattgtatgttacttgtttttctctgtaatttagagccttgcctatattgtttattttccttcattccttacattttagtcttatgttactgttttaccaaagtcttattgcacatcttatttagtccttgcagttattctgtgagtcaagttcggatggtatcattgccctcagttttaaactgtaactaggttagacagtcttacgcaagattacatagcttgggtgtatcagagccaggcctgcttggtaggtctttgaatgccttctccaatccttttctgtttcctctgagagcaatgctatgagactatcatattcttaataactagtgttttaaagaccaatatttattgagaggaaagggaaaaggggagttgtttaatgggtatggagcttcggatttgcaagatgaaaaattctggagatctgtttgataacaatgtgaacatacataacactactgaaccatacacttaaaattggttaagacggcaaattttatcctatgtgttttttaccataatgaaattttttaaaggtatgactaacttccagtagtaaattcccttggccaaaggacaaaataacacttacttaggtacaccagaatcctcagaaaattgagtcttatagttagcattttcttttcttttttttttaaatccatcttgatccaattcttcaagttcacttccttgaactcatgtggggtgaggacttcccttgaaacctcaagcttcttttatgatatttagagtttgtctactttctacccatttaaacccaccccctgattttggaagaaccaggtgttctactattgtgatgaaagtttccatgccatactctccgaacctcttggaatccttggttggcttctgtggaaccttcctgcttacaagttgttgcatcctatgaggccaaactacacttatctagcactcagaatcctaggacaaacatgagtaaaacacttgggggagcatgccctggggaatttataaatatacccaaagacatgggtatatttacatttcactgctctagcagcattaattagcaatggcccagtcatctcaaaagaactttgctgtgagagtggtcattttgctagtggtgtcaaatgggtccctgggcacactcaagtgaactgtagaattgacatgattctgtaaaatcattgactttttttgtaatggcaaagacctttgatatcatttggtctaacctagtactcaatgcattagcctcctctttttttttttttttttttttgatacagggtttcattttgttgcccaggctgatcttgagctcctgggctcaagtgatcttcctccctcaagtagctgggattataggtgtgtgccactacacctggcctgaccttctcttgcatctcgttagtattctccacaaaaaaatcaaggcatccagcttcttggaagcctccaaaaaaggatctgtactagctcactagggaaatagcaaagcacaatggttagaatttagaggtttctgaccagatctggggtcaaaccctgaatcttccatttcctctgtgaccttgcatgttatttagcttcctgaaaccctacatttccccatctgtaaaatggggctgttatatatacctatattatgtggtcaactcacttggtaaagcatctgtagtatttagcattggaaacataagttgtattcaataatgttatctaaattattaagtataacttattaattataatatcaaataatattgatagtatttgtttattcagctgatcttcactgagcccctataatgtatcaagctctatgttagctatctgtgagacatatctatctcacaatatccctcacagtaaataactctgtaaattgcagcatgggtcccagtttgcttcatggagaacttttccacataccaccccttctgaagacagttgtcatgaccccatatatgcttctgtcctttagaatgaatacttggctgggtccatggttcacgcctgtaatcctagtactttgggaggctgaggcaggaggatcacttgagaccaggagttggagatcagcctaggcaacttagagagaatccgtctctgtaaaaatgtaaaaaattagctgggtggggtagtagtacatacctatagtcctagctactcaggaggctgagatgggaggatcacttgagaccaagagttcaaggatgcaatgaatcatgatcgtgccactgtcctttagcctgggcaacagagcaagaccctgtttttagaaaacacatttaaaaataaaaaagtagaatgaatcctcatacctcttcattccatctacattagcattgaggccttgttccttcattatctcgttgttccgaaagtatattaaagattaatttagcatttatggatatgcctaataggtggccagcaccaggcaaggtgctgtggatgcgaaggtgactaaggtgtgcttcctgttctcacgggggttaccagtctagaagggggagactcttttagcccttgaggggagaaggacaattcaggagcagagaggccatctcaagggaatttccagataagaaagatcctctgggcagagttgaattaactcccagacaggagaggagtcccctgcagccacccttagaagtcactgactttatcccggcatccacttctcttctttatccccatactggaaaggctaaatgtggctccattagagtctttcaacaaatctatttcagcattttgccattaggggaaagacaatgtaacttcaacattaggagcacagactctgaaccagacatctgaatacatactcttgacggagtgattcaacctctctgcttgtgtttccttgtctgtaaaatggggatcataatagcatctactgcaatagaattaatgggagaattataagaggtagcccacaaaaagcatttagaacagttgggccctgataagctctcactaaaagtaagttactagctcttattcttgatgaacttgggttttagttgtcaaaattaagtaacaaagctactgcaacctattaacattttaattttttcccacagtaaagtttaatgttcttcgtgttaggcatttttttcttttatttgattatttgaaatgctttatttcaagttaactacttaggaaaaaataaagtggaaggaacacttagagaggaaactgtcctaagggaattgaagtctagaaataactattctgagagcacaagggccctcttgtactatcacaaacaaagaataaaagtcccagtttacttgtgttaacagtgctcaattgatattcagaaaaggggaccatccagagagaaaaaataataacgttttacaattatcatttacttggaaaaatattcattttggtggagcacaacattgaagaactcaattcagaccagtatgggggcatagacccaggcgcatcttccttcaatttgtttgtccggattagactgtggctttcatctgtccatggtgcagtttgtgctctggaagtgaaatcttgtcatttaggtaaatggcctggataaaaatcccacaaagatgtgaaatatacatgttaatagaagaagtctcttcctttttcttagctctaaaggtgttattttgacctaattatgatgttaactgtatttatcgggaaagttttctaatgcagaagaaccaactacagaatcctttctttaaaatgcatggctaggagacacattttaaattatttccatcaaccttccttttagtagcttcagcaaataagagcggttgatagaaagaacatacaccaccatttaggacacagtttctcaaatgtggaactgttgacatttgggatggataagtctttgtggtgggagactgtcctgtgcattttaggatgcttaacagcatccctggccttcacccactggatgccagcagcaaatcccctgcaggtgcatcaactgaaaatacctccagatattgatccggggaaacaaaatcagctctagtgtggaatgcctgacttggaataatgactggtcacctcagccttgcagattccctgatttctgttcctagatttgcattgcagtctggtaaaaaattgtctaatcgttgacaatgtacttagtaattaacatagcaagtggttttgttgatcaagtgaaaattagctcacctgtcaaaactgtaaagtgggaatccagtactccctagaaaattagaatactgtattgttaatcatagcagttaccacttattgatcactgaagtagcaggcactgtttcacctactttatctctattaaatcttataagacccctgtgagaagaatgttgtcacttttcaattggagacactaagcctcagagaacttgcttaatatcacatagcaagttcgtaaagaggcaggattttaatccggatctctgactcctaagcacaggctataaagttctgcaccattaatcggtaaattggagtatccacattcggctagtaagcggcagggtttttatttcctcaggtctaattggagatgaattgaaagtttgcagtttctaactggttaatatcagcatgttgatactctccccacccccagttctgctgttaacatgggacgtgagcctccgaccaaaaacctccattaggcaatggcaaaaatcttggcttttctttctgtaaaaagcagtaagatgccatacacaaagtgccattttaattctgtgcttggcccaaagtaggcacccaaaaaatgagatgacccccagcaaaatattctgccatgctttctgcttcccactcctaatcagcaagtatgggaaaagcagccgaagcaggaaatctttcagagaagtagatagagggctataagctttttcaactggaagtaatgatgtctgatctcagtagagtgcccaatgaggcatcttgctatagggattttaattcatttccctttttgatgtgcactgtcgtcaatccatgctaatcacagcagtactttctgtagtttttcatgcatctcaatccatttctcactaggtatcccccacgttgctctttgtctcccccaccctgtccatctcgctgtctatggcagaaagcattctctctctcagtcatgtacatatctcttctttagaatatagttagaaaatatgttcttgtccagaagaagcttagaattagatatctgttcaacataggtctatcaatgacttggagatgtgtatcagttgctattatttatccctaacaaatcatcataataacacagtgagttttgcatacaatttgcctatgaaaaccatatgtgtgatttacctttctagagcaagtggaataatttttcttttagcttattgctttgaattttcaagtcacattcttggtttgttaaaacctcaacgttttcccaaaatccaaaattctcaaaagataggggaataaagctttggaatccaaggagttaccagacatcatggcagctgtataagtttagtctttctggtactttacagggctgttttgaaacatgtgagtgcctttcactttgcgttaaattggacaagaataaaactaaacacacacagagcaaggttgaccctgagaaggtaacctatttcaactaaaaccacttagtgaaatgacagctaataatcaaagtcactttttatcaattccttagttagagggccttgaaataccatacaagggcattttaaatgaccacgatgtctatttttgtgcctgtgtatgggggtatgtgtattaggttttatgcatatactataaacgctgctttcaaaaaggagcaaaagagggagttgtattctgctggtctgtctgtcctccctgcctaccccaattctgttcgagccagtgtctgattcacccatcaagaagtatcttattccatgtccattgcctcccacccaaatctctttagctaggggtttaattcatagagtatatgtttagaggctatcacagaaatagatgcaatggttatcaatgaggggaagcacattcgacttgtattttgtggtatattttcatctgtatgttagtggtcattggagaggatgcaaggtactctgttgaatacagtttttactagatacttctcagtcactaaacactttaatcacacctaaatgctttctgaatgtacttttctcagatgtagaatacaattccatgtgtaatcaagaaatgggagggctaaacgacttaaagtcttacccagtaatcatggttatagaaattgtttgaatcaatctagtaatggtacgtgtctgcagtggaaggagtgaggtcagtcaacgatttctccatagttactatttcaaactgtatttcagggcatgggaagggagatcaacttgggccttttctacaaaaacaggcctataaactgctgcaaccagctagttaccaagaaatgcacatacacaaccaaaggaggactcgctgctttaaaacagcccattcagaactagaggaaaaactctgacgctagcttggggaaggctaaatatttcttttactttttttttttattattattctcttgaaagtgtaaatttttgctctcttttaaagtctgtgggctccctcttgtggctttgtggaaaatttcaatttcaaggaaacgctttttctctctagcaataaggaaatcatttccaattaaaaaaaaaaaaactttcattgcttttccttgtaaaagaaaaagtgagaagaagaggtggatacgagaaggaaggaacaaaattaactttaatggaaagtcctatttggtgaaaaggtcattttatatacaatcctgttttacaataatagccaacatttcctgaacacccactgtttgctactagttgtactagataatgcattcaccacattattcattgcctccatgctcaaaataaactgactggctagttagagtagtcattttatgggtgtgagactgtactttcctgcctcaaagggaactggttgaggagatcctgtacctctcttttaatacctgtgaatgaaaaagtaaacatctcatattttcctattttaaaaatgattttttgtatcaaataatttttcttaaataaatcctagagtaggatataggttttatctgaaaaaacatgggaattgttcaacagttaatttctgttactgtttgtctctctctagttgcctgtctcgggaaacttgattgatctttatggaaaccaaggtctgcccccaccaggcctcaccatcagcaactcctgtccagccaaccttcccaacataaaaagggagctcacaggtaaacacctagtaaatgtgcctcttactgcagatttctgtccatttcctgataagacaaagttattgatatagtgatgtgcaaactatatccaactcatggacgtaacttttataggtctctgcagtggttaaaacattatgcaatattttaagacggagaatttatacttgaaaattctgttttttttcaaggagatccttgaaaatctcctgagatactgggaatcggggccaccattactgcatgtcaccaatcactgtgtgtgtggtgaaggtcccctttgtgttggggatagtaggcaactctttcagctgtaactgtctccaccctacctgatatgtatgtttctaacaagcccctagaggcatttgcatttgagaacccagatctgaattttcctttgacacacattcaagcccacaattgggatagcataagaatatatttctcacatcttcagatgcctcctgttgtcttttgctgtattgtgtgcaaaagatttattacacagaggggaaaaaattataaaatggagcaatggatattatttgttcttgaggcaagtgtgaaattacttatttctctactttgcttaatgctttagggaaggcatttatttggtcattaaaacatggcggaaactatattagaactggcattctaccatggtgaattttatggcccttaccacacccctctttttattatttgatccttgcatcctgcaggattggatgaacagactgagaatatggaatatggatttggtacagagaattcctgttccagtcaaggatgtcttaaaaaaattttttttagaaaataagcaggagaaagatgttttttaaaaaccatggatttgagtgaaaagagtaattaataagtaaaaaccatccaaaaccaaaacacaagtagctaccctaccaaaaaggaaaattactgcaagacaacaacaacaacaaaagcaagaatcgtcgggcaggcacagtagctcacgcctgtaatctcagcactttgggaagctgaggcaggcagattgcttgagctcaggagttccaggctgcaatgagctgtgatcacaccactgcactccagcctgggcaagaggaatgagtcctgtctcaaaacaaagcaaaacaaaacaaaacaacaacaacaacaacaacttaagaatcattgaagtggagggtatgtaagtcatgcttctgtgtgaggaaaaaaaaactagaaaatgatttgaactgaccatcacaactgaaagaattcaacttctgagttatatatatannnnnnnnnnnnnnnnnnnnaacttctgagttatatatatatatatatatatatatatgcacacacatacacacacacacatagatatgcatatatatgcatatatacatggatgtatgcatatagatatgcatatatacatggatgtatgcatatagatatgcatatatacatatataacacccatataataaatatatatggtgtgtatatatatatatatatatatgcttcagtggctataagttatgctaaaaagatttctattttgagataaaattctaaattatggtagtgtaatgcttcagctatcacttctgaaaaggaaataacagagctttctggatccccagattggtcaagtaacatgttttgttttgtttttaattctgttttgttttgttttgttctctgtaaggcaaaaagtaatctcttatcccagagatgtcacaagagttgctatgcaaatagagctttccaattgcagttgccaccaaatgcctctattcctattttgtttttatagactcaagctagtaaatagtggttcctaagttattagatgatttcattacagcaggttttaacagaatctggcaccaacttctgaaaaaatgagttcattctatgaagtagtgaactagttagaagagacagagatccaatttggcagcttttttttttttttttttttttgagacagggtctctctgtgtctcctgagctggtgtgcagtggtgtgatcacggctcactacaacctcgacctcctgggctcaagtgatcctcccacctcagcctcccgtagctgggactgcaagcatgcaccaccatgctggacttatttttttttattttttgtaaagaccaaggctgatcttgaactcctgggctcaagtgatctttccacttccacttcccaaagtgctggaattacaggtgcaagcaaccatgctgggccactactcagtttttatatcagcacgttacacaggcatcaaaaaaggattgaaagcttctatggcctgaaaagaaaatatatcagacccctgataatagagtatcaacagcaaattgacatagttttctaattatcgatttctttcttgctagtatctgtatatgtttacagtgtgctatatataatttttaccagggtttttttttaccattttgtggaagcccagtttttacatattgtatatatgatatatatattgcttttgaaaacatgcaagctttttaaaaagatatcatttttaaaaaaacgtatttttacttagagtcaagtcaaataagcttctgtatgtttgggaaatgagatattttgtagtttacattttgtgcaacttcaaacagttccaacttctaatgacttcattcacgtgcacagcgtgtatttttcccacagagtctgaagcaagagcactggccaaagagaggcagaaaaaggacaatcacaacctgagtaagttggttttatttatgttcatgacatttgatattaatgttccccatatatcaaaaatgtttccagaaattctgtagaggagagttgattcctacagctgttaaaattctctcttatggaagaaaattgtatttgacagaaaccaaggtatatattttccccatattttatctcagatcaaattgaattttgtatatatacttattttcagtttctgaagagtttttatttttcttgtttctagtagtggttttctctctctctctctctctttttggtaagagggagaattgatccccaactacccaattataagtgttgctcacactggaacttattaacaaaaggggattagggaagcaccttctccaatgagatttgaaagaaaaagaaagaaagaaacagatctgaaggggagtaaatggatgaggcagcctcctaaatttctgacatgattcgtgacttaaaaaaaatagccctaaagcatttaaaatattttttacgtgtttaatttactcttgatcaaatcttcaagttgtctcctacgaatactttaattttggtttaatataaacatgtaagacaagttgcacagatttttttaaaaagggattgggcttggaggtaggaaattgtgtgtgaatttctcatctcatggcctcatgtcctctgtttcttaaattgatttttaagaatgtgagtcatatataaacactttctccttataaaaatgatagaataaggccagagttcccctttagtccccaggaatatgcgtgttggtttcaatttggcattgctcttcctgacctttttctgtgtattaagaatatagacacatgcacacagaaaataaatcatatggatttctatatgttttaacacaaacggtatcatattgtccattttatgttgatttttttctactaagcagcatgttttgaagaccttttgctgttagaaatctagatctatctactttttgaaaacaaattgcatagtattttatagtgtgactgtatgatatttagtaacttcccaactgctgtgtgtttatgttgtttctagttttttcctatcataagcaatgccacagttaacatttttatatgtgtctctttgtgtacaagaaagtttgtttctctaggttagaaaccgaactgagaggcacaacttctgggtcctgtgggtgctggtttttactttaaaagctacacccctccccagttctcatgtcaagtgtaagaagctctccttatcttttaaccaagagataaactattatctccaaggcctcctccagcttctaagtaattttaccctaagatatttcttcttttaaaacaccttagaaacaagataattaggcattatccaaaactacttaagtgagatgtggaaaactgagttggatcttgtcaaaaacaatagatacctgtaattaggcacctgaactctcaaggtcaaggttgtcagtaaagtgcaaacatgatcagctcaaactctgaaggctatgaagcaatctaaaagtctcagccaaccattgggaattaatactcaaggttagattgccccttggtcaagctgttcctcttctaggaatttattttgtaagaatattgccaaaatgtacaaaaggatacattcatttattcactcattcaatcagccattactgtatgtatgtgtgtatgtgtgtatatatatatatgtatgtatatgtatatatatatatgtgtgtatatatatatgtatgtatatatatatatatatatagagagagagagagacagagacagagacagagacagagaaagaaagagagagagagcgcccctgttttgtgtgaggcacttttctacaatgtgaaccagaaaatgagtttcccatcctgggaagcttgcctttgagttaggggtcatctaccatgtattgctgagtaagatgagcaagggtcagaataatatgtataatatcccattgtgtaaaaatagcacactggggagagacgtgcttgtctctgtgtttatatgaatgtatatgtgcttgggagacaatctagacatcacccttatcagtgacaatttgcccaggcatatagatgttggatagtataaagacttggcttttactttttctttaatacacctttgtattttttgaaattttttactagcttatatcttctttctaataaatgattggaaagggaagtcatggaactaaaaataaaatgtagtacacctaaatattgacagtgaaaggtgtcagctatatgctggtgagtgaaaaaaagatgcagagtcctttttagtatgatcccactttaaatgttttgtttcttatttaacacatatttgttgagagcgtactatgtgccagatgcacaaggttacttggaatgcaacagtgaataaacataacaaatagatcaatgggatacatgaatatgggatggcagaaagttccacgtggagtcaaagggcaggcaagggagtatagtgtcagcatggacatgggaggtagtgaatcagtttcaaagagggtgaccagaaagtctcttaggtaaatctgagtctacctgagggaggtgagtgcagtgctgttcacatatctggaggtacagtgttccaggcaggtggaacagccttatgaagtcctccaatggggcgtgtctggcttgcttgaggaatagcaaggagccagaggggctagagtaattttatgattattatgtgcttggaaaaaaaataagaagaaagtatcatacttcagagttttggggaaggttagctagtggatcaaggaccccacaattccttcttcaaaaccattgaccatcatttagggtttctattttatacaagcctaatggtaggacttcgtattatataaaacggatttcatcattggaataatccctcagccaaaacaaactgcaatttatattgggaaagcagggaatcacattatttatctaggtgtacagactattagtggaacaaaaagaagcatatattctggtatttagagtaactattaacaactttaatccattttgttagactttaaattatttggaatttatttgtttgactacattaattagagacatttatcatgtcatatgccttattatgtcatcctcccctaagaacatgatagttgaccttacactgagatttataaaataggaatgctgtgaagattcatggtacagctaaaaatgctagacttcagttctagggctgtgctatctagtacagtagccattcaccactggtgcctactcagacttgaaatatggctggtccaaattgtgacgtaaaactgaaagtgtaaaatgcgccctggattccaaaaacttagagtgaagaaaagaatgttaagtacttaatttgtaaatgtttacgttgattgcctgttaaaataataatattttggatataatggatttaagaaaatgttaatttcatgtctttctttttactttttaaatagtactactagaaaatttaaacttatatgtaaattatattatatttctgttgggtagcactaggctagggcatgggttttttgtgtggcccatgagttaagaatgttttttacatttttaaatggttaaaaaaggccggacgcagtggctcacacctgtaatcccagcactttgggaggctgaggcggatagatcacttgaggtcaggagctcgagaccaacctggccaacacagtgaaacccccttctctactaaaagtacaaaaattagccaggtgtggtggcatgtgcctgtagtcccagctacttgggaggctgaggcacaagaatctcatgacccaggagatggaggtcgcagtgagctgagatcctgccaccgcactccagcctgggtgacagagcaagactccgtctcaataaataaataaatgctaaaaaaaaaattgtgacatgaaaagtatatacaacgcaaatttcagcatgacaagtaaattctaatgcttttcattgatttgccttgcaaaaaattgtactcgtatgttatattttgaattttgtcagtaaaaaatgtgtggaaatttgttttccctccgcttaagtaaatatctgcataatatcctcaattttgctacttatcccacaaagccagaagtactaacttcctggctctttgcagaaagtttgctgacttctgctctaaggggttaggttagaatttgggctttcaccaggtattgttggatgtcctcgccaagtccctaataacagtatctccaaggcaatttcattatttgtaactaaggatagtaactgatttcagggttgttataagaacaaatgagaaatcgtctgtatctaagggctttggaaatggtaaagaaatgtagctcatttttaactgcaataccaagaacatagtaaaaatagggaaaaagtaggttcaggtttccgttgtcatgacctggagaagttaatatgcacatgcctttaatgagatgtgctaaatgcatacatggcactgttactaatagcctttcctgtgctcttttcttgaagttgaacgaagaagaagatttaacataaatgaccgcattaaagaactaggtactttgattcccaagtcaaatgatccgtgagtacaatcgcgtgttaatctgcatcatatatttttcgtacctgaatgttttttcatacgttgtaaaaaatgcagttgtaaaaactaaagtaaagaagtctcccctctccctttggttctattcctaaattcttcttacacctttcttttggttagtctcatcaagctaaaatttcaagacaaaagcattgaattgtgcaaaaggattgttggacactagatgttttggttgtgaggaggtggctttctgaaacctaagaattctttgcaaacaaatactgagcttaaaaaaaatttcctttaatggttcatgcagaacagaactttcaatagttgttaaagctagatttgttgactgtttgctctttgacttgtacagtacctctaaataggcactgatgaacagacattagagacttaaagtttaatgatactccacagacaaaaagggtcaattatttttatgaaaacttgcctactctttgtatgttttaccattgtaggggaaaaaaagtagtgttttaatcctcttattaagtacaggtcagctaatttagatttcagcttttggtctctctttacccaccctgtccccttcagagataacagctgtaaagatgattttctcaagtctttcctaccagcctatagttacctgcaacatcagcagataggacaacaaacacacagtttttatccattagaaattggcccatttgaagcaaggggctagaaaatgtatacattttaatggcccccacaggcattctgtgaaattagcctttgaatatgaccttttagctacctaataaaatgtaaagatgaaatcaagtattattcatgccaggcttattaaatttgctgttcacgttactgttagaggatttgtaacaaaataaaataaaaccattacctattgtgaggtggttttgatgaatgtacaagcacaattccatcttcaatgttttgctttcccaggtttcaaggaaaggcattttcaaacccgaaacatttcagattctcagttctgcagcacaaatttatcctactaaagggctgtgaccttcatttcctatagtcagtcttgcatgatagttgaaattgaattcccattttcctcttctttatcagctttcactttttagcatattcttttaaactgtagcatgtgaatctctttagcaacatattatgaaattatggggctgcagtgaaagcctctatttgcatatcttctttccccgttgtattagaatacttgcgggtttataatctgaactgataatgatctttaattgtaggcattgttttaagacaaaacagactataatctatatggtggtttcccacaccaggtttctagaatgtgccttggggctgctatagagacacagtcttacagactggggtctcagcccggtaccttttctcccaccagagcaagtctgcatttgttgattttatataatggagatctatattcactattctgtgaaaaaagagtccctcttattaccaaacaaaaaaaaagtttgaaaaccctttcttaaactcagaagcataattgattgattggatctcacaaggaagcaaaacccaagataattggttgaaacaatcacttcttttaaactgagtgacccttcaaatatcccaattctgatttctcttcttgctggcctatgtgaagcatcatttattttaactacatttctctctggctgctaaagttacttctcttactttgatcttagctctgaatattaagtctctgcgctcactgtgggtatctcaggacattcccctgggttgccatctttggtgttcagaccccagggatcaactccagggaattctctgggggctggaactgtccctcttatgggagaacttctgtgttgttcttcatgtaacccagatgaggatcaattacttggtgacttgtttaatgaccctccattcaccggttccacctgatacttgtagatgaggaaatggacaaagagaggctagatagcctgcccatgataatccttgattaaaaaaaaaaaaaatagaaggatgctgagtttatgccataaacaatttagtagtgagatctcacagatctgttttaccatcgtttattctcactgagttaacttttgtagttttagaaacctataactctttaacatagtgtttaaggaaactgactttgtaatcaacagacctaactttaagtcctgactctgccatatagtactgtgtggcctaggacaagttgaattgtgtctgtttcaacatgtgcacagtctctctcttacaaggtgcttgtctgggttaagtaagacaatgtgtacaaactgggtgggcaacactaggcacgtggcaaacactcgtgaatggcagctataattaatgtatgattattttatttttaaaattgaatgcttttaaaaatgatacaatggactttggggacttgcggggaagggagggagggggtgggatgggggtgagggataaaagcctacacgttgggtacagtgtacacggcttgggtggtgggtgtaccaaaatcgcaaaaatcaccactaaagaacttatccatgtaaccaagcaccacctgttcccccaaaactattgaaataaaaaaaaattttaaaaagttcaaaaagaaatggagtgctttgaatattgaattttcattgagcctcaaatcctaaaaatatctgttttcctccattttcatcgcagagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggtacgcagcctgagttgtgtaaagtttactgctttttaccgacttcaagacagtagaaacagggatataatgagccataggggagttgacttacgtgatcctaacacagtcaatccttattatttgtggattctgtgtgtgtgaatttgcctacttgtaaccccaaagtcagtatctgtggcacttccacagtcattcttggacatgtgcagagtggcacgtttgagctgcccatggcacgcatttccaggtgaggtcgaatgaccctgcctgaggttgactgtctgctgtcttgtttcagctctcatcctctaaacaagtgctcctttcgtggtctgttgagtactttctacatttttgtggtttctgttggtgatttcgctgtttaaaatgacccccaagcataatgctaaagcactgtctagagttcctgagggcaagaaggccgtgatgtgcttacagagaaaatacatgtgttggataagcttcgttcaggcatgagctacagtgctattggctgtgagtttaatattcatgagtcaacaacatatattacataaggtgaccttcaacagaaacatacataaaacaagattaagtgttgtgactagggtctcacaggaacctaacttgtaattcccctgggaacagtgcttcagtgttcaccaattcagtgttcacagtgactttgtagaacataaaaaaaataagtactgactataccacgttaaacaagaagatgccttagtatttgtagggtccgggaagcagttgatggtcaaaatctgtgtttacagggaacttgggaacacccagaggatcttatattaaggacataattcctggagatagttataaatagtggaattatagcatatatatctttaacttaaactatacaccattagaagaagacatactaattttattaatatgtgccatttgtgcgtcatcctactcagtgggtatatgcaccagtgtaagccggagatggggaattcctctttggtatcaactcctggaacttctctcaggggcttggcgtctcttgttgagtgaaagggcactacttcctctgaaatgatcctcaaaaacagactccctgttatggaccaaagggggtttgtgagggtaattttaatttgctgactttgaacacaacctatctgtaagagtcagtgacaccatatcttcttcttgagtaggctgacccaccttttactagattttgccataaagcaagggttgtctttcaacttttccagtgcaactattcatggagttattttacgaaacagcaatgagaagtatgacaccctagcgaccattgtgtttcacctagtggtgctcctcccggacgttgaacttttcaaacagagcaattcacttataataatggtctccagtcttctgaatgcttatattttgaaatgccacatctctcattcactgcagtgattcctcagctgtggggtggggaggtgggaagccacttccctgttggggtgcattttagattctgggtagtgaagtagaggtagtgtgtaatttgaaagccctcctttcccctcccctcctctactttggcttttgttgttggttttatgttctgtctcttcaataagtagctataggtatttaatctctcaaacatagtctacctatttataaaagcagcttgtgggccgggcacgtggctcacgcctgtaatcccagcactttgggaggccaaggcgggtggatcacaagatcaggagttcaagaccagcctggccaagatgttgaagccccatctctactaaaaatagaaaaattagctgggcatggtggcgggcgcctgtaatcccagctactcgtgaggctgaggcagagaatcacttgaacccgggaggcagaggttgcagtgagccaagatcgcgccactgcattccagcctaggcgacagagtgagactccatctcaaaaaaaaacaaaaaaataaaaataaaaataaaaccagcttgtggccgggtgcggtggttcacgcctctaatcccagcactttgagaggccaaggtgggtggatcacgagttcaggagttcgagaccagtctggccaacatggtgaaaccctgtctttaccaaaaatacaaaaaaaaaaaaagaaaagaaaagaaaagaaaaattagctgggcatggtggtggatgcctataatcccagctactcatgaggctgaggcaggagaacccgggaggcagaggttgcggtgagctgagattgtgccattgcactccagcctaggctatagagcaagactccgtctcaaaaaacaaacaaaaaaaagcagcttgtactaatgtgttgtttccttctacaagtattaaaatgtaataactattttgaaagagaagctaggttttgttttattttagggttccaaacatgtatattcatatgaaatacgaatattgtgaaatatgtgcattggaaattccatggtgacgatatcttggttttcttccagtgacggtgtgaggcagcctttagaacttttgcatatcacagaaaacattattaattaggaaagctctgtgatgcaattaagccagagttctctagatgagatttatcaccttatttagaaatctgagtaatgctttaatcgctgataaatatttttaattagacaacaaaggattagagtgagatgtttgcctctcttaatccaactttattattctttttctgaaaagacaatctgcctgtgtggaggtactgttcttattagcatgttggtgtagatttacaagagtccatgttttcagtatgggcctaagggctttctttcattttcactctaagtgatgcatgcaaaagttttcacagaagaaagagcatgaatcctttatgtcagtggaactgccattttattaaatagcccagggctttcaaatggtgcctgaagaaacttgtgtttctggagattatgtaaaggaacttgaaggtacttgtgtgacatgtcaagctcctggcttttactcatattgtatccaaagaaggattttgcagacccaaaaaccttgaatttagactgaaacgtggctttgcaggcacatatgtttctcagcttgtgggcagaggttgagaggccatgtcatatggagagtccttcccctctctgataaggaaaggtgacttgcttcaaatttatattctcttgctatatattattgtttcacaaccgtggaagggatagcattggaatggagaagcagaatgcttatcaggaatcaattaaagtctgtgtggttcattttaggagtgcccagggatacactcagaaaggaaaaagggaaagagcttgcttggaaggcattttgcaatgagttacagggggaatcaagggtatttaggaagtgtattacccagctagtgctgctgtagtgaaatgccactgactgggtggtaaacaagagttattttctcataattctggaggctagttgttgtccaagatcaagttgtcagcagggttggtcccttctgaggcctctctccttggcttgtagatgcctgtcttctccctgtgtgttcacatggtcttttttcctgtgtgtgtctgtcccaatctcctcttcttacaaggacaccagtcctattgggtttaggcccactagtaaaatctctttttaaattaattgcctctttaaaggccctatctccaaatacagtcacattccaaggtactaaggttaggacttcaacattcaaatgttttccaggacacaatttagccaataataggaatgtatgtgaggaaggaaaggaaaaaaattgttcatcttatagatgagaacgtacttgttgagttaaaaaaatacttcccctttgccatggtgagatgggctaaatgatgcttctaaaactttagttactggcatagaactttcacagcttttgctatcactacccaaattttttacttcatggcactcttagtgttttagcaatctttttaccatccccctagaccaaaagaaatacctactctttttgttaggtccgaacaacttattaagtatttaggttctaacaacttggtagccatttgaaaaaataaaacatataaattgaaaggaaatagcatttttattttgttattaaataaccatattacttactaactggatgtgtgtgtctgttgggcactgcacgacttctaaagtcttggaatcagattggacaccatcaccccatcgcccttgtttcccaggccacaatgatgttcatgtggcacttgttttccttcaatcacagcaactgccaaaagctcaactttgcaatgatatcatgtggttgaaaagtatatagcacagtctgatgctagaagagaactatcttgagtttagtagttctcaggtagtattgccattgcccttgaaatgttaggctatctccagtgctctgtgagttcattgcagcacacatggggacctcagtgcaaagctgaaggaccatgaaagctgaaggaccatgaactctttactgaatatgtttcttttttcttttcttttttttttttttttttttttttttgagatggtctttcactcttctagcccaggctggagcgcaatggcgcaatctcggctcactgcaacctccacctcccaggttcaaacgattctcctgcctcagcctcccaagtagctgggattacaggcatgtgccaccacacctggctaatttttgtatttttagtggagacggggtttcaaccatgttgaccaggctgatctcgaactcctgacctcaggtgatccgcccccctcggcctcccaaataatatttttcttttatcagctcgcatttaaaactttatttttgtattttttaacttatcctcagtgtgaacattaatatctgtgtctaatgacgcgcatctaccattatagtatcatatagagtggtttcacaggcttaaaagtcctctgtgctctgcctatttcagtgttttatctttactcttattataggaacttgaaatgcaggctcgagctcatggactttcccttattccatccacgggtctctgctctccagatttggtgaatcggatcatcaagcaagaacccgctcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagag

SEQ ID NO: 17251 - DNA, 67745 bp, Human
  misc_feature (1)...(67745): n = A,T,C or G
acaatgatgatgtctctgtatccccaagccaggcactgtgttttgacacaaagaaagcccaggttacatttgttaaatgtaaaagaccatacagtgagtgggtgagtgttcatgacaatgccagatctgactacttccgcgagaaaccgagacactccagggccggattccagacagtgggaatatggcgctgtctttgccccttctccagtgaggaaccagaatttacgtgttatcagaaacagccacttcccctctgctcctgcccgcctagagggctgggcaaagggtagagggagcagtgtccggccagggtctggggagaattcggctctccttagtgggaaactctgtctgtcttcctcccccagggggaggggatggggataggaggaccagagtaaggggaagagggaaggcccggagggcgcagtcgccttggcagaaatcctaccacacccggatgtagtgggtggtgaacgggatggggcggagagtccctgccctgccagggacactgactggacgatccactttcgcgggaatcccacaaatctctcaaaactaaggtcctggaaactggaggagagctcgttttcaggctatgtttgggcaagggcggggcgcggggtgcttcaatttttggaaaaggaacccccgaagggagcagggattagaaaagaaactctaccagaaacctcagtgggcccgtctcacccactcatgcccaccactgacttctctggcagctccccgtcgccccgcgcaccgctgcctctccgtggaacgtccaagtggtgcagaggagagggatctccggagactgggttctgttgcgagctataccacgttccgtcccgggcggaactcttctttgggcctttgtttcctcgtctgtgaaatggggccagggtgggagcagagggcttgcagaagccttgccagctcccacgctgctagccgggattctccatcccgccctctcctccaccgccgcccccggcccggtcctaactccacccccacccgccgcgcctcggcgccgccggccgctaggggtcactgcctgcctttgtcagcggaggaggagggcagcccgcgctccagccggctccccagctggaaggcggccgaggggtagctcccgagcgagggtcctgagccggaccccgcagcccgcgctcgcgatccgcctctgcttcggtcgggaaggcgcgtgcgctcgggctccgaccgggccccggcgggcgcgcatcgaggccaggagggggttaacgctaacccctcccctctggctgacatcacgggcgagcgggtgagaggctggagctcggcgagtgagagaaagagagcgagagcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggtaagagcgctcacctctgctgtccccacccccatccaatgcctccccggggctgggagccggatggcgggcacgactggattgtggggagtgaaaggagccagaaaagttgggtcacggcttgggtaaagggggtgggaggtggcacggcggagaaagaggttgagaagccgaaccgcctgccctgcagggaagcagtcagatgcacgtctctatgtagcatgaaagcactttctccgctcagttctttacaaaaaataataatatgtaatagcgttctgtttatttaataaccagctctctgctcgggaagcagtttggaaacactgcgtgttacataaatgcaaaataatcaccgtaatcaccgtcttggggtgggagacaacagccccagggggagggcgtcagtctcggagctgcgggtttggagtatggcgggggggcttcgtctctttgggcggcccctttgccagacggctcaggacgctcgggccccctcccgccccacaccgccccacagcgggcgcggagggtcggctgctgcggcagaggcggctcctcgctcacctgcggttcctttcctggagggtgaggccggggcagcctcctcccggcctggcgcgggaccgggctccccctcggaactctgctcccagctctgggggctctccctggaggagacaccgcgggcttcctgccatccaagtagctgcatgacccactttcccgagggtgccccgcgtgtccttcctcgaggtgcgggctgccggcagccgaggggttaacctcgcgcccgaccccggggtggccctggtggcccattctgacgggtggggtggggacggaggctgggaccagcccaggcatattgtgctggggaatgaactggaaaatgcgtttaggaggcaaatccgaccgagtcccctcgcctggatttaaccctttgtgtccctggggaagctgccgagctcgccggctgactggacaccaagcgtgggtcaaggggtgtggggagttcctccagctctctgggtagaaaccagagacgacctgcagctctagcaagatgggattttggggaggggggcggatcttgactggagcacgtggtccccgccttggggtggcagaatagggggtcagtgtacagagaccatctcctcgtggggcaggaatattagatcccgagttcctgcaatgtgctttgccgcagaatggccaggcagtttgttatcgagggaccagtctggctgcctagttccggggctagggtgcactcctggaaggcagaagcctggcctcattcccttctatgcctcttctgctgccagccagctcactacgagggccccgccaatctcactaagtggtggatgtctgggaagcagtttgtgaaagccagtactggggtgcctccacccgtgaagcctggggtgctgccctgctcgatgtggggggtggggaaaatccagggctcacaggtgtcactgcccaccctgcccccagagggtggtcttggtgagagtgagaggtcttctcacactggatggcctgggaagccagccagagatacagaagttcgggctctaggacttgcctggccatggggatttgagcttccaggaacccttcaattacatatgtccacatccggaacccagagaaacgagagcttcccagagctctggttggtccagcacactaggggttaacgtaatcctgggatggacaaagggtggtgggaagggttgggagaaggggaaggaactcaccctattctccttccttttgttattctctttccccagctttgtgattccttcatggttaattccttcattgggggctagaggcctgctgtgctccacccactcaggaagtgggagcagggaggtgaactcacctggctcaaggtggatacaacccctgccaaaaatctacatgaaagggtgggatgcagagaaaggaaccagggttgagagaggtacttaataaatgctcttccattgactgtaattgactgatgggtagcatccatgcaccgaagttcccggaccgcccagctcctctgcccagtggctgggctcctggtgccttctctgcttgcttgctctagggtccacgggtgcagggaggcaggtggatatggttgtgcccagtctgacacttggatggaggctggttggcccagaagttgcaagcccacaccctactttgcatcacctgctggcttcctccccattgcccgctatagcgtctctctagggacttgccagtctgatgctcttttcagggttttcctgggctgtgacagggaacctgggtctgggggtttgaggagaggaagagggaggggcctggagtgtgtgtgattgcccccaacttcaaaacactcccaatctggctattgaaatgtaaacacagaagtatgttttcaacaacacagactttactaagcagtgtggtgaagccccaaaggcctctgtttcctgagatgacaatccacagtttcttcctgttaacttagaggagagggtcagtggggcaggtgggttacatcccaaaaagagatagggggagccctaggaggaggcagaggacctgcttgagaagcaggtgtgtcgagctgttgtcccacctacaccacaccctccctaattggcttccccacaccttttgtctggaaagagaacacacaccccaggtgtcatgcacaccctcggaagacctgtcgggtcacagcacacccctctctgcagcctctctctgcagcttgtgcagagcttgctgccatgtggtctttgaaattccaagtgtcggggctattgggttattttccttcctctctctctatttctcacatacagtggtgtccttcagcttgctgggcaaggcattatggcaaaaccaattctgctggcctggggtttgcagcatgtgtaaatgggaatctccttacccatttataaggcagcactgtggagtgccttggaattggattctaggcctccgtagtcaaggctggaggggaagaggacatactgcagagcttgggcccagttgccctggctgagtggcccggaaggcatctcttgaacctgaacttcagagcatatgggacaggtagcccttgttgcctgaggcttgctgaggctaagagtgttattggttcccttctcagccactcacctttgtacaatgaatccaccttggctactgtttgacccccggactctgctgtatgttttcaggatggttgagccggccagaaccctagtgctgatgactgagcaagtggaccaggcttggggggcagagggtcagttccagttgctgtctatgatactgccattgtttagcagctgactaatgttcattgttcagcacaaacagaaaatacccaagggaggtgtgaatgtatcttcaatttttccgattgtatctcttcctggttaacctggtgaattgaatgcctcctacctcagagagggacagacagagaggtgtcagcatattcacctgttttgctgatttaaaaaaaacaaaaaacaaaaaaactttaaacattagccagtgtgccaggctaaaatggtcatgagccagctgtggaacttaagctgtgacatttctgacagtctgcatagggtctcacctttagtataaagtgtgtgtgtgcacacaggtatacagggctttggtgtttgtgttggtgatctaccattcactgtgtgtgtgtgcatctatggggactaggagtagaaggtgtatgtgcttgtgtctgtgggtcactatgggactagggccataaatatataacatcgaatgtatagtcacatgtaactgactgcttagagttttctgactaggacctgtgagtggtccagacttgagaatgcctattttatgtgtcagagtgtcggtgagggtgactttgggagggcacccaggatttgcccttggttagctcttctaggacacactaccgggtcctttggggggtgggaagcctctatgatgcttcctttttctgttctgcccttggctttagactgggcctctgcctgctcgcagggagatgctgaagaccttgaccacaccgggagagatattcctctcttgtcagccttctgttgtctccctggcaggcatagcagcactggaacctggcattacctggggcctggcctgccccacgagttctcatgatccatgaacggctgggaggggcaaagggaggcagtttttcagctcctaatttggcatctttgcttcctacatgggtatttaagaaaaagaatcatggtgtgtgtggggaggggaggtagcatactctgggcaattaaaaagggtgtgagcatgagctttggtcctccatgagggccctgcagagctgtgtgtgcccaggtggacaacatacgtgtgcctggaagcatcctgggttcacgcagcagaaagcaggagcccccttattggaaaaagaagtgggaataagggacaaggagtggggaagagggtggtcctgggagcccagcaccctgtgcccaagcccaactagaaaacgtttccccatgatgcccaccgctgtccacagagaccaggtctgcagagccagcagcagatgtgctggctggggcaggaggtaacttaagatctgagcacagatcaccttgcagagggaatgccctgagctggagataacaccctttagtccagttaactctttaagctctggattctctcgtgctgttgggggctaggagatggagaaagggaagagatatgagaaaacacatggaacataatatctgtacctcaccccattccacaaggagagatgaactcagtgtaacaggagagacccgagatggacacaaagacagactttctgacagcagattgtagaatcttcagggcaatagattatcccaggtttgccctgggtgggggctggggaggcaataggtatgtattctcaggcgggggcagctagtgggaggtctgcctttcacagcctcccaggagagagcagagcagcagtggtcccaggccctggtggagggagagcagcagacagctcagttcctctccctacaacctgatgatcactccatcttggcagcccagcatcatgagattgcaaattggggcccactggcctgggttggaatcccacctctaccaattactagctgagtgaccttggtcaagtcactttacaggcctcagttttccctttttttttttttttttttttttttgagacagagtctcgctctcccccaggctggagtgcagtggcaagatctcagctcactgcaacctctgcctcctgggttcaagcgattcttctgcctcagcctcccgagtagctgggactacaggcaggtgccaccacacctggctaattttttttgtatttttagtagagacggggtttcaccctgttagccaggatggtctcagtctcctgatctcatgatccgctcacctcagcctcccaaagttttcgtatctttaaaataggtttttgttaatacagatgcccaaagaggtttgtgaagatgagattgagaatgttgtatgaaaagtgcgtagcacattgccaggcatgtgaacacatgcagtgaagtgaacttctatcccctatgccttccctctcaatggtcctggcccctctgagtctgctactcgtgttcccttgagaaagagccactcagctgcctgcgcactgctgacctcacttcccgtgtccccagccaggtgctacttgggaagcgagtccctgcccccactcgggagcctggctgcctgtgggtaatgcacaggttcagctgaggtggttgagggctacctaggcagcaggtgctgggtggcctttgttctgccgcctgtcactgagggctctcccggcacctgcctcgctccctggctgtggcccagctggggcaccattgcccatctggaggctagccgtggccatagagagggcctgggactcagcccctgccttctttcacttccacatttgaggggaagatggaccacagcaccatccctccaggactccactcaccccgtgagatgatatcagccagatgggtagagaatccctgctggggtcacctccttctcactggcagaaagtcccttcagcctcctgttacagactgaatccttttgcaaattgtcataatactgtctgtggcactctatagccacagtttcagctgagcctctcaggagccccatgtgaatggcattagtgttgtattagttccattttagagatgaggagagtaagacctaggtttagtaatttgctgaccgtcttatgctcttgtggccaaattagacactgggtcttctgactgcaaatccagtaaaccagaaggatgaaaagatcgggaatggacagacggaagaggatgaaccaggccagtaggatgttagaaagtgtccatgggacggtcctccactttaccagccaccaccagctcacacgcctcctacagcagggcagagcctggcagctccctggggaagtgagtaataagttgaggatataggttggagggtggcccagccagagctgaccacagagcccaggttggtgtagaatagaggatgcctaacaatggaacgttcctgggggccagggaagcagtgtcctggagcatctgtctctgggtatctgggctgagacatgggcagggcccctgaggtgtgagcatggagccctggggcacaggcaggcacagtgccagggtgtgggcctggcccggagcagagagcaggtgtggactagacagagcagcagacaggcacgggggctggccctctcctggactatcccccacccactctggtcagcacagaccccaatttcattctcagtttatgaggagtctcattaccaaaccacagacaataaaaccctcctggccactctggcctggatctcattagaggacattagttccactggctggtggctccacagggacacagcttcgggagttgggacacagctgcgggcgtggcccaggcagcaaaacaggccagtggccttgggcaccagaatgtcccactgggagtctgagttcaagctatgggcttaaatggagtccctccccacaaagtcctggaattcttgcttcccaaagctggaaatgtgtgtcctgcccacccacttggatgctcagttctgccccctgcctgaagaggaggacacagctccctccagggctgttctggggagccggccttctccgggaggagctgggtggaagctcagcaaatcatcattccatggaggaaggcccttggggacaggggacagaacagcctcccacactcagtacatctggatgtgctctgagatatacgccctagcaccagagatggactctggagtcctcgcaacagccttggcctgaatcttggcctgtctttctgtctgaaaagcaaatgtagggagttggggaccctagagaggaagcatttcccctcacctatagatggagtttcaccgatggctgaaagagccagccactacggagagccagcaggtagccttggcaggggcttcctagtcccacccctccccagctcgcgttccttgtcctcagtcattgtgctggggccttggattccatcttgtggttcttcccaccaaagacaggaggatttctttcttagcagattctggtgcctgctgaccggcagccttctctctgcctgtaccttcccctctgctttgcgtccctcccctgcaagcctgcatacctgctggtcatcagaacgccgccatggcttgaaggaggtgtccatgaaaaacaagacaggagccaaggcaagcgtgtcccttctcgatgcctcaggcttgtgaaggaaaatgagcaccacgcccaaataactggcttttagcacacacaggctcacgcggggtgctcccatggggggccacacgggtcagcccacgctttcgcaggtgcctgccaaatgagtcagtggagatgggagcgccaatctgctggggcagatgtgagtctgccctgctgtggaggaagggggactgaaggattgcgtgggctcgtggagtgcccctgtgagggcctgccagcagctggtctggggtacatgccccgggcaggactggggaggcagctgctgtgactgttctctgtgccccatgcaccttctccctcagtccccgcgtcttgtggacaaatgctgtcaggtgctaggacaagggcagtggaggaggtgcctctggtcctagccagctctgccaccacgtcatgtgggtcccactgcaggggaggatggtggcacatcctcagtctgctgctccagtctgcccacactgctccttgggtgaatccacctaaagcacatctgagggggcacagcaccaccctaactggtcccccactgccctcccccgcacaccatgctttccatgcccagcgctttcctgcctccgtgcctttgcacatgctgttcccccattcccgcttatttcccataaatatgaaatctgaatactgaagtcaagagccacttctattgtgaagctttcatgacccgctccccccgcaagctaaggataacttctctcatctcaaatcccccagcgcctcatccatgccaccccctgccaacaattactctccatcctgctatccagtcacttgggcctgggatttatcttcatcacaagactgagagctccattgctgatgaggcttggtttctccagggcctggcataggggaccagtaggccatgctgggtggatagacagttgcttgtttgaaacattgatgaggataataataacacacttgtatggagaatccctggatgccaggcactgttgtaaacatcttacatgtaatcacttagttaatcttcataacaactcatatggaaggtacttctgttctccccagttttatatatggaaaaatgaggcccagatagagcttaggtaacttgcccagggtcacgcagctagtaagtggcagagccaggattctgattccagaagtcaggccccatgtccgtgtttataccatgtggctgagctgcctctcttcctggcgggtggcagacaggtgatggaggaagaccatttcctaagcctggagtcctcacaagactttgcttccagaatctcttcccacccctgcatagcaccttcttattcacattcctgtcccttcagtggtgcagcgataacctggtgttgtagttgtccatgcctgatgcatttggggagttattagtgctgaatcttcagagagtcttggcgcaggttgaacatccctaatccaaaatccgaagcttttggaggccgacatgacgccacaagtggaaaattccacacttatcctcctgaagggtcgcaatccaaaggcagtcaaaacattatttcatccacagaattattaaagccactgtataaaattaccttcagcctatgtgtataaggtgtatatgaaatagaaatgaaatttcatgtttagacttgggtcccatccccaagataacatttcatgtatacagatattacaaaatctgaacaaatttgaagtctgaaacactttgggtctcaagcattagggataagggatattcaacctgtattactggtatatcctgccacagacactgttgtgtcttgggagtattcatgtggctgtgccagagtggaatgtcttgaagttatcactattgcatctcctgagtctttgggcatcactgataccatttgggccccctcacacacaccatgtctcacggtgagaccagaggcaggtatagtagctcctcggagagaatctgcctggtcccccagcgcgtgttcccaggccagccccagatcctgggtggatccagggctcagcaagctgatcctatgccagagcctgttctaaacttctggaaggtttcaggccctcttgccctcacccagagatcccaaaagatggcaagggagggcccctactagggagtgtggatggggaaaaggatttagggtgttctcctgggccggctgctttgatctcctgggatgaaagggctggtgcttcctctgccccaggcaggatcaggacagcaagctggggagagaggcattgatcctgggtccaggcgtcctcagcttcataggcgagggcagagaactatcccagggaagaagatcacgggggcagaaaaatcaaagcccttccccagggttgtggctgaggactgggagttgacttcagacagtccctgtgcagattgtcctctcgagggtcacccagggtgatgctcctcccagcacaccctgaccctgcaggtcaccatgcaggctcaggcctcacagactctcttgcttaattaggaaggtaattcggctgcaaaacagtcatctgatctgtgtcgacgccaaagcgaaattcctcctagaccctccgctgttctagattatccatgctccgttagcttgaattaccgcgcggcctctgtggcccagacacaagccagagctatgtgatcagctcctggggctggatctgccctgcacctaggaagtgcttggaagcaacaggaggaaggagggcataggacctgcctgactcccatccaagccggagcattgcccagccagcacgaagggaccagcattgcccagagcccccctacccccgggcctgcaggtgcctgccgggctcccaagcttagccacttttatgtccctctcctctgccctctgggaccgggcccctttgagggttttgaatcagtggcagaggctttctgcagcaactcctaggcataaattggagcggaggcagggacaggcatctccctgagtgtaaataacactgtaaataacactggagcggagcagccacactgcactggattattttatcgtgattgcccacctcccccaccccctgaactgtcccaatctcattggcctagattgctgcatctctcagaatgatggaggggctgcctctcccttcccgggcagggtggccagccctgccgttgaggcaccctcctacccagcaacttcccagatttattccctgtctttatggtgcctggagagtcatcagtgtcctgggccggcagagcactctgatggtctccactggcgtgatggataggcctttgggggaacgtgtgcgacagccccctgctcccggcctgcctctgccctgaccacagcaccgttccccaccctcccaggggtcagatgatgggcctcgtggccagtcctgaaggggcggtgatgatggaagagggagagagcatcagtcctcggcgcccacctctcagtgctgctgcagagtctttctggcctcctccccaagctctgctcacaaacacccttcccaggaaatatccccattaccctctctcatctcccatcactccattactgctagcccctcggcacttgtgtacacagtttgcgctgtaatgataatctgtgctggtttatgtgtttctttacaagtgtttttatgtcctctgtgtgtgtatgaggaaggtttatggtgtgtgtgcgtgtatgaggtcacgtgctgtgtgtgtgtgcgtgcgtgcgtgcgcgcgcgtgtgcacgcgcctgcttctgattagactctgatcgccatcttctcccacacacaggtagggggccctcacccccctcctggggttgggggcacagcctggctactaagggtgggtggagaaggagggggagccaatcaaagatgatgactgtccgggcaaggtctacactgccccccagccgccagttagagaaccggcgaaggtcagtcttagatcattgttttgtctacagggtcacaaacaactagtttgactatttttccccaagaaattgactgaacccagtggttattttggagtcaaatgatctcagtcttttatgacttacctgtgtcagcgggtgtatctgtgtcttctctaaacaagttcccctagctgtacaatgggatgagatgataagaggctggaaggggcgaataacatatgtggtgtgcttagcacaagcaataatttgcttgatccagagaaagccttcgcaccgctggactgttgtgagctaccactgggagggactcccagtctggagaaggagggtccgttccctggggctggggaagccaggcccaggaaccctcctggctgtgtgtgccccagaacgctgtggggagcccctctgctgggctcctgtgacttctccagggtggtcaatgcaagcagagtatgtcttagtctcaggcccctgggctactggagatccgcccccccaacccagatgatcacctgggcaggtgcctcctgtgctcccttctgaaaggaaagcaagggtttcactcaaggtgcagaattctggctgccccaagcgcccagtgccagtccctgtaggaatcccactgccctggatgtgttgtgggagaggcagacaggttcatcctggcattcactcgacatgtgccaggcacagaggtgggagctgtagacagcaacaaacataatatccagtccagcactgcatggcatccacgctctgacctctgacctcacacacagcaggtgatccctgagggtgtcagctctttcaagcaggaatgctagtcgggttgaggcctgggtggatggtggagagatggagctagggccttgtgggtcaggcctcagtctctttaagccatcctgtttggacgtgaagggacagtgacactaggcaggggcctgcattctccttcattctgcaaagatgtgttaaacacctgagcccactgggcacagtggctcatacctatagtcctagcactttgggaggccgaggcgggtagataacctgaggtcaggagttcgagaccagcctggccaacatggtgaaaccctgtctctactaaaaatacaaaaattagccaggcatggttgtgggcacctgtaatcccagctactcaggaggctgaggcaggagaatcacttgaacccaggaggcggaggttgcactgagccaagatcacaccattgcatcccagcctgggcaacaagagtgaaactccatcttaaaaaaaaataaaaataaaaaactaacctgagcccacttgttcctctcccagacccaggtctggaaagagcctcccagctgggcctgcagctgaaggtacctccctgccctgcaggggaaggtggagaggatgtcagagaatcctggagtcttagcattggaagggaaatcaaatgctgtagcaccccattcacttcctaaaacccctaaccacattctggcctgttggtcatcctccagctgcagctgaatccctccactgacagggtactcaccaccctccatggaagccaggacagccctgactgcccccagctcccccttccccctgaagctccctcccattagtgttggaatcgcatggagctcatgtgatcctgcaggcatttacagacagcctcggcccccgtctcacctctcctgagtctcacacacctcaccatctcaggtgctcccctcagatccccagtaacagctccatatgtgggctgccacgcccagggatgtcagcctaggattcccagccaccacagctgtcccagatctaggaggaggcagtgtgggtgggccctccaagcttccccacctccctctatccctttcccacccccacccccttcccacccctgttttccttaggattaatgataaatttcagtgaaagatccgcttatctccagtaggaattaaggaattaagttggcgatggggagagaggggacagggagagggagcatactgcagagggtcaggatgcagagggaccgtgggcaggacaggacagggcaggggacagcggggatgtggagcattcccctctgcctgcatcagttcaccctgcggtgggctgggctgtgctccccacctgcctgcaccgccatgggggatggatgtggggctgcttggggatgggtgtggtgactcgtggaaggaggtacatcacagggatcctgcaggtggggtgacctggcagcctcccgtgtcacctgttgctgcttcgtgccatggtgcagtggctctgtggcatgtcatggccctgggagggcgagccacagcatgtgtcagggtgaggcaccccgcttttggcattgggatacagaggcacattctgcagttggaagtccaggggccaccaccccacaggtggctcatgagtgccatccaggctctaacacaacccccaggcaggccctggctgcccctcaaaaggggcccacccagaggctgccgctcctgcctctttgcttctttggtgggactgactgagttggggttcctgcagcaatggctgaaagaatctcttacccctggagaatctgagcttcgatgtaccctcagagcaactcagaagcctctgtcctgaataccaaggggggggccactcagggtctgcagcatcccttgcccccaaagcccaggagactctgtttagagtttctccccaagtccccaggcttgctgctccttggcacccccctggcatcagacatctcactggcaagcaacgccgggcccaggactgtagccccaaacagtgcctcccctcgccgaactctgaggctaacccaggagagatgggagctgccctccagagggcggggggtgaggaggtgagaagtgaagactgggtgggccagaggacatgactgcccctcaggtcatccaggccaagcttcctgccccaaataagtttcaatcactgcggtcccattctttcctgtcacccccaaggctgggagtagcggttggtgttcagtagcagccaccagagcacctggagataagaggagataagggcaaggctgggcggagacagtcacagtctggggtaagggtggggagggggcaggggaaggggggaggcggggcacgttggggagctcaacactctggaagctaggggaggccaggaattggggcctcaagtccaggagtcaaactggttaataattagtgactctggttaataaatcatggatggttttttcttcctaatttcagcttctccttccaccccacaaccctagagatccttctaggctctgcccaggcctcagaaaagaagcccccacacctacccctgccctgggctgtcacctcccaggcaagattcaccctctgtccctccacagccctccataggcctctgccccctcccccagctggtttctggtctccaaagccagtgtggtacttaatctccaagagagattagtgacctgctttcaccaccctcccccacaggctgcttggatgcccctaaatattccctgctggaagggcaggcccccatggccacccagagagcgtctccaggtgccctccttgacggtgccacccgccccacccattgactcacttggctgcaggtcctttctgctggccagaaggtgtcatggagcacctgtgggtaactgcccaaatgctttaggtgaggtcagtcagcagatgttctttgggcatctactatgtgccaggcactatgtgtcaagaaaaaaaatactttaagcaactggaattgaggttaaaggctgatgcacgtgagcggggacctgaagaccaggagactccaggactggcagtttagggtgaggagaaaaggggatgctgggcatttttcatctctaactccgggatgcttccgttaaaggtcaggctgttttctgggtttctgtcccttttgcaagattgcgccaagggcagagatctgcttttgtaagccttgtggtggctggggaaagggagggaggaagaaaaggggaaaggagttgcctccttcccctttttttttgaagattttgaagtttccctctttttgaagggttgaggcaaaagaatgaggggtccctctcccgtcctaagccttgcacgtgctggggctgagagtacagtagtgatggatgaactggcctcaaaacaggtgaggcccctgtctcccaagtgatctttgcacaaagcccccagagatttacttaggtgattaaactatgcccggggctatggtggagactcgggggcctgaactgggggaggggaggggaggcttctctgggaccgtgaccttgattctgaaacctggaggctgagaaggagtgggctgggacgtgaccaggacagccaagggagacccagccacgagcatgcctggaagaaaaccagcgcctccgcagcctgtggactgggacttgaaaagaacaacccccaaatctgttctctctgatttcagcctgacctgtgcgcagtccaagctcaacttgtccagagccacccttgtcctcttcttcccaagacacagccctccctgagctcttcccatttctgtgatgaaagcccagttctgctgtgcaccggagccctggctccctccttcacccctgcctctgatttgctgtgagttcttatcccatttctgcaggacccctccccaatcctagcaccaccacacccatccagccattcctgtgcagggtgacaataaaaagtgtcctcagacattgccgaatattccctggaggacaagagcaccccagttgagaaaacactggtctaggccttcactgcaaccagcctctttttccaaaactgcttttccactgactgctctacactcccacaactttacacggacctattttaggttccagtcaaaataaactgctcctggcttctccagtgcactcctcggccttggctcctgatgatggctgagccccaacacacccacctgtgaaatgcgaggctcccagacaccagccccccttccccttctgtgttgtttagtatttactttctctcctcccctcacccagcacctgagctctttgaaggataggacccagccttaaaatctctgcaggccctagctcagcaccttgcacacagtaggtgtcccataaatgtacagtaaaccgatgggagctggctggcttcacaaccctgataagctgtgaggtttccttctccatgccttttttttttttttgaaacagagtctcactctgttgcccaggctggagtgcggtggcacgatctcagctcactgcaatctctgcctcctgggttcaaatgattctcctgcctcagcctcccaagtagctgggattacaggcacccaccaccacgcctggctaatttttgtatttttaatagagatagggtttcaccatgttagtcaggctggtctcgaactcctgacctcaggtaatccacctgccttggcctcccaaagtgctgggattacaggcatgagccactgtgcccagcctcccgtgcccctttctttctgtttttggttttttttttttttggcaaccctatttaacccccatgccaagaaaggaaaacttctgatgctttccttttacttgacacctcccctcccatctcattttgtttgcagtaaacaaaatcatcttttttccatttgctcaatatttatcagcaccaggaaggtctgcggttatgtgtgtgtgaagttgtgcgtggatgtgtggtttgacaggcgggcgctgtgtgatggcacggttctttgtgtggggtgttagtgtttgagtcagaaattatactctccacaccaggacttgtatggggtcttctctcccatgaactcctctacacttcaaactcctctcacactgggcttatcccataagctctgacctttcagtccaccatgcctttgctgttcctgtctcctctgcctggaggaccctacttcaccagctggcaaactcctactcatccttcaaagcccagtgaaattttacctcctgtgggacacctcttgtttctctaattctcctccccacattcatcatttcttcctgtatcatcatggcactttgtgaacagtcctaccgtagcagtgatcatgtcagtgaatttatcctgtgtccttgatatccttcacatgcatacacacgcatgcagggtgtgtgtgtgtgtgtgtttatagccctactggcaggcacttggtaggttcttaatacttgtttattaaataaatgagaataaattgcttgcttggttttccaaagcattttctttgtacggtgttagaggaatgtgtctgtgcaatgactctgcctgaccttcccgcactgctcccgcgtgttcctgagcatgtcgacctgtgtgcataccgcagcgttcagctgcacatgtgtgcttgggtgcgcgtgtgtgcgtgcatgtggctctgtttcagcgcttctgtaaatggaaagctgtggctgcccctccccaagctgacattccctcagcaccacgcccccacctttgaggactgaaggggtgactgggtggtgacttcccccaggcagctttctctacccacctgatgtccccctccaagaacggtgacccagggtttcccgtccatcctgggggctgagctctctgcggcctcgtcacatcacactcccttccctatccatctctgccctgtttaattggaatttggctagtggagaccatctgttctattccggcctgtttccatgacaaccaagtggcttgagactgaggtttgtggtgagagaagtggcctgggggatgctgggaaaaaccagctaggtcctccccctcaaacccgctccgcctcgccctgccctctctccacaaacccggagttaaaataaagctgttccctgcctgagagttggggagtccccgagcatcactctcctctcccagcccccagcccccagccccagtctttcccaggctcctttcaggcttcccacacggggctcccctccctccctgcttccattcaagagcaccttctgcccttacagactagggagctagcccttcccttccccaacccctgaacctccacccctggaagtgagtgcttcctcacagcctggttacagacgctcagggccccacagaaaggactctttagagggtagtctcggcttcctctgcgcccctgcccctgcaggctctcccccggccccaggtagcagagtggcccaggcaagtgcgtggcagacagaggcgccctgggcccggatgtggagctggtgatcccagattctcaggggctgagacaggccctggtacactggggatatgagtgagggggtctcttatttctgaacagacagttctgttttcacggtgttattttctgccctaatttccccatctatggcaaagcctcttcgtgcctgttctattaccaagggacccgcctgtcttcaaaaataggtggtgtggcttgtcaggtgaccgtctgtcgctctggtcccaggcatctcatgcaggatatgtgcgatatgttggctatgtgggcgggcgtggggggtagagtgtctcaggatctctccggtgccccctcccccagcaaaatcagtcctgggcagaatcagtcctgggcagtcctgaggagggaagctgagtcttggacttcagaagaccggtgctcttagcagctgcgctgagccgtgggaccccagggcccccacgcttgggggtgctgcaggcttgcagaggtcttctggtagcctgcttgtctccagcctagccctgccatcatccatccttcttcatgtgcctcttttcttcttttgtctttgttgagatataattcgcaaaccacaaaattcgccctcctgaagtatacgagtcagtggctttagtatattcacaataggccgtcaccactgcctaatccacagcattttcatcacctcggaaagaacctcggtattcattagcagtcactccccattttccctcccccggcccctgacaaccactcatctactttctgtgtctatggatctgcctatcctggacatttcatataaatggaatcatacagtatgtggccttttgtgactgacatcttctacttagcattccatgtgcctctttccaaagcacagatgtgaccatgtcaccactttgcttaaaaggcgtcagtggctcccagttgcctacaaggtgaagttcagaccctcatctaatacaaagcccttttacaactggctcctaccttgctttccattcaccctgtattcccctctcctctgccccacatatccagtgctttcgccacatccaagcttttaaagacactctttcctcttttcctcttcccctcctgttcccttccctctctctgtctgtctctgtctctgtctctatctctgtctgtctcaaggactcctgcttatcctgcaggacccagctaaaaaatctcacatcttctgtggcgcctccgtcaccttcagacagaatcactcccccttctgagctcccattgctttgggtttgtatttttcagaaacaaacaaaaactgcgtttatcactcagtcattatttgttttcatgtctggggcccctgctagacagagcttttaaggtaaaagaaaatgtcttagtctttcttattcctccacgctccttcctcttgccactaccactgtcactttcacccaaaaggtgccagcaccatgcttgacacattgtataggtgtagtaatgctttgtgaattaaagcaggggtagaagagtgtcgaggtgatggatagcccagccctgatttgatattttgatacctgcctacaatgtataattatcaaatcagggctggaagctcatgtacccccaaaatatgtacaactatgatatatcaattaaaaatccaaaaaaataaaagcaaggggaagaaccagagacagtacattagtctgagagaggcaaccctatagaggaacctggaggaaggagaggattctgcaacttggcatagcagggacaaggtggggtatgactggacctaggaactgcctacatgggcagttggagtggggagacggtggggaggtgttgttcaccctgttcgacagccttgtggagtgtcatggtggtcactagcatgagagatggggtggaaggtttggcagggatgggaggggaatggggaacggccataaaagagaaggtggaggtgacctttagcaagaaaaggggagtggtgggtacagggtagggtgatcccagcagacagaaccgcttgtgcaaaggccccaaggcaagtgagagccagtgcctaaaagacccaggagtggagcccagtgtggggtggggagagaggtcagtggtgaggttgggctggtggagtgagcagcagcctggtcacacagagagctttaggacaaggcgagggtggtggcccttacacctgtgtctgatgaaaacctccctgtccttcaagggtcacttaaggatgaaacggcctttccctgtccacccaagccagcaggggcagtagtgggcctacttcccttgccagatggaagctaccagaaggcaaatgatagattctaacccctctccttcctcacccagctccagggggagggagaattgagggacaggggcagatttgggttccctgccacatactagctttgtgcccttggacgccctacaccaacactctggtcctcagtttcttccgtgaatactgacccactgaggacaaaagtgggataatgatataaacccagagggagttcacgaggattaaataagagtatatacaaatgctccgaaaaggctgttccagcatttattctcctgtgtgctgttaggacaaggtgacaaggaaggaagcagaggcccagggtctccagtttgaaggaatcaccaaggcccctgccctcttttgtgctgttgtctttgatgacatttccaagcgattagaagccctggtgggggcaatatcatgctgtttatttgaaatcgacttgaaagcaatcaatactatattttctagggggaaacacaaatttagcttccacccttactccaagggtgcaatgcgtgcagagagaagatacagtggtgcctggctagaaggtccctccctcttcctaggcaaccagcagttctcagagcaaaggaaaatgggtccttcctggcgctggggggtgagttggggtgggcccaaagctttctccactgggagtcacaggagccactggccctccccactgtgggatccagttcccaaggagggtgccaaacagaccttctgcccctacaaaaacaaacctgtctaattgcctttaatcttgggctgtcggtccgctggtgttggtgctgaatagtaaaaggagatcatatctttccctttgagtgaaaagttatttgatctctgtgtgtcagaggaaagcctgtgcccagggaagaggtggggacggaaggggaaggtggaagaagagaggagcgagggcctggctggcggccgaggggaggctgcagctgagggctttatttctcccaataacaatcataaataaaggggaacaagcatctctcttgtcttggctcaaggccattgttttgtgcagggcttcttcttcacccctgccccgcccctccccgcctccctctcaggcccaggatgggaagacagcttgtctgcagggagaaggagtgggctgccagctgtctcacctggaggggtgggagaggagggctccgtagaccttgatgaagcccctgccccgcctctggccttggggctccctccccagctctgcaggggccgccaagatgccccagatgattgcagtcgcctccaccagtctcccggcctgcgctccctcctgttcattctcagcagttgtcagtggtcttgttgaaacaaagccgggtcacagatctcatccctctgctcgtggcctccaacagcatggtccagctcaggggagaggcctggcccctgcatcagtctcctccgtctagctacaccggccacagttaccagacgctctcccgccacggggcctttgcacctgctgtctgctgcctctgcctggaatatctcctcccaggtggccacatggttggcttgctcaccttgtttttttctttgctcaaatgtctcctttctcagtgagatcttctctgggcatctttgatctaaaattaattaatcctacacacattttatcttctttcttgtctggttgccattgctagaacataagttccatgaagacagagaatgttttctgctttgtccagtgctgtatgcctgggacctaataggtactgaatgacagcaggaatattttaataaatgaataccctaatggacagctgctgcctcctctgcctgcacaccctgtttctgcatgcaatcacatgaagtctccctgaaattcctgctcatgaaggcctaatctcgagccctgcctggccagcacacactgcatctcccttatggttccaccctggcctgtgatgtgggctggcctcccgtagagccttatcatcctgcagagctttatggcatctacacagttctctcaccttatcttcttagcactctctgaggtcaggactatcaccctggtttacatttaagaaaagaaagttcagaggttaatgactaatttacttgaaaataacaccacatgtaagtggcagggccaggactcaaaccagatcttagctagagctgtccccttgctgcccaaggtcccaggacacctggtcccccctccctggcgtgcgcagtcatggctgagctctcagccctttttctgcatctgctcacctgcccggagagagcctcccggggtggagtggggcattctcacctccaccaaggcctgcttcataccccacggaggagagggagactcattctgagccctgccaacacttagaaaaccaagttacagatggggcggtagaagctgggagcacccagtggacctcttcctaccctcaggcaaggggctgaaatccacagcctctttctgggaagcccttccctccagctctgggctctccatttcaagaaacacgggggtggactgcgtgcagtggctcatacctgtaatcccagcactttgagaggccgaggcgggtggatcacttgaggtcaggagttctagaccagcctggccaacatgaaccctatttctactaaaaatataaaaattagctgggcgtgatggtgggtgcctataatcccagctacttgggaggctgaggcatgagaattgcccgcctgggaggtggaggttgcagtgagccgagattgcaccactgccctccagcctgggcgacagagtgagactccgtctcagatacaaaaaaaaaaggaaacactggggtggtcctggatgtagacccagaaggaggaagcagacagcccctgcccgcaggttcgtgtgcaggaaaatgatggtggggcgtgaggggtgcacccagctgtgtgaccttgggtgagccttttgaggcagcttcttgcccggagaaccgtgttcctgggtaaagctggggagatttgccaggaggaaccattgtcttggagaagaggtggcaaaaaggcacactaacgcgtactccgagtgtgaaaggatgggcatgataaaggccactctctccctgtgagcgccattcctgagcacctgtgtgccagttccgagcccggcatcctggatgcagtggaggtgacaggctgaacaggctgagccgcgcatctcattactctagcaataagctaccttgcattttccatgatcaatccttttgggatctcatgaagagtgtgggtggcagaggactttaccaataatccaggttgatggaaattcagggtacgaggcagacaggaggttctttgctaacatgggccaggtgtgctttcatgaaagagcgtcagcctcgttgttgggagtcctgcctcagccacttgtgggtcgggtcacctcaggcattccctggcctcaatttccttatctgtacagcaagtaggttgggcttgttgctcctggggagctcttggagtctcctggcccatcctgggtacacaggggatctgtgtgggaccagctactataatcctaccacttggacaagtccaaggcaaacaccaagaagggtacaagacagcgtggtattgtgacttctgagggccagccagcctctgagctctggagatgcctgactgccccttgctgaaagacatttatctgtcccgttggtgccagcatgaaggcccttcctgactacttgggcctccagcacgtgggacacagagtggggccaggcagaagaaactcgtggtcagatcctctgccaggagcatttctcaaacccacgtgggtcccaacccctcccactggagctggggaagctttgaggcaccttggtctcctggtcatgccgtgtgtcagttacctcttaattgttgatcacctcccatgtgcaggccctgggaagtgctgggcatcagctttgagcaaaacaggtgccatgcatgttctcatggagctcacaggctggtgggggccagacactgaatatgctttttaagtgtggcaaaggcctgagcctggtgggaacatagagcaaggggggtttaacccatactgggggacagggctgcctcccagggtaagagatgttactcaaggcacgaagaatgaatgggccatggagaaagaggaaaaaaagaggaagagaccctgggaaggccctgcatctgccaaaggtgtgggggccacagcgccaaaagctaccatctactgagccatcatatgccagggtcagctctcagggctttgcttatagagctttatttaatcttccctacagcctttgagggagtgattattctctctccatttttatagacgagaaaaaaaagtcacagagcttgcaagtggcagagctgggatttgaacccaggagcctggagtcagaggcttctctgctgtataactgagagaacggggatcttcagcaaatgcccctggtgaggtaggactagaagggggcaagtggaagggccaggctaggcccaaccagaagcagaaggaacaatctgcttcttcccagcagcagagttagcctagcagtacacagatggcctcagccacagccctggactcgccttgatggcatctggcggtggctgacccactcccaggctctgtatcaaaaggcttagggaaatggacttgctcttcagcagaagggattgagatgaaaccacaggacgaatttcccagctgtcatgaccatacgctattaaaacaggcagccgagggaggtggaggccctggtgggaaaggttaatgccttggttgctcagagctgctggagaggtgagtggggcagggggaggtccaggatgacccctccagtgtctagagatgagatcacgtcacacagatcaaaaacactgtcccacaggaagagggcactgtcagctgtccccaggctggtgccaccctcttcctgggaccctgtctgccccagccctgccatcggacttcattaaattgcattttcccagagcagggcaggccggtgacagaatgagtcaacgtcagcttgctacaactgtcgcccctggagccggcgggcatagagggagataattgggagtggtttgacagcttaatgtctggggctggcttcctggagcagtggagggacagggacggggcgggagccagtgaggcggaggcaggtggatttgggctgcccctgtcttgagaatgaccaccccccaccacctttcccctccatttccctagcagcagcttgttgggcaggaaaataaagcaccgggaaggaaatgagacctggagaataaattaggctttctttattaatttgtcagaactaattaacatctcccctaggtttgtctcctctccagatgccccctagagccaggaggaagggaagagtcttggggannnnnnnnnnnnnnnnnnnnagaaggacagaagaggtgtcactcaaagggggtctgtggtcccgttctagggactgcaagctgagagggcccccacaatgcattttgtccacttgcctagggttctgagccccagacaccccttggcattttacctctctgtgtttgtgtcacttcaatgaaacagagtcagtgcccacctcattcagagttggtgggaggatggcctgcgacaagcactgctcagagaaaagtcagctctcattattttgagagacagaacttcagtaaagctctggaaggttctgagttctttcatactcatgaggtcactttggtttgaccctagcaataatcccaagagctataacaagcaataattggtgttcccatttcacagatgacacagctgaggcacagagcagttacatacgttacaaggccacacagcgaatggctggcagtagcaggatcagtgcttagctgagcaagcaccctgctccccagcctcccctcctgagcacacacccgtacccccacatctgccccactgcagagacctgactcacggctgggagtctcacttactaacagatgcctcacttcctgggtgtaagttcaaggtctcagcccaggagccaccccaagccacagaagctccagtgctactgtgggctgctctttgacttgggcaagagcctggatttgtttcgcagagttgatgccttttctcatataccccccatcccagaaaggggcccagccctggtttcagagagtcaccaactctaagaagcacctctcaacaggcgcaagaggcccttgacagagccacgccttgcatacaacaccttgaagggttgcaaaatccattctgtttcatatcccgccatgctgcgatcacatcctagaggtttcatttccgctgagctacaggacgctgggaatgtggaagtgaacactccccacccaccgtcccacccccaggcctgagagcttgttgccttccacaccggcagcctgttggagggtggctgcagagcagagacccccagactggccaagccagatggaacctgaaggaaggatcaaccgagcagccttcctgtgttttaaatgaggaaactgaggcttggaaagagaaagccacacagttcactggctcttggcagcaatggtattagtacctggatctcctgactcccaagccaggcccctttcacgaactaggtgtccgcacttgacaaatgacattgtaactaaatgaatttgtcccattagggactctcagagccaagaacgggcaaccttccaggggaggtggggtgtatgccaatggtgtcagaccaaaggtcagcatccagtgctaggtcacaccacaccccctccctgcctcagtgaccacaagggcagattctcccccaggcctcctggcaaaaccctcaggcgggccctcaccccagcaggagacatagagtcctgtttcagggcctcgaatcatgaacacggttgtcgctacagtgccttttctccagtaacacagttccggctccacagtttgtttcatctgatggtctccccacacctcaggggctggggtggtggtggttcccactttaagagggggaacagagacccagagaggttgtgatttttccacagagctaggcctggaaagcagccccatcttctgaggccttggagagaaagggtgagctggtggggtacacactacacttggagtcaggagacctggctttgaatcctggctctgccactaaccgtgaccttggcaaccccgaatgccacttagtctcgatgtcttcagctgtctcctaacacctgccttggaaggctgaggacttcatgagcactccagggaatgcacctgagcgtctttcaaaaggccctaccccagactcctgccactctcccttgcatgtttgtgtgtgatgagggagcaggcatagatggaacgggccctccagtcatcctgtgactccagccaggcctcgaggcccagccgtgcctgcccgccagaggggccagagtgcaggggtggggcgggccgctgggacaggggcctctgctctccaggactcggggctgggcattgacagagctgggtgtggccggcctggggagaaggacacagagagagggaggagctgggctagttggcgtctgctggccggggccgtgggaaagagtcccagagttcccttgaggacagtcggaactcttagactccaggaactcagggaggagactgggaaaagtcccctcagctcaggtcaaagctccagcactggtcccttgttttcctgcatccttagggctcatcacatgccacagtataaacacaggcctgtgctggtacctaccagggggccggctggcagagacacatggcacttccccttatcctctgcagagatgatgatcctagctctttgcagagctctcctgggcccctacctgaaaaacataggactccaggaccagggcaggcaccacaggccagagtgaggatgctgattttcgaggaaacaattgagctgtctgacacccattgtggagctttgaggctgcccatttttctgcaggctggcacagggcagcttagagaatccacacaaatgggagcagctgtggcctttggggagggcctggagcccactttgggatgctagaaagggtcttgctctgaccctgaggaatggtctcagcttgcagccctgtccatgatcctagggtacccacatatcagtttcgccacctccagagcaattattctgtgtcaggcacttggctaaccatgtacatacgttattttactgaatccttatagccattttgtgataaagtattagaaactggggtttcatgttacagatgaggaaactgaggctcacagggtaaggcaacttgccaatgagtggaagagcccagccccaggtctgtccaccatgcgaactccctctctactctccactgctctctccttatggggaggaactacctgatccccagccctggtacctgatcccacatgcccaagcacaccatgggacagattgtgcttcccttataataagaggaattgagggtagatatcaggaagaacttctccactactcaggggtatagaacactttagcagtttcccagggggaaatggtagaatctcatatgctgaagaccgtgaaagaaggggaagagacaatttaatcacctgggtggggttttgtggagtaaaaccttgccagtgtcgggggtagttatgacagcacccttcagctgggaaagtctagaggctcaggcccccaactctggtggggtatgacctctgtctgctgccaccttgccaaaagggtccagcatgggaattgcttttccaagaactttcttgtccaagtccacttgggagcctttgccaactagtgcctggggcagcatgtcaggcagggcagggcctgggcctgggcaggtgtggtccccagctacctgtctgggcactagttggatccacattgagagctctgccatgccaaaaccccggtttttgctctttcttttccccttccctgtccctggtaaggagctgggagaagactcaggctgggcaggacaccgagggcttcagcctctgcagcccatcctgcctgtcctctggggaaatcactcttcagaatttgttgagaacttataatgtgcacaccagtgattaggcactgcctgcctagaaagctggaatctggtcttaagagagggttccagttgaggagacagaaaaccaaggggcagtgtcagtctgaaagggagcacagtggaccacaaccagaagactcaggttcgggttctggatccaccaccctttagctacacaacttggcaaatttctcaaccactgggcctcagtttctccctctgtaaaatgggactatcagtccttgctccagaagatggaagtgaaaagtaggagattctgagtgcctggtagatagaaggtattcagccaatagtggtggaaataaaataacttgctgccagaattctgggaagcaggaagcacagatactgaccaccagtatttatttttagggttgcgggagcctacgaaggagaggggctgagccttataaaaacttgggcacataatctgtctaatcactttgaagatgaaaagttgctgtgaaatgccaaccgagctgatgggaccagggctggagcagagatgaagagacacagcagggccaattgtgcaaaaataaaatgcatattttttaattgcttgagttcacatctcataaaagaaaaaataataaagcgcaagcccttgcatttccctacccccctctctcggctgtgagtcaagaaccagttcccaccagtctttctggggttcaaagcgtctccccgccctaatcctcacctcgacctccccgccccccacatctattgtgggtgagagggcctttccctgagctgctcgcaggctgcccctcccaggcccggcctctgcccgctgcagcgggcagcacacagagtgggcaggcctcataggaggcggggagggggctggagagacaggatgccctccctcctcccctgccaggtctcctgttgatcttagtgcattgtgcaggtgacatcgcgcggctatctcactattctcaggcctcagcattggttcttccctagacaatgtggcaagatgccttccagcctcgccccatccgcccctatgccgcctgcagtcctgctttccggggcctgcctgagcctgtaacccaggagaggtggaggccttgggccaaagacccactgagccaaccctgtgcaattcccaccctggggaacccaccctttcctggttcctgccagccctggtccctgtgtcctcagaaatgggacagacctcctgcccctttctcttgcccccaacacccagccctgactcacctccctcatttcccactcaagctgtgtctctgggacatgtcaggacagggcacctgattctggtcctacaggctcaggctctgcccgctctcagtgggggtggggcagctggggaggatttgctttgacctgcttcttcagcttccctccctcctccaaccccaccccaggggggcgggcggggttgaactccagaacacctcctgattgcactgacaagaggcccactctgctcttcgatgctgaagtctagctgggggtagggtgctgcccatcctcaccttactctaggcagcctgagtcgctgagcactgtgcgggggacaccaacctgccctccaaagacagacttttacctttgggctgggttcagtggctcacgcctgtaatcctaacactttgggaagctgaggcaggtggtaatcactttaggccaggagttcaagaccaacctaggcaagacccccaactctaccaaaaatttaaaaaataaaatatatgtatagacttacccagacaccttcacccaccaggactgtaaggctgtgccttgttgcctcttcctcacccctttggcaccaagagtgtagaagaagggtcaagagacttggattctttttggcttttcaattagtttattatataacctcatgtaagacacctcacttttctgggtcttaatttcaacatctacaaaataggtagcaccttcctcttgattattccaggatccaggaccctcctggtaaagggggctggaggagcgtgatgggatcagcacttgcaaaccaacctggggagcaaaggggggtgctcccacttcccactggaggcatgaattgaatgcggcccccacatatgcagcccatcagcctttctcttacagagaatctcattttggtaaataagcatggccctcaccagggattctggtccttctttgatcactcagcttcctaagaagtcttgattaaaagatcgcagtgacctgagaagccaccaggcacccccatccctgagttggttctctgggatttgactctggctctcagttcatccagcagacctggatccagggcctactgcgtgccgggtgtcaggctgtgtgctgggacgtcgggggtgagcacatctgtcttcgtggcacagccaacactgtgtgccagggagagctgtttgagcaaggagccaggtgctgtgggaacctgaggtcagagctgatgccagtgtgggacctgagtgttgaagggtgggtaggagttttccactggcagcggggactggtggggagggtggggacctgggaggggtgggagagggagatgggaatatgggcagggacagattgtgaaggcctgataagtagtttagatttaccccaaggcagtggagagcgaccggggacttgtgtaacaagatctgatttgtatttaaatccacttattagcagtgtggcttggacagatcacttcccgagcctgagcctcagtttctcagcatactggggagacggattacctaacgtaatacccattagacagtgggtgctcagtaaaggtgtgatattttcagtactgtgattccagataagagacagtaggagcctcacctccctgtggagttgcagggagccgagggagctgaatggctgtattctagaccttcagaaggagagtcaaggggctatattgatgcaactgtggttgggccctgggaggggtagggctgaaggagcagctggagagaggagttcagtgcacatggagggcaagatgcctgggggggcagcaggacacctgggttcaggccctcagcacagaggtatcattgagggcctgccctggagtggaccatgggccaaatcagcatccccatccccttctctcccctatttcttcctccagggttcccctccccagagtaatacaaaactggtgtgtcaccatcaagttcaaagagcaaacgtgttgcccacactgccctcttcagcccacatcacttcaggccaaggcaggcggctgtgagccaagcaggaaatagatagaaggtcaggaaccttctgcaatgagaggtagtgagcttccaggggacccaggcctcccaactgcctgcctaccaccaactgctccttctcgccacaactggctgcctcctggcttgagctatttgcttatctggtgacccagaggcagggtctttgtaaccacaagagaaaccaccacagtacatttctatgggctagtgttcagttgatgattcttgcccaggtgctcctgggccatgatcacactgctgagccagccgagccacggagccaagccatccaggctcagatcactccttcccacccctcttctccctgggtccgaccctgccagctcctgcttcccctgattcccactaactgcttggcaatcttggaagagctctccttctctgcccctccatttccccctctgtgaatggggagtcaagagcagacagtccctgtctcagagctgctagctgaccaatgctcagcctggtctttcctcctgccccagactggtctcagcctgagttccctgtccctttgactttcctgtttatacacaaaattcacccacaatattttagttttccaatcaaatcattaattaccccagtaattaaatctaattagcagtggtaggggcctttctgagtgaggagtcattagctagggtgaaaatgcacgggggagagagaaaaagaaaacccaccctttcccagcattaaaaatgaaagcaggagtcagcgctgcaacatggagggcccctactaaagctgggcctcactcattaagctaatttggtgtgctatcccagtagcctctgctggggaagcccggcttcaccgtccaacattagaggtgtgttggagccccctgcgtgttttggaggctgagctgggcctcccaggaccccagtgccccaactcagggaggggtgtgaggagcctctgctgactcttcatgagcacctgctgccacttcctgggcttcatggtggtcatggcccagagtgggaggggctgagtgaaaaacgaggaaaagaataacagcaccttccactcctgggccttgggaaaggacagagcttggcagtcactctcctctcttggcccgaggctgaggggactccccactcggggtagttgtgaagattaaatgagattttacatgtaaatggatgacatcacaggtgcttgatgcgtgcagctgtcattcaccctttagttttcagaggtgctcagcattcctttttcacttggtcctcaccaccccacagctccaggaggcaaagggtgcaggtgccacctccaggtttcacaggtggaggagctgaggggcagagagagagagacacacaccccgagagtggcagggtttggactggaagtcaagtctctgagctctgggacgaggaggcaagaggaacaggggaagaatgggggcttttcatgtctggagtcttcagtcatatccttgtgctgggctgccggggttgctagcccctgtagtcctgggggaggtggaggtgtcagctcagcctcccgcagaacgaaggaggagtggcaggggtggggggatggtgcctgccctctctacaaggcactcccagcagccccatcgtcagcctcaggccagcactgccagcaggcaggggctgctcacccaggtctggttcagagggtgctggccgctcttttccccaggaaggggagagagggaggccgtggagctatgagtgtggtgaagaacgtcacctgtggagacagactgccctgatcagaatcagtcttgcagactgtgtgaccgtgggcaggtgacttgacctccctgagtttcctcatctctaagatggggacaatctcgctcctggagtgttgtaaggattaagtgaattaatgtatgtaaatatccagccccaggcctggcacagatcagcagtgcacatgtgttaactgttcttgccatcctttgggaggggcctggcagggaacctgacccttttgtactttctcccccagggagggaaggaggggagcacttgagccccagcttctgctgctgctaagggcatgggcccaaccttggggtggccgaaaggaggcaggtggcaaacatggggtccacttcccacccccgccacccacacacacacacacacacatcactgccacaagccacttctcggctttcaggggcccctctgcacagagccaagagagcatgggaatggaaggagggaagggaagggaagcaggtggccaccgaggctgagctgcatccgcagctgggcgcgagccccgagcctacgtgctggttcctccgtgaggcagtgtgcggagcaggccctggcacgccaacccctacccagtgactcctgaaaccccgacaagtctgagctggaagcggggctgggcgaggctcctgatagattcgtgttgggcagagggatggtcgggcgggggaagcatgggaaagaccccactctcgaaactctgacaccactggggatgctgggagggagcaggtggggctggggacatgcggccaggctcagggcttctaccttctccctctcaggcccctcaccccacatgcccctgcccggcggggcaggaagaagacaggccgcggcagaggagggatgtgctcccctcagcattttgccaagtgatgatttcagtgctgctgagaaagagggaggaagggaggatgacagccgggagctgggagcagggcaggccaggcaggagggctcccagaaaactcctgggactggggaggtcattttatacaggagctctccctccaaccaaatgaggtggatgtgctccggcccatttacaggtgaaaaggctgggtttcgggaaagttatgagacttgttcataggtcctactgctagttaagtgccaaggctgacattagcaccaggaaaaacaaggaagcctctgccttcccaccgcccctttcagccttctgggcactggggaaagggaaagcccagggacctggatgtgtccacaggccctgctgtagcggggcaagagcaaggcagagagtgggcagcaccgtgccccctgcaggcagaccacccgcagagcagccttcagctcagctggcctctccccaaaaccccatgtcacaaccttttgaagatcccactttccccgcccacctcaggatgggggactctcaggtggaaagaaaactgtgaactgtggctgcctgccctccagggtgaccccaagctggggctgggtttagacctggagctccagaggagctgagttcaggcctgctgctgcactgagggccatgcgtggagtttgcttcgttctgtggttaaaccaggaagaggttaacactagagttggggtcatgacccgggtttgtgttgtggtctaggttggcactgatgttgagacctgggcgggggctactcttggggtttctgtgagtggttggggagaatgcttttggtggttaacactggggcaagcacattgagttggggtattccagctcaggctggtgtcctgagaaagggtggatgagtttgggaggctcagcactagttgaacaaaaggccattgcttatgtttggaggataactgcccattttcacaggaccattggccaggggagagaatcggggttggggtggtagttgagccggaaggtaggttgaggtggggggcggcgtgaaaagtgagtggcttctgcagtgatggaagggccactcagagtccctgcccctgtccccgagttcccccacctctgtggcatcctgtgatgtgggaccctccccaccccaggccccacccagatgctactcagacataagcctgaacatctgggcacgggctggtctcccctctgtggggtttgggttctctcatcagccaagggaacacagggccggggttttgcctcttaccccagcagtcctgaggccctgatctgctggtgcctgggggacctgccctcctggcctacctccggcagcgctgctggagaccctttggtgggggctcctgaggccacactagctgaagaagtcaagagaaaactcaactttaagcctttgctagttccgtttcccatccccttttttttctggccccagcccctggtcattgaagcacatcggataaagactgccaccccccagctcggaggtctgtgatccaggagcagagctcatagggtggcaaggaagcaaggaagcctttattttttatttatttattttttttgttgttgttggatggagacagccctgagccaggagacatggaaagagaggctggcctgctggggtctcagtccatggttgtgccacctgagacactgcagggtgacgtttcaccaaggaggggctgcgaggaaaggagctccggctgtctcctccagcatcacagctccctttcctggcaccgcctaagtccaggtacagaagaggccctgagcaccttgtgccaaggcctggtgcagttcttgtatcatccatacagggaagggttcagcagaaggcccagccccacctgggaatgttatgtctaacccagacgttacgtgcaatttgaatgcagtatcgctcattgggtccagaccagtgagttctgcccagaaatgaaatagcaggtttggtgcctatgcagataccttcttcttctcaagctgctttggaagcaggtggagggaagagattgctctggggccctggtcactgatccccactcgctgtccaagagttcaaggtcaccactgtgctgtggctacaaagtattatttcaggggtcattgcggtggggattggtgagaccaagaccttcttgaggggatggggtcgagagccctccatcccaatgttgctccagtggcccccacctgctgctctggcagtgcgcacggagctcctagccctgctgcctgtttggaatgtgcggggcacattcagaacttctgaacagtcaggttgccttctcctcattgccccttcagcagcagggccccacccacaccctgaagcctgaaccgatagtccctcactttgcagctccctcccacagcagagtgcctctgggcaggcagaattctgactccaaagccttgcctaggagcaggaggtgcctggggcatggatggaagtgctgggagtgccagatgccagccctgggtgggacgggctcaagggctgatgctgtagggtctgaatgccacagggaaggtgcgtgtgcacatgtgtgtgctgctcctgaggctgcgaggctggaaccacctgcaagtctgcaatcaggccctcctatgttcaaagaaaagccaggagaaccaggcccagggtgaggagcgcaaacggcaaaacttaatgactttaatatgaaagaatttgccactaattaagcacaaacactccactaatgcacagaacacatgttgtggatttcacttaagcagaaaccaaatgaggtgaaaatccttccaaaatgatagcagtttaccagccgaaggaagacgctgcctgactttgtttcagctcttagaaacctagcgcagcccctaccttggcagcctccctcccctccctgtctaaaggtgctcacaacaccccaccgcatgtcccctgtgtccctcccctcgctgcccctacccaccctcttgcatcctctgaggacacacatgccactctataacccatattctgacagccagctccccagaggaccctgttctctctacctgtctcccccaaacacaactcactgcccctcctacagagcccagactctccagccctgttcccagccacttctggaccctctgtccctggacaaacaaggacagttccccaccagagtgccccccaactatgtttcccactcctctctgcaccagcttgccacagccagccctgcatgtccctcgtgagctccaccatccctgcctgagctttactcccttcctctaggccagtggtcttacccggggatgattttgcctgccatgggagatgcagcaatgtctgtggttattttgtcatcacaaatggagggggtgcacttgggtagaggccagggatcttgctaaacttctgcaacacacaggacagccccccacaacaggacagtccccccctccaaaatgtcattggtgcggagttcattcgtgccctgggggagtagcctcatcactgcaggggtctgctcaggatcacagggtgggcttagagccgggatgggaatcagggaaccagagcacgtgatttctaggtaggttctttctcctagcaaataatacaactgcttgtatagcatagctatgggccaagcactacgccaagagcaaaactgaattatttcattggatcctcaaatcagccctaggagatagtactattactggccccattttatacatgaggaaactgaggcatggagagattaatgcacctttctcgaagtcaaccagctaaaaagcagcagacacaaacccaggtctatctgaattcaaagtcagcgctcatagattactttctacccctccccccgctgccatgttcctcttaatctctcatctgtcaggccttctacacaacccctagaactcccaccccatccctattagaatgagtgttccctgcaggtaggcattgtataccttcccccactgccttccactcacccccccggccatccgagcaggcagctgcccatagctggacagggcatcgggagggttgggcgctggggtggccccacaggcccctcctgggatgaggcagatcgagaaccctctgcttccaaacaggtgttgaacatcagcctgaagcctgcggggctgagacaatgcagatgtcaatactgagcttttaaaagattctccggggaagcctggggaattctccctctgctttctcggcagccccccgcctctcccacccccacactagccttccaaagaggctgctgcctacactccccaaaatgtgtcattaaaaatgcacacttgccgagggaaatccaggctgccgtgtctgctacaagacagtgttgtttgctgcagctggggtggagagggttggcatcagcggcagacaatgggacctgcctgaatcttggcctcagagccagggggttccaggttggccagaccatgaaaggctgggacagcagaagccccagcggtggtgggaggggcgatgaaccggggagtgcagacacaaacaaggctaagatctccagagcagggcctcagggatggagtttgcttgggtgagaaaaatgtttgtcaccttatggtctggcgtgaggaaggaagagggcctaggtgctgggaactggggcagaggagagaggaaagcaattgagaaatgtctcggggaagcaagcagaagtcgtggggttggaggtgggcgagggatcgggccaaccttccccctgttgggatgtggcttcctgctttcagtcaaggaaggagaagattcggaccctgacctgcttcccttccatgcaggtgtgaggcctcactttccatttctgccttttggataatatgcagtttccaggaagctgcagtcagacctgagaaatggctaaccctggctcaggcccccagctgctcacagccttttccacctgccacttgggccccctgtgtttcccatgtgccaggcactgggttcattcaagtcctggccttttccaaactccgtatgagaaacgctaggacaggtgtgcgccgagatactgggaccctgggggtgcaggaacacgcaatccatgaaggtgggaagaggagggctccgggaagcctcccccttgaaagtcaactctaaggtgattccgggaagaatgaaaaggacttgcgcaggtaacgggggagtggtgcggttttcgccgaggcagcaacctcaaccgaccggattgttaagtgtggcaaggaagagagagaagagttgggagaggaagtggctggaggttggggatgcccaagatagggtctagagcccggaaaaacttcatcctgagggctgcaggataccatgggagggtctgaagtagtaagtgatttgcatcttacagagatccctctggcagctgagtgaaggagtttcagggtggagctggaggcaggagactgtagacttagcgtgatgcagcagtggactagggaagggatgatgttggcctggacaaggggcaaggcttggggaaatggagggaggcaagagatggcaggtgctaaggttcaaaggaaagagctagtgcaaagtcccagcccgggaatattgagaaaataagaaagggagactgccggaggtgaggtggagggaggtgtgcactagtgagagagggcttaggaagtttgaatcaggaccagcggggctggaaaatcaagaggaattcaaaagctgtttaggagctggcatcagtaagacttggtgattacttgactgtaggagagtccctgtgtgctccagctttgccatgctgtggcctggattttcctggcatcccacttaacctgggaggtcttcctggaagagctgggcagtgtagagagacagagcagccacttggtagataggtccccagaagttgatccaaggcaaaggcacagctgggtcagagtgagctggacaggtcatgtccaaagtgcagtcccccaaggtcatcagagccaatattccccattttacagcaaaggaaaccaccctatccaaggccatacagaaaaacaatgagcaagtagtggggaccagagctcgcctctctcagtgtccaggtgagcagagcaaaggtggcaggtacaggagagtgatccaagaggtgatgtcttgaaggctagaggcaggcagggccaagagagaggctctgtgttcctggggtgccacgatggagtcagaggctggctcaggactggccccatgatgggccatgtggatggggcagccagcatgaaacaggcctgcaggacagaatccaggtgtcctcagccacctggtgggagaaggcaaaactcagctccctgactcatctctgaccccagcctgtcctgctggagggaggtgggacttgccagagcacccccatcactgctgccacgccggggcagcagagcagggccagcctggcctgtctggaagatcctgggctcctgcgctgcctccttctcggggcttttcccaggccgccgtgccccctcctctcccacgcactgtgctcacccgcccaaggcgccgggcgccagctccacagcccatcattaaacagctccatgtggggagttggggggtcatcaggcaagaggaaaacatcagcagtttttgtgaccccaaaggaggggcggaggcactgacttggatggtagcaattagcccctgactgtgggctcatgggatgttatcagcacctcccaccagccaaagtctctgcactgcaggcagcaggggagacagagatgccagactaacagcagtgcaaggccaggccggactcaagtccagactgtgcgcagccccagggaaaggtggctggagcaccaggacaagaactgggtctgctgggtctacttctgcttccttgctgagccctcctccccatcctgagtgtagaggggagtctggaggcaggagggggcagcctgggcacccgtgaatctcctggactaatggggaaatgagacaggacaagctcagtgagagccctgcccctctgggttttgctgacagaatgatcggagtctaggtgacactgattggcaaaacctgtgaaaggaggggaccccagaaaggaagtgggtgtcctgattgcacgctcctccacaccggcctctctcccaggcggagctggccttggcttcagaaggtatggagttggccagccctgggagttgacaatcagggaagcggctgcactgggaggagggggcctataacctttaggtcactgtgctgcctcagcagggtttcagatggaggccctgcccctcccagtgggtgagtcactcccacttaccacttagccggtttctcaccggacatcctgtccccttctgccagttcctggggtgggggtgggagcatccctggaaagccctagaaatgcatcccgaaggatatcgatttcacagaggcccttatggcggagcccagcacccacctcagacacacacgtgcacacagacccactccctctctgcaatgtgccgccactttactccaggccaagttggctgcccctgcccagccacttcaaggcccccaggcagagtctcaggaaaggaggggctggggtgggctggcacagccaggacaaaagaagtggtttatgccaggaagccccaaatccccctcgcctcacctaggtacccactttcacctacccctgagcccagttccagcctgcttggctaggaagaggggtctgggggttaaaagggcaggaagagaaactgctttaagtgggtatgtggggagcgaagtgtgccacaccccgctgcgtgggaacctgtggcactggcttgcggatgagctccatggcaggcagggccttggggagcaggtttgtccgccacaactgaggagtctttgtgttttgttgctgagctcaggcgtttgcaggtctgtgacgtctcagggggccggcctgaggcccgtcatgctggctcagcacttctgggaagtgaggcagcctgaactgcccaacctgagatctagtggggaaactgaggcacttgagaacaagccccaggggcatgggtcccagatcctggagctcatagggtggtcagggagaatataggcagtgcttgagttcaggaaaaaaaaaaagactgattcttttgatatctgtgggatgcaagagcccctctgctgagggcacaggttctatggatgcctctgcccttcactccccacctctctagctcttattgctcagcacatagcagcctcctgcaagtgcccacacacacacacacacacacacacacacacccgggatccccaaagcccctgtttctgacctatcacctgacacccagtcaggtgacctgcagatgcaatggccaccccagtattgtagctggtgtttgtgccatttctcacaaggggcaatggaggcactgaggttatattctaggagggacaccacccagaaagaggccccagggagttaggttgagccagagtctgtttttgtggcagggtgggaaagcactgggctgggtgctgctgttctgtgtccctgagcaggtgacctaatccctccagtcattgtaaatgatggattgcatggtccatcaagctccaatatgctaccattttagtggtcccagttcccacatctgggccagcctctgcttctcatgtaagagggaacctgcgggaaaggagacaggatgtgttctgtggaccagccctgactgcttagggaatcagagaaagtcagcagggaactccccaagccctggaccctgccagtggcaggcgtgacatggtcaactcaacccaaggccaggcctgctcctttcatctcctgcaggggcttacaattggttgggagacaggctagacacatatgccaggaagtagaaaataaaagggtacaggtcagtgttacatgttattggggtattaatagaactgtcagctgagtaggaagagatgacagtcacaagggcgtcctggaagaggggcgcctagtagcactccctacagtgtccagtatggagtaggtgctcagcaaatatttgttgaatgaagttccagggagggaggcctgttgcttcatagatgaaagatgatggtgatgatgatgatggaagctagcatctaatgagcctttcatttgtcctaagtgctgctttctgagtttcccatggactccctcttttaatccttacgcagttttatagggcaggtattagctattataatccccatcttacagatgtgcaacattggtgcaaactgagctacagagaggtgaagtcatttggccaaggttgcacagctcatcaatggcagaggtggaatgcaaccccctactgcctggctcctaacagccccgccatgctgcctgaaagggtggtgacggaacagcccttcagaaggtgggagacgctagctcagctttcaggttgtcaaggctgcagtgtctggagaagcttggcaaggagaggggctgtgcagtctttaagcccctgtttctgctgcctgtccctggagcaggctgccttttatcaatcctggtcccttctcgtggcccacctgttccaggattcttgcccccatccagctctttctttctttccggtggtgatccctgctcctctgttgactctaacattctaacccgcctgttagagtcacctggactctgctcccgtctgaaaacctcccaatctaaagaatgagggtccttctccccaaccctgagtccttggaccaaggcaggcagcccctaatacgaggcttgggttcccggtccctaagtctggagtggagaagtggagtttttaggcctttccaatcttccagcacctcccaactccagaactctgggatccagtccccaccctcaatgaccctaagccccttgctccaagagctcccttatgctcaccccatgggtcacctcccctggccctgctagcagtcagatgtagcaaagaggcaaataccaaagtgagtctgtacctgctccttaaagatcctccctgccctgccccaccctgcccatcaccagggcaaaaatgtccaggacgaggggcacccacttggtgcccagtaagagagaggctgggaacgtccttcacttccccaccatgtggttgcttctgggagtgccacagtggacagaaaagagcaacctccaccccaacatagacgtgggctgcccctgcctggtgagggattggtagatgtaagggggcctctggggtgcccggccaccttgcagcaccctccccaccccatgcctggccgctatcagccgtctcccctcctggcattgacacagctctgagggtgaggtcaccactgaagactcagacaatgaatgtcagcctgtgccccagggactgtgccctgcctgcctccacaccttcaggggatgagaggagacaggattgcaggggctcagagggccgtgtcccgttgcaggtccaccatgcatggcaccaatccatgcatggcaccaatcccaaaatggctcctggagcccacaccccttccctgcgctctcacctggggcccaagccctcccaactggcttttcctgttcctagctttgtgtggtgcaagttccccaattatgcccacattatctcagccactgggcagcctccagcagcctgggggaggggtggggagcacccaattatcctgctggagagggcctagggcttagctgcttgccaactagcccgtcagcaagagtactgggccgtctggcccactgacctcaccatggaactgtatctggagtggggccacagctgcactgggctgtcatgagacagttaggaccaggaggaccactgggactcgggaggccagtctgctgccttacagaggaggaagctagggctcagaaaggggaggtgactggccacggtcccactgcctgctaaaggcagaggcaggctacagcccagccttcccaactcgtggctggatacttctcccatcgtattcccaacccatggggcctctgcccagggagcatcagctccgaagcaccccacaggctggcagagggaacagctggaggagtgagagtggggataggcctgatggaccttgagggctgtgtggatgtgaatcagcacagagaagggggaacctcagggaaactttcagaacacggtagggcctggcttggtgaagccaaagatagacttattcagcaagcatttcttgagtagctactttatgctgagcaccagggatactgcagtgacctagagacctggcctgtggcctctcgagcggaagagaggggagcaacttactgcactgaccatgggttttggggccctcagaggagcctgtgttgctacaatatccccgtcacgctgaggaggtgagtgagcataagccccaaattcccactcttggatcccagactcccttggggggtcatttagatcctccccctgccttgggtcagtacaggtcctggtgttattaatgctattgatgacgctcaataaagtgagtgaagtaaggatacaaagacatgaagtatacaaatgacagcaaggacacggcttgtggggagttgcaggactcaggagagagctggagtgtacagcctagtgctgaggacaaccgccccacgttaagggagctgagccaagttcaggggtaaggaagcccaaaaaaaggacattctaaaggggataacacaacccatgtggagactggagggaatttcactccctccttcttgcaaatgtctgctctcttgacttccattgcaatttgtgtagtaacaaatatttactagcatctgctatgtgccagatgctgcactgggcactggggatacagagatggaaaggacagaccctgcccttggaggagttcacagtctggtggagaaatcagatgtgtaaccaccaccttccaaggcaggaaagaaccaaggtagaggtggccaggttagctctggtggggaagatcagggaagctcccaggaggaggtggcctcagggggccatccacaggtggagaaggggaagggccatctaggtggagggagctgcctgggtaagagtctaggagtgttgggtggataggctctgtgctccatggaggccgggactcaattgctccttgatatgacccaaatgctcacactagatcctggaatatgtcactcggcaaatcgtggctgaataaatgggaggaagagggaaggaaaccgggaatgtggcatgttctgaggatgggcccagtctggtatggtgggaaagtgtggctgatggagagatgtggacaagaggcaggtgcaaggaggtcttgccaagagaaggcatttacatttggctgtgaaggccatggggagccagcggaggcctggccttatgcagtgcccacttccctctgcctagctgggtaagaggggcccagctagtgcaccccaggggatggggactcagctgcgagggagaagacagcaggggtggccatgatgacagccaccgtgggccttcaagctcatccagagcctcctgcctctgacgcaccttctcgtccatcacgccatttgtttcccccagtaacctcgtgaggtagagaggactggattctccaccccatataacagaggaggaaaccaaggcccaggaagacaaagcagccagtgcatggctcctaggctggggctctgctcgaaaagcaaccaaaaatgagggtgcagacgtatgtttactaacacagagtgatatttataatctatccctaagtaaaaaagcagcttatgggataatatgtacagcatgattctgactttttaaaatagatagatggttatgtggatatacacagatataaagtaaaaggagatagatccttcaagattatcctgagcggaaggatcatgggatgttgtcactttcttctcatgatttttcagtgttgcctagagtgtttttataacaagtaattaatatttttacaatcggaataaaaacaataatgactgctataaaagacaaggccagagcacagggaactgtgtgggtggggggaggctgtgcctgacactgaccacttgctgccatcctcctggccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatgggtaagctgccctgggccccctccctgttcatccagaggcctgtgacctcggggcgtggccatcctcaggatgcctcaatgaccccagacatcccccttgggtgggcatgctgccatcattctaggcatgaggcttccagtcccttctagccaggccaccccacaattcactagggattaggggcaggggcttatctctagacagtggggaacgtgattcttcaggttgaagcccacaaggcactgtgctggcagcagcatcagacaccacggtaaggaaaggagccacctgcgctgcttgccttagacatgctgggactccaggaggcctaagctcgatgacagggatatgactagtagggcagggaggacataacgttagacatgatgaacttcctgcaagaggttctgggacagtctttggtgccgcacagctgagaggcagggatggccaaggggacctgaagacaaggcctgacggatgccacgcccttttggccggtgcatcttggacaagtcaacagggctagtcccatcactctctctgcttcctcgcagccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtgtgagcagggctggctgccaggggcctcctggggtgggcgccactgtccctcctccctcctcctctcctttctcctccctttctctttctgggggtgctttcttctcccctcctgtctcccctatctcctccctttgctcgttttctctcctccttccctgtcgccctcctgtttccactcccgggctctgtgattgccaccctcccacccacacttccctctctcctggctgtttccatgccactgctccttccatcccttcctggctgaagttcccttgttctaagtcccgctctcctgacctcaccctcttcaaacatcccttgccccacagatgagcctgaggtaaccattgaggggtttgatggcaactggtacctgcagcggatggacgtgaagctcacctgcaaagctgatgctaaccccccagccactgagtaccactggaccacgtaagtgctgcagggctgaccagtcaccttggaagacagctgactggaccacgggtgatgaggggcaaccatcctacctccaggagcctttaggcagggaagaaattagggtctgggctcagtaagaagcggggccatgagagaacaacccccacccccaacacacacatatacattacgtccatgtgtgacagtgtcaaggtcaatggaacaagctattctgccagaggggtttcctttgtgatctgcttccctccctcttcctaataaagagttttgtcgttttcctttggtgattcagtctgagtcactcccaccccaaccccccagtatttatttttatcaaggtgtccccagggaagccagtgttctggagcatctcagctctttctttgtccctattccttctctctggcacccccagattcttggggaggaggcagcagccagcctagaatgcctgtgctcatggagcacgtgccctgcggcccaccatccccttcttggcctcacggtcttcgccttgccttgccttcgccttctcccctccagccggctctgacagctggggccaaggctcttcccagagaagagctggatggaacacacagaaagacagggacgtggggaaccaaggagaaggttgatatgggtggccaggagacagctgcccagaaggagtctgccttctttttctggggagcagagggcactggtatgccctacctatgatcctccacttcctggaataaaaagtgcttctgaaggtgtgagtgggcagagcctgctggctggtttcagctctgcggacccaggagctgctaggttcaacagaatagctttgtggcctttgagggtcaggaggaaggaagaagatcctttgtccttggcaaatttgcaagtcacttcccacatgaaaaggtcctgtgacattcccagcaaaaacacaaagtagtggaatggaacatacttcctatctcgttacctgagtggcttgtcaaatacagattcccaggtctttgccccagtggttctgcttcaggagatctggggttagaaccaaggcatctgtattattattttttttttttttctttgagacggattttcactctgtcacccaggctggagtgcaatggcgcaatcttggctcactgcaacctccgcctcccaggttcaagcagttcttctgcctcaccctcccgagtaactgggactacaggcgtgcaccaccacacccagctaatttttgtacttttagtagagatggggtttcaccatattggccaagctggtctcaaactcctgaccatgtgatctgcctgcctcggcctcccaaagtgctgggattacaggcgtgagccaccacacctggctggcatctgtattattaaccagctgcccaggagaccaaggaccaacaaccatgagacgtgaatggaaagtagaaagagcactttaccaggagtcccgagaattggctggagctcccatgctgctgcctgctagctgtggttccctggccttgaacctcaggtttcatctgttaagtgggaccggcacctacctagcctgcctatattcccatattatgatcaaatatgaaaagctgaataatataaaactaccaagtgaaagagattattattattatttttcttccttcaaagacagactctaccacacaagctcagcaaaaggctagggggcctggagccaagtgggtgacccaggaacagcttcttgaggctggagagtcataaccctacgctgtgtctcccacttcccacaggctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacaggtaggaagctgcatcctccccagcctctccgcacccacgggttccttcgccacctgcatccctcacctttgagcaatgccactgcaggaagattatctccttttcctgcttctctagttctcccttgagctctggccattggttttgctttgcttttctctttctttcattaaagggtgcaaatgagacagtcagggtgacccccaatcagagaggggcaggaggaaggctctgagagggaagaaggaagtgctgtttacagcaatgctgttttgggggccaatagaacctgcccgtagatctgccagcagaacacgctgtgggatgctggcatggtggggataggtttgcaggtggagctcatctcctccaagctctgcacctgtggtcaaggacctcttcatgggccagaaagtgaggcttacctcaagcagggagactggagagaaagcgaagatgtagcccaaagccatagtgctttgtgtgccctgcaactgagctttccctgcagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaccctgacctccatcatcatcattattattaatggaagcatcaaaacaagtccacacaggggtaaactgccatcacaacttcacatggggagcgtcttttacagtggacctgagctatctgcagggtgacagggtgaccgagtgtcttaaaaaaggaagtggtgtcccactgtgactgagatataggaagtaacatgctcagggacacagaagactggtcggcagttgctgggctccggccacaaagccactgcacacctgcaagccacgaggattcatgagctctgagccagtgtctcgggagtgggagacctcatttgtgggtatatttaggacacagctgcagaaagagccacgtgaagttgtccagggtctgcgcctacctgtcctcagagccgttctgtcacgtctctcacccaggggcgggagtgtggagccacctgctgttgtctgcaatccctggccttggccccgagactagtcataggaggaggagcatcagggttggagcctggggaaagctggggggtttccacgggttggcaggtggaaggggccggtgtcacacacttctccccagcggggaaggtccaagtacagctcaaaatgagcctcatggttacccaagctccagctctgagatactgggggagtcaagggggaggtgggaagggcagggcctgtgttccatgtggagtggccatagggaacatgaccacccctcagggaggcactgtcacatgggagacagcacagacctggcctgagtgttcacacactggctcttcctagctgtgtggccttgagcaagtgcttcacctctctgagccttggcttcctaacctctgatatggggatactcacacttgtctcaggcttcttacgatcatgcagtactccctgcgtggtgataccttcccctgatggtgggctatcaacatgtgaggggtgtgggctgggggcaggagggccgggccacctagggtcccagctggaagagggacacaacatggctcttgctggcagccccgttaggcaggagccagggacgcatggcactcactgaatcattgataggcccaggcgctgagcggctggcctctctcggaagggactctcagccccctccagaggactcagggagttggcctgagccttctcagggctgtttgttcttgtgctctcaggcaatttccaagcagcagctgacctcaccaccctccattccacgtcggcccgtgcctgccacattctctggggagcccaccccgcagggcacagccatgcccttgctctaagccccactggtccagagggaatgcatgagcgagagggataagtggaaatttaatttttcattctgggcattcgttcgggtaataactttaccctgggcacatctggaaagggaaatgaggagtgactggggcagggcagaaggtgggcagcagggggtgtgctggagggacacgcatatgcagaacacgtgtgtgctgggccactgcacacctgcgcagactcgctttggcatggcttcttggggacctgggcccctgaggaaggagcactgagtggttgctgggagatgagtgagtaggcagggctggagggcgggatgcccaggccagggaagcatgggaaggaaaatggctggagcagagtgggcagggaggaaggagcaaggccttctctctgttggccacagggagtctctgaagggctctcagccaggaagcaccgtggcgaggtgtgtgggttagactgagcattcagggggctgtgtggatggcaccggcacacccgttaggagctgccaccatgagtgagtccctagtgggaaacaacaggcccaggctgtggctgtggcgatgggggcaccgaggagatggaccggacagaatctgtgtgtgcttccgtgggcacaggccccagagaacccctttcagaggcccttacacagaggagcagtttcatggggtgggcccagtggtcacaaaatgaagctccctcccttctccctctggggtaatgacaaggtggggagaggcccagggtgcagcctccaccagactgaaaaaaaacagatgaggcagcctctatccctgtgggtgtcgggaggagacaggccaggcctctccagctgggacccagcctctcgccactcccaagagcaggacagggaggctgccagggtgtaggatgtccatcccagggtgcagggcgtctgtcccaactcacatttccagtgaagcccgggctcatcccttgcaggtgagggtcacagtctgcccatcagtcctggagttcttcagacccagaattgcgggccttgaaggccagtgtcctggaagggaggcaggtgtgagcctgcaagtgtgcatgcccagccatggtatggacatgtgtctctgggcatgtaaatgtgaaccagtgtgaacaggctccgtctgcatgctgagtgtgcatgtgggagcccgtggctgtgccgtggcaacgtgccattctctgagccagcgaatggcagtgtgttgggaggtctgagaaggcagctgcatccgtgcctctgggaggattcggttctcccccagcttgccgaggccctgcctgatggtctgacacgaggcacagctgctgcagctgcagatggacagaagggcttcccagaggtggaccccaggcctccccactctccctgtggctggctgcactgcatgctggggggtgtagttcttgcagcttccaggcctaatctgatgccggagcatttcctgcctgaggaagcgccaggcattggtttcggaggcaaacccaaacattctctttgaccccaaacctccagatcctagatccagactgtaagccctaacacttcactccacctcagatctatccaaagcccccagcaccagcccacccacctcagtcagagaaccaggaccccaaaggcatgcagagcccccacttccccactgtcttggccagccagggaccccagaagagaggttacaacccttcaggaatagggacaagctgctccctttgtaagaggatgtgagggaggctggctgggcccctgccagcaaacacaaatgaccctgcagcctggctcttctctctcctcccagctgcggcccttgcagctctgctcctggcacagagacaggagctactggctgagtgtaacagctggagggatggagggggaggggaggacgctccactccacgccagacagccccttctgcttgcaaatgagttagatccccatgcttctcctttcttctctccctcactcagtatcctcactcgaaagtctttgatactggaaggtcatcccagccattctgctgctgctacacaggcccagccctaaacaaaataaccggggttctttggtcccaaaagatccccaggaaagagtaaacctccttaagacttaaggaaaaaagttggctaggcgtggtggctcacacctgtaatcccagcactttgggaggccgaggtgggcagaccacttgagatcaggagttcgagaccagcctggccaacgttgtgaaaccccgtctctacaaaatattagccgggtgtggcagtgcgtgcctgtagtcccaactactcaggaggctgaggcacaagaattgcttgagcctgggaggcggaggttgcagtgagccgagatcgtgccactgcactccagcccaggcgatggagcgagactctgtctcaaaaaaaaaaaaaaaaaaaaaggacttaggaaaaagaattaaacagaaggcctggaggagaaaaaaagcctagtgtcatctggtcccaagccaccacaccactcctcctgtcacccactccagagaaacaaggtcccagtgggccccatgcaggtttattcgagtctctccttacaatacttgctctgcctagaacaaggcttatctctaagacataatcttgccattgtagaattcattctgtcgtccaacagatacttcttgaacattgaccacatgacaagcggtctaggtgcttggtataaatccatgagcaaaacagacaaaaagtccctatccttgtggagcttacgttttcgcataggaggaaagacaatagataaaatacatttttaaaaaatatgtaggctgggcgtggtggctcacacctgtaatcccagcactttgggaggctgaggtgggtggatcatctgaggtcaggagtgtgagatcagcctggccaacatggtgaaatccccatctctactgaaattacaaaaattagccgggtgtggtggcacatgcctgtaatcccagctactcaagaggctgaggcaggagaatcgcttgaacccgggaggcggaggttgcatgagccaagattgagccactgcactccagcctgggcgacggagcaagactccgtctcaaaaaaaaaaaaaaagtagtaattttgaaggtgatattgaggaggaaaaaaagagagtaaggggatcccaagtgctagggaccacacaggtggagtgggcttatgagctgcagttttaaatagggtagttggggaaggtcttgatgagaaggggctatttgagctgtgtcccaaagagagtaaaggagtgaacctgggggccctggggaagtggcttccagggggcagggcagcccgtgcagtgtgtgccaggagtggggcaagcctgcaggaaagcgggaacagatgacttcagaggtggggcggggcgtagggcaagcagagcacgttaaggctctagggagagtcattggagggctctgagcagatatgttacacttcaacaggatttgtctggctgctgtgtggaaaacagtccacagagggaaaggatggaatcaggggagcagttaggcagctattgcaatcaataatccagatgaaagatgagagtatcttggatcagggtggtagtgatggagacggtgagaagagatcaggttcaaggtgcattttttttttttttttttgagacggagtcttgcactgttgcccaggctggagtgcaatggcacaaacttggctcactgcaacctccacctcccagctcaagcaattctcctgcctcagcctcccaagtagctgggattacaggcacccatcactacacctggctaatttttgtatttttagtagagacgaggtttcaccatgttggtcaggctggtcttgaactcctgaccttaggtgatccgtccgcctcggcctcccaaagtgctgggattacaggcatgagccactgtgcccagcctgcattttcaattataacttacaaactagttgggacaccagtcattcctgtgaaacagataagaccgtacactctaccatactgcaatgatgtggcttgagaggtccagaaaattcaacctagttgaggaagatgtaggagagctttattttttattgggtctctgctgttgaagaaagcacaaatgtaacaatagtgagcttatagactactgcaacacactgaaatgagtcaatcccaaatgatcatgaggctgccacttcctcaaaccctgtcctcattcctgcagaagagaagaactttagccatttgaaaactggcagaaggaccagagccagccatggtaacttctaatttgcatttatttgcaatttatacaggctttaccatgctatgtcagtatgtgattaatggaatgaccttagcaattgtcacaaccagaatgagaggtgcagaccattagtacataaaaattcgaaagagaaaaagatcacggtaaactggagaagagaaggctcctgaagaaggggctggagaagtgcaatcggtggggagggaggatgaggaaaggcactcctggcggggcaaactgcatgtgtaaaggcttgcagtaaggaatcaacttggataacaaggacagcaaggaaggtgagttgaccaaacccaagatacggttgcatgatggaagctttgaaggccagactgcacagcccaacaggcagttggggagccattgctggtctttgagaaagcgagtggttgtgtctacagagtgaagattaacctggtgactgcgggtggggtgattcaaggcaggcagaggcaaaaggaaagtgggagatttaggaatcgaccacagcagtaaaacctggcataagttccatggtggtgacagtggcgacaggaagttgtatcgaatggagagggtttagaaggaagatggcaaaccaggttggtacagatgggttttgaagtggtggtgagaattccaaatgagggtgtgctagaggtcagtttttctaatgtgtccacctagatatcagttatgtgagactgtcttggaggcaggaggtatggggttcatgttccagtatgttgggaaacatggcatttgacgtgtccctctagtagttcacagtgtgcacgagaaggtaacaggctctgatgcttttgtctaagccaacatctcgacccccctatttttgctgaccctttgagccaatggtttgagattccatgggccacagtttgggagatgctgtggagatacagtcccagagttgggcgagaactatgtaccctaaataatttggacagccagcaggataagggtgactccagaagttgatactagtctgtcactaggaaagaaagcagagggtcaaggctgagggtcccaggacaaagcgtccagcgagacagctggaacagagaaaaggagcaacacagctggagatagcactcagagaggaaagccgagaaccacggaatcttgtatgggaaggcaagggacatgtttcagaaaaatggcagctccctccatctggatgcttccttatcctcctggcctctccaagtccggcctcctccaagaagccttctctaatgccaagacacaccaccccgttcccctgcaccctgcacttccctgcctgttcccttaacatctgcatgtgctgtctctgagtgtcctttgcttccctggggaggctgtgagtttctcatatcccgtgactagcaggatagatgctcagtatgtttgctgatgggagggatggatgaagagaggaaggcaggtgtagacaggagagatcattcagatctgggtgagaaccgaggaggggggcaggcaggctgagtacagaggaggctaggttcttcccagctgcctctggggaacccctggtggaggctgctcccatctcgtggggagcagttgcggggcccttttgagggcggtaaacagatgggacctggtgagccgggagatgcttgaggttccagggaggctgctgcggagacaggcggtcaggacaaagatcccatggatatgtactgggcagctgctggctgacctgcaccgaggatggtggtggcaggtggggagcggggtcctccatggcagtgctcctctgccagtgcccacgtgtataggaacccctggggggtcctggctcagccgcgtgaccttggatgagtgagtggcctccccttccttgggccctgtgttttcgtcagcccttcccgcccaaattcctggaaggcctttcctctttcctagaatctccaccctgctgcagcctgccgagtgggatagcaccccacacacgccccaggaggagggagtgggctcagggaggagcatgattcccatggagtgagagatactgaatcagagagtgagctggcagcagtatacaggcaaacagtatacgggcaaactggccctttacgtgggcctggagcaaggagggcctgagcggctgaggtcagccttctgggcttgccctagacccgcagcctagtggctctgaccgaggccagctgtggtctctggtgccaccctgtggtggtgccaggaaccatttcccttagcctcaccttagggcctctttggcccgtggcatggccctggtttcagccaccttcccaggccctgtaaggcaagggaaggggcagtgttggccaaagaacagtactgtggcccggccccactggcacagaaagccacccacccagccttctctcctgtcccacctgcttcctttctcttcttttcacctttcctgcctcctcattttggctgtgtccacggggcatacagatttgcacactcatgttcatcatgtcggcacaggcatgcaggccctcccagcatgtgctctctgggtggcaggcttgctatgacggcaagcgtgtatgcctgtgcatgtgcccacttgtgtgtactcgacattgccacgcacgcacacacgcacatgctttcacccccatttctgccgtccttgccctgtgcttgtgccctgccatgctggtgtcttacacttataacccaggctggcagcactgccaggcccccaccttgccctgcaggcccagaccacagccaagaaccacagccctagtttctggcaccttggcagctgattggcactcacggggcatctcctgagccagtgcctgggaacctgttttccctgtgccctgcaggcagacaaaatcaggtgcagaacacctaggtggctcctggttctgggtcttggaagccaagttgatagtgttggggcagagtgactgccaggtgtctggcagaggggtatcagtgacatttgcacacgttctatgtgcaggagaagcaacgatgcatcattgctgggtggcctcaggcaagttctttaacctctgcaagcctcagctcctcagatatccaatgagaatgaatggcatacctcctcagggttgtggctgtgaatggcatggagtgggcagtgtgctgcagctggaactggcacacgtgtctcactgcaccatgaatagggattgagctgggccagcaccacaccaaggacagtggggatggaagaccctggtgctgtgggtactgccctctgcctctcctcttgcctgtctctcactccagctaccaacgctgcggcatgttagggctccaggatgggtggagtgctgcggggcctcgaactggagctgctcaaacctggggtgcagacagcctgtccttcctggcctctcctttccctgcctccctcccaccccctctacaccccaggagcacacgctgatgctgtcccctccatctcttttcctcacccagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccccgcacgccccctgcccaccccccacctcccactccaggagctgaacagagacttgcccagctgcccaaagccagccccgaactcctggggggccaggggagcccagggcagccacgacttggctttgtgttttatttcctccctctcctccgcccttccccatggtgttgtgttcgactgtggctttagtgttactgtatcttccctttacgggccccacctgcctgccctctgtgtagggagccctgttctcgtcttgtgtacctgggcatccctccagggtttggggagccagcctcccccgcccccctacactggaatttgtttgtgtttcttcactgggggtggagggctcaaggggctctaagagggaaaagctccccacacccccagatgctgctcctcctcccggctagagggaacccaacacccaccagtgaaatctgatgcagctgggagtttggaccttgggtctagacagctggtgcgcccaagaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgaggagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagccccccaacccctcccctcccctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttc

SEQ ID NO: 17252 - DNA, 13866 bp, Human
ctgggtgagctccaaacaaagtctccaaaagaatcttttgaaatctttgggcaagtctctcaatctctctgaatcacaattgcctcatccaccagaacagataacagtgcaggcccctacttcactttggaatgggcatgacacttttctagccttatttcccatacttggtcataccctcacatcaggtctttattccatgtaaaagatttgctgggaaggcctttgaggggcctcttcatctttccacagagctttccattaaacagaggcaaaattaaaccatgtcctttttttccatggcactctgaacccttctcatcatgtgatctattagaattacttatctatgtatctggcccacaccactgagctcctggtgaacctatactgctccccttcataaaatataaagcaggtggctcacacaaaatacactctcaacaaatgtggaatagaaggcatgattcatgattatttcattctactaaatgcatgatattatttggactacgcactgtgatataccattaaaaataagtgatttttaaaaaaaaatttccagaattaggacagatgcactgtgactcacgttattattattattatcatattattattattattattattattattattttgagtcggagtcttgctctatcacccatgatggagtacagtggcatgaccttggctcactgcaacgtctgcctcccgggttcaagggagtctcctgcctcagcccacccgagtagctgggactacaggcgcgcgccatcacgcccagctaatttcctttgtatttttagtaaagatggggttttgccatcttggccaggctgctctcgaactcctgacctcaggtgatccacccgcctcggcttcccaaagtgctgggattacaggcatgagccactgcgcctggcctgacctacattcttaaaagggctgtgttactgaaacaatcaggaaagaatcatatctccaggtgaaggaaaatgaacaatgctttttctcttcctcaagtcaagaaaaatccagttctttagttgacagtacatccaagttagtcaaattaagtagcttcctgtctccgcttcattttatctacttgtcatgattaaatatcctactaggttgtaagtgggccctcaacgctgacctttttatcttgggatttgagaggcacagtctagagcactactcttcacctaaatgccagtatgccaccagtagaaattatcctttaggctaaatattgttcttcccagaaaccctcttttcaaggatcagtttaaacctaaattcatcagagaggaaaacagcagatttcagagtcagatgaagaattcatatccacctggctttgaacattatcggctgtgagatggtgtaggtaaaattttaagtgcataatttggcaataataaatcatcaataaatattaatgttgatgaggcccctgggccacataaagaaatagggagtgaggggatttgaaattctggccacttcacagaaatgggtgggaaggggctcttgattgagttagaagcccatcctacatgaagcaattcctcattaagagttctctcgtcctttatccttgttggaaacatcaggcaaagtcactcttggtcttaaagtacttttacatctaaatacggaactcttctatttaatccctgtctgttgtagatgttaagtatacaaagaggttgtcagagtttgaaacatctggacttctgtcaggtactagctccggaactccagtcctgctcgccctcaaaaacggcttgcagctagaggtttaagttccacttcctctcagcgaatccttacgcacgagggaggcggggcgtgtgtcctccgcgcgtggttttcgggtagcaccttctggggcgccgcctgcctccacccacggccgggccttgacgtcatgggctgcggccccctcccggctgagcctataaagcggcaggtgcgcgccgccctacagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggtgaggattcaccggcgctgaactgctgggctctcctcccatggcaggttttgcctcttgagtttggctcttgcttctctaaaaatcgccctttagttcccccgaccctgcgccgcaggaggtgatcactgtagctccctccctaggaggaaaagagaagggcagatgtctcaaacgtccaggacaaggtgtcccagagaatcgctgtactttttctttagttcagctgagaagacgggagagatcatttgaacctaacccttcgtttcacagattaaaagattaaaaagaccaagatctagagaggtgaagtgatttccgcagatattggacccagcagtgtttgctgcctcctgcctaattctccatctctgtctagtgatttcttctttaccttcctagagggacttagagtatcccggcgagaggttaaaagcaccactctgatgctgttttattgagacctaagaaaaagcaagataaagcagtggcttaactctgggccccaaatcttacttagtactcagtttattgtctatgtagtaataataataatgataatgaaaaatgacaataataatcgatataattaaccactgtttatattattttaaaagattatcttttaaaaatatcttttaaaaatatgaacacatcttttaaaaatatgaacacatcttttaaaaatatcttttaaaaatatgaacacatctgaagaaaatctgatatttgtatctaaaacctaccgaaataggccaggatggcattctagcaaaaaaagaaatgcatttggaatgtgaagtgatgggaatttttagacattacccatcaagtaattgtattagattaatttgccaatttggcgggatttttttgatgtggaaattaatgtggattatctgtggaaaagaaaaacttcagaaaagcacttctgtaattgggacagctgaatttgcttgctggcaaaaatgtaaagtttctttcatagaaatgactcaatcacaaacaatagcacatgtgcaataactgctttgatgtcaaaagataaacttttctacctaacacagctgactcgaaaggcaccctactttaccttttcttttcttcccttattccctcccctgcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagaggtgagtaggggataaagcaaaaatatggcctgtgagatgtgggtttatatgagcaaagctgcttcagaagtaaagctgctccccagattttctagtggctttattgtatatctgttggatagcccctaggtaaactgtgacaaaaagaaccataatgtgggcacatcctatatggccagagtgatcataaatggtgtatgtctcatttttaaacctaatcttcacaatgactttaagtaggaattgttatcctcattttacagatgtgataactgaagccgaaaaaggttttgctctaggttctacaggtgacaagcagatgagctagaattagagctccagtctgtttgattctatgcagaagagacactaagctctttcccactatgctacatgacccccattctgagagacaaatttagacattaaccattcctatctactttgtatcttagcttttgtatccccttccccaacaccacccttccccagataactgcattttaacacaaataaggggacaaggaagtaatgggacaggaggcattagactttagcgtttaagtactaggtgatgagaagctgatggaataataataataatgccatctggaaatattaaagaagggtgaatatacttagattttgtattgctaaaatcactctttaaccccaaatcccatttgttagttatataacccatggtttctttcactttcctgttatctcatattttaaaaaggccctttgcttggagtgaaagtaccaaagtaagagagaaatattgcatactttggagtctgaaggaagaagaagttaacagtaaataagatctaaatatcctaagagcatccactacagaggcagggcaagatggtttcagagctgttgaaggccttttctgtcctgacttgagtttccctggcttctccccctcttgtctggttctcagaactggtgaagggacatcaagtggtaccagagggacagtgacttgggtgagtgggaagtgagaaaacctttagcgaacactccacttaattcccttccttctcaaagtgtgcttttctgtgaggtgggtaaggggttcatttgtgcttatttttgaaggcatgagattagacccatcaaggtgtctagaaactgttctcttaaacatgtttcaagttgttaacacttcagaaggccaagtaaatgattagtagtacaaatgatgactagtgctcaaaattgcaatgcattgtgaaatagagtgaaaatgttggctgaacaccttcgaaaggctaagttaaatgtccatgatgttagtgcttatcgcaacacttcagcatagtgacttttttatttgcctctgtctatagtttgtaatctatctgacaaagtgaagttacaacgttcattcaaaatatttctcttaaaggacttttctgtcttgtgcttttttatcgtcagagaaaagtttcaatataaaaattgcataaccacctcttaaacatttgctactaattttacttttgttaaatgttattataataaactgctaaaatactcagtatttattttccatttccttaatcacagatattctatctttgataccctagttgaccttcactatgtttctaatgttttgtattgaatgggtgctgcatgaccattatgactaatggtattttctctttactgaaatctgtttgctaaatattcacttggataaacctcttcagacattagtgtaacaaaatgcacagcactaacatgcaaagccatttgctatctttagtatgtgggtaaactacaccttgcataactgcaagactgaacaaaagtttctgtggatcagataagataaatctctgaagcactgaatacaaatattcctgggctcctgttttcaaatagattgaccacgaaaatgagctccatggaaattatcaatttgattataatctgttgtaatctgggtgttggagcattgtaacatagagtaactctaatttataattctcagttttttccacctgcaagtagtactcactaattcccaactataatcatgagtggacactactttcaggtagaaaaaactgaaaattataaattagggttatgcagtcctctctaacttttatattgtgttaggtaatgaggcacgcatggctgttacccctgtgagcgctcactgctatgacatctttctctcatgtctctaaaattatattcaagtttgagagactcttgtcaataaatcttttcttttttagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaagtaagttttcctaaagcatatagaattttgtatttctagcaccatgtctgaaacccctaactgcaggaaaccatttatttttccaatgtataaaccaagggtcagtaaactttttgttaaagcaccagatagtaaatattataggcttagtgggccaagattgttacatgtacttaaacaacgaattaaagtgtaaccatttaaaaatgtaaaattggtgggtgcagtggttcacacctgtattcccagcactttggggggccgaggtgggcagatctcttgagcccaagagtttgagaccagcctgggcaacatggggtgaaaccccatctctacaaaaaatacaaaaaagtttagctgagtacaatggtgacagcctgtagtcccagcagtctgggaggctgaggtagcagaattaattgcttgagctcaggaggttgagactgcagtgagccgtgatcgcaccactacactccagcctgggagacagagcgaggccctgtctcaaaacaaaacaaaacaaaaatgtaaaaactattcttagcttgcaggttgtttaacaaaacaaaaaagcagcaaatggctggatttgatccatgggctgtagtttcctgacccctggtataaaccattattttttgtgcatgctcctgcttgctctctctctctctctctctctctctttctttctatatatatatgtatgtgtgtgtgtatgcattttttaaaaactcctttaaaaaaggacctaaaggtaatttttgcataatctttcacattgttttaacctcctccccgcttacctcccacaagcagctagcacattaaataatattggaatgtatcaactgcataacaaatcactgaactcatcagttggtcataaaagaaacacaaagaatgacaaggcgtgtcttcttgaactatcacacccaaactaatctcaacttgttcttatactaatagatccttagttagaatgcattctgtgtctcattatttaaaatacgagtatatggcataacttttttaatgttggaattaaatggttctttatgatctggagagtaagcttaaaacacaccgcacgtttttgtgattataatttttaaatgtgaattgcttgcagatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagtaagtatgacataacttacaaattcttaataaaataatgggaggttaattttttcagtatttctctcatactctactctggtattttagatgaattattatattgtcacttgatctttggtttatatttttatattttattgacaaatatcacagaaagtggtcaatgtttatgacttgtggccaccattgaaatttaacatgtaaagcccttttatagaagatctagaaattttttgaacttaagtaattgaaggttttatttcatgttatttttctactcatggttactttagaatctcagaaaatatttatatctactgtgaaatcctatgcttcatcaagcctcaggagctaattaagacctgtttataggaggttcgtagtatcagacatactgctttgatactaaaaacgacaaagaactacaaatcatcagcagtaaagaatagatatgttttctgctcatattagaatgcaaaattctgagttaggaatattataacatggtactaatttacttagagcttatgcttattttgttactatcgaatatgagaactcaattattaaaaataaatttccatcataagacatggcatagcaagcaaggacaattctattactgtttcactccagcgtatcttccctgtgctcataataacagatcacacacttcacttcatggccagtaaatgttaggactagactgtcccaggtagtaggcactgatgggtgcatcaaaatggcattgtctgtcaaacagaagtcactgaataagggaagctgggggaggacatgaatggctctgtgatgactcatgtgctactagagcttgggaaaagcaagggactcattcttctaattttaggtcttggtaaataactttaacagctatccacttgtgtacatgatctaccacgactaccattcaggaaacaaggggttatcttctgccattgttgacaattattttaaatttagatgagatcatcataacatgacacataaaaattgtttcatcatgcatatcaagtttgatatgtagcttaaatttattttgcacacactagaatttgtcctggttttctagtacctcaaggcagatatgcaaaggtgtttaggagacatactctcagacaaaccattattattttaaaggatagaacaaaacaatcgctagttaaggaagatgttttgtaataattaaacttgtaattatttgacttgaaatatttaatcattttttgggaaagaatggatagattttgttaatgttagcactcttaaaattaagcagtggcttttttccccgtgtctcccatattctccttgtgtttgaaacataaaacaaacactaaacctaagcaaaagttgctgggtttgttttcataattgaggtgagtttttccctcaactattacaataaaagaaaactttttatgattttaatgataatgttttgtggtgggttaaagacctcctaacaacagggggtttttatacaacaacaagaagtttttaaataattgagtttttaaagtggaaagcagcagtaaattaaactagaaggatatattttatacctagaaataaataaagctcaacttgttttgtaagcctgttttaaaaatatttaatcatttaatttgtgcaagtatagagttctcctatggcaaaactataccatcatcttctccaattgtgcatggcagctgtactaagttctgcaaaaacaagacatatggatgtgtttcataccttctcagaattggtatatcaagacacatttaaatataagccctctggaaatggatttatatacagtcaacataaatacccccttagaaattggtaatattttatagccaggtttaggtttagtgtcaagtatagtgattgctggtctatcactactcatgaagtggaaccccctctactcataaaaaccccaatcaaacatatagatgaatagaaccttgataacattagaatgccttgttctctgaaggcttagaagacaatacgtcaggaaatatgaaggagaagctgaggaacgaaagaaacttcgacaagagaatggaaatgtacatgctatagcataactgaagataaaattacaggtttgagttttaaaatatatctttagatcatatcctataattttgaaaaatttaacactatataatctcaagaaaaatatggaatgtgttcttaattatatatacactatgaacaatggctatgttaaagtattattctttgagtataagatggaattcaatgttgagaatagactacgtgtttaataagtattattagggatataaatataagagacactggtccagttctcaaagaagttattgtttagtagataggaaaaaaatgtaagaaaccagaatactagggatgtaaaataaatgtcatgagaaaggaaccaatggagtatgagaagtttccagtgaaaaacagaaagaatccagtagaatttatttagggaagaggaaaagatgtgttcggggtggccttggaagtgaacgttgaaggactagtgagattggttcaagaaactgtgaagggaaagaaagggttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtttgtcagaagaaggaactttatttccttaaacattcaagaaagatgatgtcatttcagttattgattgtctaacttcagtaggtttaagagttacttgagggctgggcacagtggctcaggcctgtaatcccagcactttgggaggctgaggtgggcggatcacctgaggtcaggagtgcaagaccagcctggccaacatggtgaaaccttttctaaatatacaaaattttctaaaaatacaaaaaattagctgggtgtggtggtgaatgtctatagtcccagctacttgagaggctgaggcagtagaattgcttgaactgcaaggcagaggttgcagtaagccaagatcgcgccattgcactccaacctgggcaacaagagcgaaactccatcttaaaaaaaaaaaaaaaaaagaattacttgagatgcttgttgaatatgcatattgctaagcccagccctaaatctactgaatcagaattctatttttaatgtacactccagatggttctgatacttgaacaacgctatatttagcattggttaagtacagatattttgtttttagcctattgcagaattagctcaataattcataaaatgggtaattattcataccaatgctaaactcagtatttattacatcaaaatttttaatgtattggctaattttggtaaagctaagaccaccagtgtgaataaggatggatttttggttatttgccactgagattttttagcatagatcccagaattattttaggaaaaagaatatgctgtgctagcacatagtgggtgcctattaactggtagttactattattatgcccttggtactaattttcctaaattaactatatatcataaatatgctgagacagttaatctttgattttaattatgtccactgcatagatttggttaggaaaactatttctcatgactgctgttgcatttttattaagcagaatttgatgcaacagatttgagcatatgtggacttctactgaactaggtgtataatcaaagcaagtgtgaaagaggaactcaagccgaagtaagagttggtctctgaaaaatcttagcatttctcaaacgatgtactagaaaacaactgacagaaattctgattcctgattatgctttaaagtttcttaaagctctgctggaattgagcttatctgtaacattttgttttattttattattttattttattttattttctcacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagattgagagtttgaatattagttttgatattgcaagactccagtgtacttttctcctaacagttggttgatcatttaaaaaggcttttctctctctttttactgtctttatgttgatttttaaaactcattttttattagatgacattcttcatgggagaattataatctagagtcacatagttctcccacaaacatgagtgtttataataataatcccaaattggtcttacttatccaatgtagaacttataccaagtgctgttaattataaaagcatctagaatcaagataaggtgctacctctctgttacagtgcacctagattattataaaagaaagcaaactcactgcccatcactatgaccatcatagacaatgagagaaaaataagtttgaatattacaagagtgacattttaagagaactaggaagtatttacatttgagacttctttccctaatatcaagacatgaatgtatgaggtatctaaaacccactccttctttccctcctcttgttactattttcttacagtattgtattttaaacaaatgtgtgtgtattggtggtggatgctctttcaagaacgctaaggttacgggatgcctcgcagtttgatgtctggctgatgaactaagttgcctacttacaaaacaaaacaacctttatgatatgtgttgggggatggggaatattaccagcaatcatctcacggaagagaaattcatgaatgaaaggtgcattaagcatcaacaccttcatatgtctctggcatattatccaccagatccttgcccagtgatcatctaaccaatgagctcccagcctcagctataccttatcactacttgaaaagttttaaatgtctaagctcctagactcccctcccagagcctcccatttcaatggactagagtgagttgttggtattaacatttttaaaagatccctagatatttcctatatgcaactagtgttgagcctcatcctagttcactaaatatttattgcaggtgattcaagtatagtgtaagacagaaaagctctgccttcaagacatttaccacctagttagcaggaggtggtatgttttctcaatgcagtgcagtaaataactggctgaggtgtgcagcaggaatccctaggatagctcccaggaagctatcacctagctcagcctgaatgagtcagggagggcttcctggagagatgctacctgaaacttttttgaaggatgaataggagttatggaaacgagactgttataggcataagcaaaattacaaaatcaccaaacaatatgacctgaaagagaaaatacagaaaatcattcagtatcaacctatgaagtcaaaagaggatctaaggaagctgggtggtgagggcagggtcacactgtaggccatggaaagcaatgggaaatcagggtacaaacttgatcagatttgcattccagataggtcatcagaccacagtgctggggagggattttagccaagccaaaggtcagaagataggcttagaagcaattgagctattccaggtgggatgtaaagaacatctgaagctaagaagggaaactcaacatagatttgaagttttataaaaacacaaaaacgtagcagggggcaatgaagtgcacctgtagtcttagctacttgccaggctgagtcgggtggaaagcttgagcccaggagttcgaggctgtagtgtgttatgatcacacctgtgaatagctactgcactccagccttggaaacattgcaagacctcatatctgaaaaaagcaaaacaaacaaaaacaacaacaaaaaaagattaattattatagaaacaaagctgaaagtaatgagataatggaagaagagaataaatctgggatcactctcagattcctggcttcaatggctaggtggctggtgaaatgatttaaagtaaggaatccttgaactggcttgttctatattttagaagggaaacatagcttttcactt

SEQ ID NO: 17253 - DNA, 42672 bp, Human
aacagattagttcatcagaatgccaaaaggcgttcttgatggctgttttaatttattaatatatattaaagtaagttttttggttagatttaactggttcaagaagggaaatcatgtattggttcaaaaataagaaaaaggcagattttagccttcttaggggtgggtgagagccaaggaaacagctgccttgttttaatttaaagaatttagaatatttttaaatttggactgtgtagacagtgagagttctgcagagaattaaacgaagtaatattcacttttgggggctttatctagactagaaggtatgttgaagtgaggaactattttgtttctaaaccgtaggtggaatctccctccccgcaaaaaaaaaaaaaaaaaaaagaaacaaaaaacaaaaaggatcactctcttggataaccattgtgcaatgatccaaatcaggaagctaacagcaacacattattttactagctaatatgtacaccttactcaggttctgtcaattgttccaatcatgtctttgtaggaaaagaaaacgtttccacattcagttgttatgtcttatgtgtttggctggtaccttagtctttgtcttttataacctttcagttttgagaactggttggttattttgtagaatgtcccagagtttgagcttctcttatggtttcatcatgattagattcgacgtatgcattttgggcagaaatctaccagaagtgatgctctgttttctgtgcatcgtatcaggagacatatgatgttggtatgtcttattacaaaagtgttgttttttttcttttgtaattaataaatattttatggggagatattctgaggctatgtgttttgttactcctcaaacttttacctacttttagcatccatttatgattcttgcctgaattaatcattactgtgatgattgccaaatggcgcttttctaattccaacatttcttttttactgattagttgggatctcctttaaggaagagctttcctttttatttacttgttcattccttcctttcttcattcattcacatgaggctggactcacggattctcattttattcagtgggttttagatagaattttacttgtattgatacccttgtaacttttttaacagatcatttgttgtgagagaaaccaataggctgtttccccaaattctaggggtgtgaactttgcactcagtggatcttttcttcgggatcttgttctgggtggaatcaatttgatggtggccctcactacttccagtcatacgtggcttaagaatgtgatggtttaggagcataatacatgggagatacttcctgctgtatttaaaagttaaaatgtggaagtttgatgtccggtccgaagggcgaggcacggacctccctggaccagagcaggttggtggccccgggcggcctcccgttggcggctctgggatagaaaccgcggcgcatttgtaagtgcttgcgcgtggttcctcctcgttgtcctgttgaagttgctcttggtctggaacgcgcgctagtcgttgtctttcagcactccgctttccacaccgcacgcttttcagttatgctttacatttctcctcgacttagatttcgtgagcaaaatggtcccatgttttattttttctcgtgcgtgggccgtcgtgaggctttaaacaggaaactgggacagcacccgggctccgctacccgtcaccgggccttccgcgcccctcgccccacgccgcgggtgcggtcctccctccagcagagggttccgggcgccggcgcggcccgcacggggccgggagcccttcctgccggccgggtgcgcgcggcgccgccgacagctgtttgccatcggcgccgctcccgcccgcgtcccggtgcgcgccccgcccccgccaacaaccgccgctctgattggcccggcgcttgtctcttctctccccgcagccaatcgcgccgggcgaggagctcctggtctggtacaatggggaagacaaccctgagatagcagctgcgattgaggaagagcgagccagcgcccggagcaagcggagctcccccaagagccggaaaggtaggagccccccggcccgcccgcccggccccggcgccacgcccgcccaggacgccgccctgccgccctcgctgctgctggcccgaccgcgaggcgggtcgcgggctcgggcggcggacgcccgcggcatctcggatgaccttttccggactcggccctgccccggccccgctcccgccctgcggtcccgctcgggccctgcgatcgctgccctcccgccctgccgacccggccccgctgctgaatcacggccgccgcgcgctcgggctgtttcttaacttgtgacttagctcctgggcggcagaaagtgcgcggacggcgttccggggccggacgttcccccgctggcaccccaagccgcgctccgcagccgcgcgcacggcgggcgcccgagctttctcgcggctagcttgacagccccggctccgcagactcgggcccgccgcgcaggacgcgggccgcgtcggtcgcggagtcggggtgtgggagtgggggaggcagagacagtgagagacagagacaggaggcggcggggagggcagggagactgcgggtgcggtgggcttccgaaaggatgcccagggggatgtggaagttagagagcgtgttgttttgtcgttttgactcaattctcatagttttacgacttctgatgatttcgaacaaaaggtaaagtgtagtcacacttaaaaagggaggggataatttctgggtaggaaaatagtttggttggctgtatcatatttccagtgggcatactgacacgttggggcttttttttttaatgaagaattttaatgtgaattggggaatagttcatagatcccagtttgaaaatatgccaaggcacagtatggttagtttcttattgatacaaatacaggtttgtgttttttgtttttttgtttttttgttttttttttgctctccttaggtcttaagtagatttctttttagtcatctgaacgaacgagtccatcctttatccagaacattgcaaagtgagttgtggaagtcatactgtaaataaaatcatatcgtaaactcgatttgggaaaatgttaaaatcggcattaaggaatgtaggcaagaagtctgttctgatttttcaagtatgtattctttgtatgtcaccacaaaatggaaatagaattaattcccccgtgaaacagttagtaggcctattactgaatatgcattgtctatttattgaatgtgatgtagtcactgcttcagagcattaaatgcttttgatcctgaatcagacgatcagagtctagaaaattcccagttttttttttttttaacttttaactgagttctgggattttattgctattaggcttagtgcttaactgtttgtagtgaaaactttttatgtaattcaacttgtttctttatttagtattcattttgtttataactaatgttaccagccttccgggtaagttatttgtagggggctggagatggggaggacagtaccctctttactgtgccactaatcataactaactcctgtacttaaatagatttgtagtttaatagcaaccttactttaacgcttttctctgtttggcatactttagtgtgcatgtttagaacatatgtcattactcttttgcttttttgtttatctgtttatttttctcttggttggatttggggaaaaacttgaacatatactttttgttttattagtgatatatgaacttaatagctgcatttttatacctgcgtagactgttggtgtttcgtattaaatagttcatatttcttattatcctattattttgtactactctgggcagcctataacccagaatcctaggttttaattaattaaaagacttatgtttatgcagagctctctgttggaacttacagtctgtttttaacagcttactggttaaagagacctatttgctctttaagacttaaactttggagagtttaagtaatgagtcaaaccttttttacttttaaattaaatactcagttaaaaccaatttatagcttgcaaagacctgaaatggagtctttttttttttttttaattaactcagttctgtttaggtcttatgtgtgacctcaaacatttaaataatatcttttcaggcagtgatgtcagagagtgaatcaacataaatgtcattcagaggcagtgttaacttagtattgctgaaagccgcatgttgaatacatagagccgacaggtagattgacagtgggcttgacttcattttcgttatgagacagagagaaaaacaaagggctgaattcttcatagttctggacctcagctcctttgcgtgacagctgctatacttacagctgtgcattgcatgtggtgcctttcagaattcatcagatcgctggtggatcataaggcgtgtttgggtagagcaaagccctgatttctttatatacaaagtagtggccccttctctctcccctcatcacctttcttctctcccctcccctcccctccccatattcattcattcatctaatgtttattgagcccctgctgtgtactaggcactctgctgggttgtagcacacagtgatgagcaaaaaagcagcggcgactcttcttatggcgccgacaaacgttaaatcagtaaatagctgatcagtgcctagacagttggcatgtagtaggccctcaataaatattcattgattggcaatgactcacacaaatgtgttaggaaggaaaagaatgcagtgctatgagaacacagttcatattgtctgcgaccttggagcgtgcatttttgccatgggccaaagatggatatacatcagcattttaaactggactttaatttggattcccagatttgtaattgagcttcactttttacatatctgagcagcctctgtaaaatggaaaataagttccttagatggaatagattaatctttcaggtagagagcaaggagggtttttagtgtcaggtgtttcaggctattttaatgtgaaccacagaaaaattataattataaaatagcatagaaacggtcaaatttagaagtatttctcatcttcttgatttctgtcccctgtttgttttggtgagaaatgagaaattgaatttgcttgttagcagtaagcaatgactgttggcaaatgctcttccagagtgtagattataatagcagagtgttttccctgctctctcagttacataagagccttaacctgaagttcttttacctggagaaacaacagtggctttctacaaatgggcttagtggaaggaatgaaaaagacgggatgcctgggcgtttaccaggtgtgcgatcttggacagctcatgtcacctttctgagatgaagtttccctagccttaaaaatgaatatcatcatatcgatgatgcttgtgccacctaacctcacaaagttgtcaagagcaagtgagataatagaaacatgctctgtgaagctgtgggctcttgggaactgtaagtaccactccttagaacatggctggcgtttacttccctgctacttgcggaggaactactgagttggtgactcatttaatcaatggggatttatggagcacctgtgtaagcccaaaataagcactgggtctcttctttccctcttccctcctacgtcacagcctcattctgtgctgattcacccttattttaggttctaacctattgacctcgctgttcacagcaaattaagagagaagagtttatagcggcaagaagtttttatacctgaaagctggatagtgaagaagacagaaagtttattacaaaatcggtaatgaattataaagaacaagttccttaaggtcagttagtaggttcagatagtccttcctaaaaaccgtcagtagtgcctgagaatatcagctatagcttataagtatttatctcagcgactcttagtcaccacagaacagttaaattataatcagcttagcaaagtaatattttatctgtctctacgatcagaattgtttaaattaaaaaccttggtactgtgacgacactcaagttttttgaaattgtacatatttgaaattcttctctaaaggtgcgaaataacaagcctttagaaacttaaaatatagggaggtaagacagccacatgcaaagataactcagtctaaggtagtctaaaaaaagtgcaacacggatggtataggcagtaaggactattgaccctccctaagagaaggaaaaagggatgctgagctgggctgggctggccagggagcctttatgtagaaagagtggcaggatggggatgtttcagaagagagagaggaaggaggaggacatcaagaggaaccttggggactgagaagttgtgactgtgtggatggtcttcccttctgttacttaacaagtattccttgcatctgtgtcaggcactattctgggtgctggagtttcagcaaagaactaaaatgacaagggtccctgttcacatggaatcacattctggagagtggggagtacaggccaacagatgaagtaggtaaaccttgtcatgtcagtagtgttttgcagggtgggtggaggaggtatggcctgactgtaggtgggagatcaggggtgaccattctgaggttgtgacataagtgacacaggaagttctaggggctgaggtctccaggaagagggacctagttctattagcagttctactcatgtagaaacctacatcagtatttttggattatgaaactcagttctgcaaatggacatatattggccctttttctgccaggcgctgcaccaagtggctgggttggttggtgggggagatgagagagatgactacagcaggcagcatcctcctccagtgcggagtctccagtccgtttcatgacagccacgcacaggtcagacttagtgggtgttctggttgatgtgggagagaaggaaaaggacactttccaaaattggataacttgtccaagatcaccctaccaatgagtgtcacagtcagaatttgaaccagttttcccatgccttttcttctacataatgtggagctttttgtccactcctacatgcagttgacaacaacagaagtgacagcattggttccatttaaagttgaacttagagaatacatttaataaaagcagagagtggacgggcttccgtggagtttgatctcctaacctttcgtagcagccagcagctctgtttcaggctctaagctgaatgacagaggcctggctgtggtgtctgaggatgatggtagatgggccctgtgcctactgggtgcctggtgggcaggtcctgtgcccactgacttatagggcactggcctgtggttcctgtttgcaggtgctggagcaggatgtggagtgcttggacatggcagtattcctgtgtctggctttttgctggcaagcttgtggcatgagacacaaatgagctgtttctgggttggtcagtcttggaggggcctgtctctgctgtagctttctggctgcctcctagctgagggtgcctttgctgagcattgaatgtcccgtctctggtggttgcctgccaggatgaactctgctgctgttatggtggcggtctgtttttaaaagctcagtacggttttaattagtagtttttcaacagtaggagttcgggaattataaaaaatttgcagttctgctgctgctactgaattgctccaaatttagatgaaaatgttggtcagtattttcgttttgtgcctttgattcttatgtctatccttgtttacagggaaattatgtggattaacgtaaatttttcaaagcattttgcaaattttttagctgtattttagtgggtggatttgcaaaaatcctaacatatgccatgattaaaaagttttaaatatcataattgagtgtattgggaaccatgctgtgccctatttttaggtggttattttggttctcttgtccatatgtaaattggaaggtaagacttgcctaatacagaaataaagttcgattatgattaaattttctaaactatataaaagaggtaacaagatccttatagttagttcaaaatactttagttgatttttacaaatccacttataatttgaaagtaaaaaacctaatttcctgtgttttccttaaatatgaacactaggttatttttctaaatgatgaatttttattgtttttttttaaactcgttcagtgtttttttttccctagacaatttcatgttccagtttacagatagctgttacgacattcaaacctaatgttcgtgggagcattatagagaggagggtgtagttattttatttttcaataaaataacttttaaagtttatttattttgtagagacagggtctttctgtgttgcccaggttggactcgaactcctgagctcaagctgtctccctgccttagcctccctaatagctggtattacaggcttgtacagggtgtagctttgtatttaaagttgcctctaaagaattgaggaattggaggctgggcgcaatggctcacacctgtaatcccagcgctttgggaggctgaggcgggtggatcacaaggtcaggagatcgagaccatcctggctaacatggtgaaaccctgtctcttctaaaaaaaaaaaaaaaatacaaaaaaattagctgggcgtggtggcgggcgcctgtagtcccagctactccggaggctgaggcaggagaatggcgtgaacccgggaggcagagcttgtagtgagccgagattgcgccacagcactccagcctgggcaacagagcgagactccttctcaaaaaaaaaaaaaaaaagaattgagggcttggataaatatcccaagaacaccattgtggaggttaaaaatagacttttcttttagttaaatgttgtatggtgaactgaagctgaagtttcaggtagactggcatggtactttgttggcattcagatggcttgtttatatttcacatgctgccaagtacaggcctgaagttttattttgaccatccatctggctcagagtgttttattaatattcctaatttggttgaaatagtttagaggagctgaatgacatggagaaacaaaagttacttgaaaatgctattctctaagtgaaaaagagaaatactgcaagtagctgtttttctttttgccacccagattaaaccagttttcatacattacaagagttcttggatgaattcatttattacaatgtattttgatgtggacatatgtcatgacttgacacttatttgcacatcatgtcattatgccatgaattgctcacttctgttgatggtgacaatgacagcagttacactcgtttctagcattatgttggttgctctgtgtataccatagctaatcctcccaataatcctgcgaagttgagatccatatcctcatttgtagaagaggaaactgatgctccgaggggttatgtgctttggccgagttcacacaggtcctaaataaaaggctctgtctgtctaaatccagtttttatgcatgatgtttctaagtaggacagttatactgtataaattgcagtgttttatttgctttactaactagccaaggtgaattttcactgctcactgtaagaagtgcccactttaattctaaataccaagactatgattaagtgaagtgtttggtgtaggagagaccagtcatggtgacaccttcagctgtttttgctttggagatttatggattgcataggtatattgtattccttcaaacaccccaaatagtttttaaaaacacagattgcatttttactgctttctagctattgtctttcaagtgttttttaaatgacatatttgttggtttaagtttctaatgaatattttctttctcttaggttttatattattttggcattagttttgaaaccaaaagagcacagtaagacattgcttttgcctaactccctctgcagtgcagaggatcgagtttaggattatagagctctttcattttgtcttattgatgagaagctttagctgtcagctctgcagcactggtcttgtgttgagactgggttaacagtctggttgttccaccaataaaaatacacattttaaagttttcttaagctgaatgttatatagacaatgaacatgctttttaattaatgtgtagtctaaagattaattacagaaactgtaagtgcaattctgatttgtttgtggatataattgagttacatcatgcttgttagtcttttcagctttaggtggtgacattttgttttttatttgttttgccaaaatgtttatttgcagaggtggatagcttttttttttttttttttttaactttcatttaagaggaatgcacatgaactatttgaagcagtaccttcctaagaggttttgtttgctgataaagctttcctattctagctgcttgactcataccagaggagaagcattaaagaagaccagaaggtgaaaagagtcaccctaacctatccatgtgtgctcttgaattttcctaaggaggggcacgcgttgatttcctcattgtctttatcccacaatagattcttagaatatgtatgtctatataaaatttttaaaactgcttgagtttgtagccaaatgtaatgtggctttttctacttggaacttttactgagagtactttatttgattgttaagacttagtaagtcgtagccaggcgcggtggctcacacctgtaatcccagcactttgagaggcagaggtgggtggatcgcctgaggtcaggagtttgagaacagcctggacaacatggtaaaaccccgtctctactaaaaatacaaaaattagctgggcgtggtggtggctggagcctgtaatactagctactcgggaggctgaggcacaagaatcgcttgaacttgggaggcggaggttgcagtgagccgagatcgcaccactgcactccagcctgggcagcagagtgagactttgtctcaaaaaaaaaaaaaaaaaaagtaagtagttaacacccgccccaaccacccaaacatactgtaggcaaggcagaactacagtttgtaatctatgctttcaattttcaaaggtctttagcatttttctttctgttctaacctgttctctgaaaaataggagaaggtaactttgtttaaaaggttaaaacttggtgcgtatattaagaaaatatcctaagggattctgggtaagagactagaaaattctcagtgttctggagcatttattgtagctgcttgctattcctgcttctgtggccatgatcctgaaatttaaaaatattttgatgaaagttttaataatctagtcaacgtgtagttattttagatgcttatatattaaaagtacataccattttttatttttaatagactatttgaatagtttcagaggcaagagatttattctaatgaataagataatgatactgtgtgtgtggtatataaaaataacagtttataagataagaatataacatctaaaatactgctaatttgatacttttcatgactttcaattttatatgttcttgttagtttaatcagtgtctgaatgatgaaaaactaatttcactcttagtgaattagctgtctgttaccagttatggagagtagcaaaggattggccggttaaaaagaaaactaattcagcattgcttaggctaaaattcccctaccctttttttttttttttttaaatgaaaactacagcgataaacaatcttttttcttgtatttataaacctacctcttggggcagtcttttgtagatttcctgaaacaccacatgccagaaaaatgaaggcaaactggtttgttcacccatgtttagaaccccaagacggaattatgtgcaatgtttgaagttgcaatgccgtttagaatgggcaacaatgcagtttctgagccttttgttattctttttaccatttggcctctcaggttcagttttcattctgttgccagtttgagatgtaggatatgcctttctggttctgttggctacatttttgtctttcatgtttgggattatcagagcctgcttctctggaataaagagattactggccataagcagaatgtctaagggcctgtgagaaatgagagttcctactgtccacctcttgtcttggtgcttttgccatgacgatgttaatgttggtcatagctgggtcccaagtcttctaatcttctgtagcaggtttacgctgtgggcagcaccatgatgataatagttgtagttttgatcttttatatgtggaacaatctccttgactgtttacacacgatggactgtaatttttgtaggattagcactaatgttgaaattataatttccctttgatatccaagaaaataaggaaaaagtatcaataataataataaatatcatatgttgtcagtggtctcaatcttggatttttggaccaggggtttaagattccaaatctacttgattttaggaattttgttaattgctaaaggtgtgatccacagtgtccttcccttgttaggtgggtcatgggcttgtttgataagatcaaatttgagtggtaagcttaatacctatttttagttattataaatccaggaattcaggatagaagataatgtaaattactgtttgtatgccaagataaaatttggggttgtagtagagtgcagaaaatattaaatcaagaaaaagtgatacttactcaatttctgtctgacccttttaagttttaaagacaggatcctataaatctcatgggtgattgtcagaaagtacatggaattggtgaactttgttttcatagcaaatgattcttgtgcttccccctaccttcagtttctatgctaagcacattaaaaaaaaaacctgcctaaaaattttttttagtgggtgggaatatactgcttgggcttcagtgttgcttttgcattagatgcagattgatcagtactttgaaaatggatagcttgtttaaaatgagcctggagtgtgcgtgtatgttggctggaggggagagggggaaagttgctgacccagctataccttgagtgttaggagatgtgcagcatgcagaatttattgtgatacaccagaacatagctttggaattaagagaccagattcacataccagctgcaccagttaattgcattgtgacttcggatgggttactctccatgttttggtccttaatttttctgtctataaaatgggaatatgagctacctaccctacaaggttgctgtgagcattaagtgagaacattataggaacattcctggcacaccaacctttggttcatcccattgtaatggtgggcaccagcaaaatacattctgtggtaactgccgttctctggccggttggcacacttctaaaaaaaaaaaaaaatgagcagtttcaccatcttgtgtaacaagttctcttaaaatccatatattttccttttgcatcgtggagtgaattaagtgggtttcaaattagttaagagtaaagggcctgtttggatctgcacctaaatagctacatcgtggcactaaggaattcttcatgtgcaagaaacctgcttctctcttaaaagctgtcttgtttcactgttaaccaaacgaggacacctgtggtgacataggttggtgcattaggtaactcttggaatttgatttgttccatttgcctgggcagaagcaaacacgtctcactgtttgctcgtcttacctttatgtggtccaaagcactcatgacagttataagaggattttatgtgaatgaatttttcttaacattttcttaggtattaaattatcagacagccctgaaagtaattgtgtgggagcagtttcagggctgtatatgacaaatttttttttacagtctttctgggtgtgaaatcaggaaaaaaacaaatggacgaaaggacagttttcttagaaggtgctaattaatttgacgataccagttttccgggaagaaatgtcccgatgatctgtgcagcatcttgactgggctttctgaggagttggagttctttttcagcagtcgcacaggtacattccttctgttgatacacaatgcttgtacaaactcacagcttaactttgtaataacacaggagtccctgacccccagtgttgtctaccaaatgttgtgtttacgtccgtttgtgactggggagaagggccttaggtgttacttgatactcagaagtctcctctccgaaagattaagaaccaccacagtgaaccagtatgttcagttttcaaactcaagcagagacagttaggagcaataaaatcagtaggttacagactttaaaaatgaaatacactcacagcttacactgttagagcattagtatatactgatgtggacatgagtgagtgagtgacagaattctctctaacttctgtcttcattggacttgtacatttttataataatatctgggtgggatcctgtgaatcagcggagaacaaatgaacaaaacaaatggatgaattaggaattgttagtggaagcagaacgccattgtcttcatatgaaggaacatatgccgacaatttagatttgtaggcgtgcactttctgtaatttgtttagtagcatctgtggatactccttacaatcgattccatttattgagtctgtgccaggcactgtgtggcattcgttttgtgcattacctcatttacttctctttgacaacagtatccgatcagtattaccagtatatatcagagctggttcccatctgcctcgaatgggattatttcttgttaatcaaatcatggcccaagggctgcgcagcagtgtttcatgctatttcacttttatgggtatctgtttttgtggaccaaacttaccttgaggacctactattgtgagtgccaccaccacactggggaaggggacaagagcctagcccactgtctcgcctcagttagcgtcagctctttgcagggagcacgagtaaccttggagacacaggaacctgctgggagcaggtgaaatgagtgcataggttgagagaccctttccaccagccattggacgctggcctaggaaggactcctgtttcaagccctagtcctctgtgagccttcctcccaggctcagtttgttccctgtggtcattactttacccctatattggcaaaaaatagaaaagcctcagctcaaggacaatgtgggataatccttggagaccagcaccaaggaagattgtgtgcttctgaaaggctccattctcagtgccagagcctgttagcaaggccaggtccacagcgcgcgctcctcaggcttcccggctttacctggctcccttggtggatggaactttacatcctcccctgcgattatgtggatgatgtgtcggtccgtgagtgctcatagaggcacagctgcaggcaggaggtggctggggcacagttgagatcctccacagcagtgggatctgtttgatcagcagcagtggagctgagtctgaaaacctgtgctggaataaaagtgcctcatttcatggtgggccgagtgattaggtagcttagtatctctgtaaatgctcttgtttttataaacctctgctaaaatgtggcatattcaaatgccgttgcttagtctttgcatttttaagagaagcaaaataaaggctgaggtaaagaatgatgatcacagccaactgccaagacatcgacccttaggttaatactggcaggcattcaacatgattgtttaaattagatatttgatttaaataatgatgggtataagaaccaagtgcggtgaacaggaaaaagaatatggggtatgtggctgtttggaaagaggaaacagatgatttttttgtttgaagtgatgatgtgtagcatggaattgaaagatgtctaccaaaaggttaacagggtaatttgaatgctaagcatttttggctatttaatggtatctcttgtatttttaatccctttaaagtctttataactgtgtgtccattgtgggtttgatgttactggggattgtggtttttttcctgaacggttttcctgagttttatgggtaggcagtagacaagagagaaacacttgagcagtactttttgccatctaggccaagtacaaagtagaggctttttccaaatagcacttgtaaaactgcgtattttacaaaattttaaagtgttatattttgtctcaaccaataaaaacattttcaattatctcattgtttttacttttgttggcgtcttctttatgaaaaatcatgtattcatttttttgtgtgtaatgtaaccaagtgctcatctgagaaaatacaatcagatagaaatatcatacccttatcaatactctctcactgggagccacctgccaaaatctgaatgtatatcctcttgattttccttaaatttatctctgtggatatatcgtagcctgatttgattaattagtcatgtggcttgaccattgttcatatgggcatttctgtaaccaaatgtgaagaatgaattttgagtgttttcattgtatcttgtttcatatttatgtcaaatttttactccttgaaaatattttaaaacgatgttgtagttaattcatcaggatgcagtattgtaaaatttgtcatgggctttaaagggggaaacatgattttcttcttagctgagagtaagcaattctcgagggcgtggctgtctcttctgttttcagggttgccaggtactggaaatgcacctcctctacaacacctcccactttggttttttcagccacggggggctgagtccataagttgaattaggttctttattttgtagttgcctcgtcactatttatatgtaaggttttcagattttaggtacatttttcaggctactaaaaaaacgtgagaaagaaacctagaaattgattatgaagtagaacaggtcagcatcttgtttatatttaattattctcccaaatcattttgttcatgccacaacactttttgaggctccaaagaaggtaaggaaacttaatgctttcttatcttgaatttggtgaagtttgtttgggaagccctttcttaagatgtggaattatccagtcaaaaccactgaaagcctttttctgacagcataaaagctcggactcccttccgatggatctttgctattctcctatcagcctgacatttggaagagttagggtagcctgcagcctccacagctgcagaggctgtgcaacagcccccctggtgggaagcaagcatttcaggaatttatactgcaatctgcagaactgcaaaatctaaaacttttccattgtttctgttggaagcaaaacctagagttgtgttttaataccatgagctacctaaaaccagagaggttttatttttataatttgcctccaggattacagatagttcttggtgactttaactgcagaaaaagatttgaaattatgccaaacgagcttaacagaattttttactgtcagataagtttcaaagttattttaagtgaaaaaggaaactatagaaaatgcatggcatgttaacttttataaaaactaactgttgcagtgtcttactacttcagatctatggggcttgctttgccactgatcgcgccttgaccagttgtaacagccacttgtgatcctctgataaccacacccaccccgctgcaaacctttctgaaagcatttctggttgaggcacactggtgcccccatcagtccttctgcccaagtctcccagttcttttgttaatgacatttgatgacttccagagtaccaagtcattctcttacattaaagcatacattaagaatattgaaatgaactgttaattccttatggaaaacttaattttaggtatccatttccagcttctctcttcctctctatcatcaacccaactgtagaacgttaaactactaggcacatatgcagcagagctgaggtctaattccagtcgaccttcaccatctcacacatagcatcacttggctattcttttgtttttttttttgagatggagtctcgctctgtcacccaggctggagtgcagtggcgggatctaggctcactgcagcctccgcctcctgggttcaagcgattatcctgtctcagcctcctgagtagctggaattacaggcgcggtggtaccgcgcctggctaatttttgtatttttagtagagatgggatttcaccgtgttggtcagtctggtctcgagctcctgacctcgtgttctgcctgcctcggcctcccaaagtgttgggattacaggcgtgagccaccgcacctggcctgcacttggccattcttaagataacaactttgccattatccatcgattcctcttccttaccaacacaatctattacagattgtaatttttaaaaattttataggagtcatttaacatgtactttatacttttctcctcccagttaagccttttcatcttgctttgagaactctaactttactccaaaccagatgtatcctgagtgatactagtgccacagctggcctgctgtcacgaaagacacctttgactttgaaaaatttgaaaggctgtatattataatgcattgctcattcttacctgaagtgcaggtgacggagatgaccttcaaggctctttttgctccagagtgttctggttcttctctcagccttgagcatagtgagttcaacatctaccctgttccctagggtctgtgccctcagcttagtcatatgcttttgtcaaagcctttcttcaacctagtgtgaaagcatggttccagtcttcagtttcctaggaagggccctcttatgtaggggcaggaagaagaggaagactctgcaaaagggtgagattctagatagtagtgtcttaaggctgggacgaggaattctaagaatgaaagaaataccaagttgtcaaatgtgaaggagaaacttggggcaaataaagcctgaagaactgttgggttttgtaattatggtattagtgatagccatgggaattggatgcctgtagagtagagagggtggaaattcagttgcaaggatgaaggactgatggagggcagaggaactggaggcagcaggcacaacccaccttggtgagttggtatcagccctgttgggaagcccgtgtcctcgatgaccattcatggtacagctgtggaaatctcccagttggagtcttgtctgctttggaaccaactgtgaagctccccaagtgaagatcggatggacctaacttctgtgcacagatatttaattctgattttatccttcagagttggatagctccccagtgaggaggcagcacatctagagttacatatagttttaaatttaattcatttaaatcaccaaatgcatgagccttcactgttgtgatgaatttttaatgtaacttgagcaaggctcccagaattttgcattctctctactgcctgaacattttaaggtgaaacattattctctagaatttcctactgtgtctgtccaatttattaggctagtagaacatagtccagacctaggttaaatttttcatgtgacgctttaggcaattttaattttgtaactcatatcccaggcatcagtggtataatgctatacatagtcttagaaaatagtcattatggctgttgaatgtctttgtatggtaactatttcactacaaaatccagttttattgatattactcagtggtgaatcatacttgttcagatcagggttctgtgctgttgacttgtttctggcacaggataaaatagaaataaaaaaaagcattccaatttgattgttgcttttttttttttaaactataaatgcagtttaagtctttgttttgtttttgagacagtctgtcgcccaggctggagtgcagtggcacgatcatggctcactgcagccatgaccttctgaggtcgagtgatcctcccacctcagcctcccaagtagctggcaccacaggcatacaccaccacgcacagctaattttttctatttttttttttttttttggtagatacgggggtctcactatgttgccaaggctggtcttgagcccctaagcttaagcaatctgcctaccttggcctcccaaagtgctagaattacaggcatgagccactgtgcctggccgatgcaagtctttatgcaacttttttcacttgcacttgaaaccagtgaaataatggatctgtagagtgctttgtaaagtaaggtatgctgctggatgccgtgactacatctgtaatcccagcacttttgagaggccaaggcaagaggattgctgagcccaggagttcgagaccagcctggacaacagcaagatcttgtctctacaaaaaagaaacaaaatttagtcaggcatggtatcacatgcctgtagtttcagctacataggaggctgaggcaggagggatcacctgagcccaggaggtcgaggctgcagtgaatcgagatcatgccatcgcactctagcctgaatgacagagtgagagacagagtaagaccctgtctcaaaagaaaaagtatgcatattaagtcattattgatattaagaagtaactattaagagaaagaacatttttaacattttgtccttgagtttttttttttttttttttttgagacggagtctcgctctgttgcccaggctggagtccggtggcgtgatctcggctcactgcaagctccacctcccgggttcacgccattctcctgcctcagcctcccaagtagctgggactatactacaggcgcccaccaccacgcccggctaatgcttttatgtttttagcagagacggggtttcaccgcactagccaggatggtctcgatctcctgacctcgtgatctgcccaccttagcctcccaaagtgctgggattacaggcgtgagccaccgcgcccggccttctttttttttttaagatggagttttgcccttgtcattcaggctggaatgcagtggcacgatctcggctcactgcagtctccacctcccgggttcaagtgattctcctgcctcagcctcccaagtagctgggattacaggtgccctccaccatggctggctaatttttgtatttttagtagagatggggtttcacccaccatgttggccaggctggtctcgaactcctaacctcaggtgatccacctgcctcggcctcccaaagtgctgggattacaggtgtgacccactgctcctggcccttgagttttcattctggctttacagctactgtagtcgtgtgtcattgggcaagttatttcacatctctgccctttgggtgtctaccttgtaaagtgatttatgcgttgggactttgggggcttctagcaaaattgatccattaagtggcaggggcatcagttttacaataagggcgcacagtacaggcccaagaatgaatatactacattggtcttattctcagcaactaagtacacagttaaacattatttttggcatgtgagcaccttgatgcagtagataactgctgttttccttctgttgtattcaatttctcatcttgatgtattcatttcttttcctcatgcacatagtgttgtcctgtccctctgctgttccttgtcatcatttccatttcacttcccttgtgtttcattcctctttcttgtctagaccaagcggagcagccagctggcagtagcgccctgtaggacccccaggacccgatggtaagtgcacttgtgtgcttgccaggcctcccagcggctcctgctcctctgcctcacagagagaagctcacaaatgccatctcccctctgtaaatgtccttatgggtttggttttttcttttaatttgatgacatataggacagaaatcaggtgtcagaagaaatcagtactggtttaaggaaatgtagcaggttccaccgcctgttgctgcaatatttggcggttgtgagggacaccaagcctgtgtatgtgtgggcaggacccctggttctgctttctgttctgccataggctaattacttcccctctggcgctggccttcactttctcccacaaaattgaaggcaggacaggtgatttcaatagccccttcatctctagtccaaggccctcacgatgagacgtaacttaactgatggttctcatgaagattgagaacattgttccaggtgtcagataatctcaattccatggatgaatgatatagacttgtgatagactcatttccttgataaactaagtgtgttggtattcaccaaatttagtttggtggtaaatttagttcttcatctctccatttttagaattggcttattagtgttattcaagtactttttgtagtttttaatacatgtatagaccgtcgagtgtgatccagaaatgcattgatctagtccagtggttcttaacctggggaaatcttctccccaggggacatctggccatgtctagagactttggattgtcacaattagaagggggggtgccactagcatctagtaaatagaggctacaggtgcagttaaacatcttccagtgcatcagacagcccaccccacagccaaggatgatctggcccagatgtcgttcatgctgcggttgaggcgccttggtaccctgtagtggtctgtggcgggatcccctccttagtcctctgataagatactggagatgtacctactgcaaatggcttctcctcacagtggattgggtttccagggtcatggcttttaaagaggacacctggagagagaaaagggagttctcgctgattaggttttgtttgtccaataaaggacatttgacatttagtatcagctaggtgctctaacattcttttaggtagggaataaaacttaaaatagcacttatgttttagacagttatgtgatttcattttgagtgcatcttaatggtattaagattgtacttccttttgttaagatataaatctagacattttacttatttaatactctatttacatgtagaacagtgtacttggctttttatatgacctacagactgggtttgtacaacacttgggaggttgtagaaaaatctttgcatttttttttgcaagtgactgtattacaagaaattgacatcggtttttctattaaattttacactgtggcccttctttaaatgtgtgtgaggtttatgcaaggagtgaaggtttagattacacctctccattttaatttattttaaaagctcatactaagtaagtactaagtaaatgatcagtaaaaaaaggccacattccttggcctgtttggggttacctgaggggtatgtcttataaaaatgtcattgtttgggttcagagaaaaagtttctgaatatgatttttgaatctgtgggctacaccaggaactctctcttcacatggtaataaaagaagccgtgaatttcctcacacatcagttgcagcacagagaagttatgttatgtcagtagtcattatatttgcattatggatgtgggtgggcgataagcattttgtttgctctcagtaatctaatacgggctgagcatcacacacaggcagaactagcttatgtcataagcataagaaaactgatggaaaggaggtagaatccaaattcccttaaacaaaactggatccctgaagaacctttgtcattatctgatttagacaaaatgctgttaagttgacaaagggagaaagagtcacaagaggacgttatgcctgtggaaaggtgcttagatgtttgtgccccttatggaggggattggcttataattcttcacctggagacgtgtgttggtcatctccatgcagatccttcactcttgttatcaccagagtgtggtcccggtgaagtgtgtgctcgttttttgagttccattttaagtgcctttggaaatgaatggatagacaggctatcaggaatttatttgctcaaaccctgataaacgtagtggcaaaaacatcggatttcctatgggctgaagaattaggtatgtaggccgggcacggtggctcatgcctgtaatcccagcactctgggaggccgaggcaggcggatcatgaggtcaggagatcgagaccatcctggctaagatggtgaaaccccgtctctactaaaatacgaaaaattagccgggcgtgttggcgggcgcctgtagtcccagctactcgggaggctgaggcaggagaatggcatgaacccgggaggcggagcttgcagtgagccaagattgtgccactgcactccagcctgggcgacagagtgagactccatctcaaaaacaaagaaaaaaaaaggtgtttaaaatggtattttagaatttacgttttaagactaacaagcaaaatgactgttaaggttatgtctcaaatttttgtcaaaatctggtggtgttttttaggatttgtttttgctttgtattgtatttgatgtttctacttttaatctagatgttttcaatgatgctattttatgtctctgacctcatttttgtctgtttacatttttagctaattatgcttcccggtagtgattctctgttatggagtatgtaactttacgtgtatatagcagctttaagtcgtttttagtttgattttactaatgcagagataaaaggtgtcagaggcttgtagttctggaagctggtggaggtttgtctgggggagagcagcggagaaaaaggaggattgttacggaagaatggggatctgtctggatctgaagactgaaacaccagcttccagaaaaatagaaatctggtaattaaaaaatgtaaaagaaaggttgcaaattctggttaaatcctaaagaaactgggcttctgacttcttcagtattattactcctatagataattgtttcttatcttcatgactttagttccgttgttccaacttatgagaacgatgttgcaatttaatcttaccttgtaaacgtatggtatcacttggaatgcagtcagtgtttctgaattccatcctctgaattgttaatgaaatattgacctggactggacctacagtcagatcccttagggctctcagagtgccatgctggtggacagtgaattattcataattactctgcatttggtatttgagccattgtgaatgtgtatcttttgaaattccgcagaatctctgcttctcttgttttgcttccaacaattatggataatcatgtcttagctaaaagggccccaagttataacatactgtttttctctaatatgcttcttacaaatagccaatccctattagctgtgtggcattgaaattcaatgctattactaattttcctttgacatcaatagtaacgttacctcataatttgatagtcattatagctatgaagggaactaatgcccaagattctcaaaaatgcaagattgatgtgtttctttcttttcccctctgtcataatttacctatataacagagtatttacagtcatcattcattcctttctttaggaatccaaagtggtaattgcccaggaatatacagtgttcttgattggattaataattatcttcagtaattcagaataacacatgagggaatgaatgaatgaataaataaaaaaaaaatgaatgaataaattaaaaaaaattgtgtttcagggaagaaaaaatcccaggaaaataaaaacaaaggaaacaaaatccaagacatacaactgaagacaagtgagccagatttcacctctgcaaatatgagagattctgcagaaggtaagcttgtgatattggcttggtctgaattgggtgtgtatgtacccagtgaatttaactttgtatctctttatattgtccttctgagaatcatttaggatctttacgaggttaaacagcaaaaaagctgcctaaatttaatgtggtaagctgagccttctatatgctaccttcccttcaaacaattgtgaaagacttttcttcttaaaaatgaacttgttcctttgttaaaataaaatgagaccaggtgtggtggctcacacctgtaatcccagcactttgggaggctgagccagaaggatctctggaggccaggagtttgaggccagcccgggcaacatagtgagaccctgtttctacaaaagaaaataagaaaattcactaagatgatggcatgtgcctgtagttctagctacttgacaggctgaggtgggaggatcactggtgcccaggagttagaggctacattgagctgtgatccccccactgtactccagcctgggtgacagggcgagactgtctctaaaaaaataaaaataatgataataaaatgaaacatatgattgcatttaaaaatagcatgaagttcaaaaccatcaaaaaatagtgatagcaaggacatgaggaggcacctggggtgctcgctgttttctattattcatctgtggaatggtcacatgggtatatatatttagtgaaaattttatcttgctatatactcaactatttgtacactttaatacatgtacgttttatacttcaaattaagcatttacttacaatgtcagagactttgatttttgtataacagaacaaaaagtatacagaatgaagtgtgtttctgttttttgttggaatttaaattcttattttgtctcttcgtgtttgtccccttaaaattttctcctttatagtccctctggtgataatattctaggcctgccacgacgtaagaatccaaccaagaggcatggattgaaagttaatcagaaagacagcttgccctctgctcattgcagttgggccaccatattgagactattgatacagaagggaaggaggtgtgtcttaatttgccatgggcaaatttttgcagattgcagcttacttgagttgtttatagtgagccaagtaggcaaatttcagaagacaggtttgtgactcttttaagaaatatttgtagaggaaaataaccagaatattttggatgcctttcataaccatttttaagcactgtttgtgatgataacattcataaaagatataattttctgtgaaacaagaatagtcaagttcatttcccagagtcttaagactaagttctgcctcctcattgcaggtgtgccgagagttttttttgaacaacaaaaattactaaggaacctcactacctttggcggtagaattagaaaacagattcagcagtcacctactccccttcagtaattcgagacaattatttttctcctgacacaacatcaggtcccatgaaaaatgacacttgctggcctggcgcggtggctcacgcctgtaatcccagcactttgggaggccgaggcgggtggatcacaaggtcaggagatcgagactatcctggctaacatggtgaaaccccgtctctactaaaaatacaaaaaaattagccaggcgtggtggtgggcgcctgtagtccgggaggctgaggcaggaaaatggtgtgaacccaggaggcggagcttgcagtgagccgagatcgtgccactgcactccagcctgggcgacagagcgagactccgtctcaaaaaaaaaaaaaaaagaaaaatgacacttgctcttcaccccccagtatttggcacagctggtcaaagtggtgtcgtaggcttccgctgaatgttctgcgttgtcctcagcaaatggtctataccatgagcaaacagttcagactcttctttgtgctcccaaacctccctttatgttcaaaactccagagaccacataaagtgcgtggatccactctggcatgggccgtgcttgttaatggagctgtgcagacttcggtttatgttactttggacagttttatatctgggattgtttaccagtcatggggaaagacattttttccccatcaaaagaagccacagattttgactgaaaataaagtctgttaggaaatttctgagccttagagttggcgttttctgttgtctcatttcaactcttttggcagtattcggggtctctattgaaaatatctttgaaaagagaggtagctcctaatttgaaatatgttactactgtcgaatgactggtttcccactttgtggaaagctcatggaatttatgaaattagtctagggggagagaaggctgtttctgtttggaaacagaaacctcattgctagtaaatggagtagcagatgggaaacagtaattcccgatattcctgggaaacagcaaggaggctaggactgaataagtgagcttgtatgagtaatacttggcattgacctcttccccactgtatccacgcagtccccatgtccagtagcaggcctctcagatcgtgagggtctggctgctcttttctgcctccactgcctcttcccctttccttcttagcacagcagccagcatctccattctcattctgctctgccagtcttgctcctcggcctccagtgatgaccttcccccatcccttcacccaccctgcagccgaatctcccagatggcagtctcctgctttcagataccttcagtggctccccactgtccccagataagtccacattaatttacagtgttctctatgttttgactcttttctgcttgcttttcctcttctgtccttaattcttgtattcttcaggttctgtctgcttagtcctttctctaagaagcctttcctgattaatcaaacccatatgagatgcttccgtaccacactcacttccataaacacagccatcaatgttctacagtttcgttgccttcctgcttgtgtgtggcttgtattaaagtgaagctctctatgggtaaggatcgtgacagtcttgtttacctagtactggcagatagtgggtgctaagtcagtatttgcaagtgattgggggaacagccaggtaatgtagcctggagaagaagtcagaatagctctgcctcctccgtggaacctttcttaactctcctagtgcctgcagtagaggggtccgcttctgcagtgcagcaagtgggactgtcgcgacagcagcattggggaccattcctactagcacgaaaccgcgattacagcttccgtctttaagaatcccctcttgtccctgtgttttcttccagtctcttctccatttctttttctttacaggtaaacttgaaagagttgctaatagtctccctgtctctccatctccttccattctcttaggaactctgttagacatttgtccccactactccacttgctgtcacaatcacaagacctctgccttggcagatggaatgttccattctcagtcctcattttatccaacccatcaggagttctggacacagctgatcatgccctccttgaagcagtttctttactttgccaaaggaccaccactctcttggttctctggatacctcactggcctttcccccagcctcagtcgtggagtcatctgggacacaatcctctcatccctcttctgcctgcgttcacttgccaggtgacctcatccagtccagtgctctaaataccttctctggccttctctaggactttgaaatttctaggccagcctctttgttgaattccagattcatataaagctgtctacttaatatatttacttggatgtctataatcaggtaccttaaactttagcacgtctgaagtaagctcttgatttcccccacaacacgcacatgcacacagaccacagttgcttctcttgtggtcttccaacgttttattagccaggattattgcagttgcgtggaatctcctcttctctctcaccacagccagtcagcaggcatgttgtcaacttcattgacaaaatatatccagagcacttgtagtcccgccctgctgccacccctgtgccaccatcctgcctctcctggaggatgcattgggccccatctttccatctgcctccacccttgtcacctagggttcactatcttccttgtagtaaccagagtgattctcttgaatacaagtcagattatatatttccgttagatctttctggtagctccctgttttcactcaagagtaaaagccagcagcctgcaggggcttgtgtaagtaggcccctgtttgcatctctagtcttacctcctgccctcactttgcccagcttccccacctcacctcactgatgtctttgctgttctttgaatgcatctagtatgttcttgactcagcgcttatgcattttgagggttcctctatccagtagggctcctcctcccacccccccccccaatatttgcatgcctcattttccttaggtctctcctccactgtcaccttctaagcaagtccttccctgactgccttctaccacccacctcaggtgggctaggcctagggactccgaagtgactgcagatttctgttcccttcagtgagatgctcctgagttcttaataacttggctaggcttagaagagatgatctccaaagattgtctagcttgaaaaacttgtgattacatgattctggaaaatgttctagcttctgagaataacattttatttaagagggagagaggatcatttactccagacagacttccaaggatctaacctggtgatatgtctggtaaagaactgtttccagtttggaatcatgagaaattagaatttacaactactcctaaaatgtagtagtgactactccaacacgattttaaacactacagtttctgtcaacagagttgtatctgtgtgcaactaaacacaaaaccccagctccacacggacatccttgtctgttgcgctcgtgtgtgtcctcactgccgggaatattgcctggtacgtggctggtaccctaaatacttgttgaatgaagtggattcatatccaatacaactttgtcaattaagtatataaagtagaagtaatttattgttcatcatcatctcccttatgttttaggtggtaagagaaataacttgaatcattcagattgttcaccaagtagctggtttcccatgcttcacttccatgcttctgcttccatgtgctttctaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagaagatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaagtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggtaagctcaggagctggtgggagggaaagaccgggaaggcgacagtatccttgcctacgggtgttttttggtttcttgttgcttttttttttttttttccccacttaaaggaaatagctgttgtataagttaaaggcatgaagggtcattgctttggctgcttttagagatgaataaatagttctaatttcagacttaggactcacaaagcagtgccacttctttaatgtggccagatgtaaattgaatttaaaactatagaaaagctctcaaaagtactctaagaaaagatgcaatcctctcaaacttcctttatgtcttgggtaatagctcagtgtcatgtgtcttattttccgatcatagaacatttcttaggttaagacgggtcactaagttcattagtaaaccatgttacaatcttgtttaatatttctgtgacttcagcatagatctagtacctgacactttctttcagaattgccaatgcttaaattttaataattgattgcatcggtcaaaacaaaacatagtcctttaaaaaggtcttatgcactgtcccccacctcctgaactcagccgtaggacggtaaacaagtcaggatctggatgggaagcagagcaggagagacatgcttggaactccaggcaggacccttgcagctctttcaggcctgtgtgatacccagggcatgtcagcctcatttgtcagtgcctttgtttccccagtaatgatagaaggatttgtcttagatttgaagtgactttactgctttattccctgtgcttcctatattaagaactgttctcagtgacagatgaagagagggcagcggttaaatttgttacattggattctcaaacttcctgagtcctttgtccaaagtggatgtgtattggaattcctgctgtttctgaatagttcagtctcatgtgaaaattactcatcagatagcatttctgcaaaatacttttaagtcttgtcttttcacaggatgccacctgactctaggctttcatgctatagcttttggtgtctgaaaattctttggtgttttaagcaagcagaattagggatcctaagtgtggacgcgactgccattttgtagaggtcacgaggacacagaggtgccattagccctgcatgattgatgaggtagaatttttaatgctggtgtgccttaaatcacagctaaagatagagaagaatcattagctaaggctgatttgaatgatttactgtaggattaatggatcagatttttaaaaagttacttcataaatgtgttaaatatttagttgccataggtctgaccaacgctcggtctctggccgcggcacatacataggtagcatcttggaggttagctctgctgaaaataagcacctgtgttatcagctgtcaaagctgcttgcctttagtaattgaattgtgcacctgtttgtgctcagtctgtgttctggtggtgccacaccaacaggacatgatcaaattgagtccttttcaagttgcttgtgtcttcaacaagcagagtgtgccttcattttcacagattgtactataaaacacctcccaggcggttgatgctttagaatgtactgtctatcccttttgtcttcagtattatctaaaagaaatgcttgttttgtacttggccctacttacacagttcaaggttaaagttgatttggaaaaattaagttctgcaaagaaaagctgtcagagtgaccataaatttatgaggcctattcaaatagcctctacccagtgtcttttgagtaacctttaaggctacaaaggactaaagggccttaaaaatcatgtctcttctttgccccagttcattttcattattttgctttgtttgatagttaacagagggttaccttgctggagtgaaattttgcctaaaaggaagcacagaagaatcagataagaaaacactggtattgtcctaaccgtagatggtaatgacaggcattggtggcagctcttcctcctctgtgtgaggtgctggaactgtgctgcggacacatctgtaggtcaggaatgtgatccaggggtccacttaccaagtcaccataaacctgtgatgtgttcttgggaattagaaaacagatgttcatcaagatagattttgactatctggacacaaaagtgggcatttctttaaagtgtttgttttggtcttagtactttgtagtgagtttagcacaaaactgggattcctaaacttagacctgggtaatatgatgattgtcattaacgtgttgcccagggctcgtagagaggaggcctcagcctcagtgcatatttgttgcattacactaataaggagttgtttgaactacagtcgtctttctgtttaagtatagttctacttgtaaatttcgtgtagggatgattcctgacacaaggaatcatcacatctattacatgtcgaggaatactcactttcactctgtttgcagcttgctttacttaccctgttgggtacacagggatttcttacagaacaggcagcacatcctcgtcctgtgttatttctttacaacaagctgtgattaagagctagttttccatactcagatattttacatgtgaatgccactttcggattccacagtttttcaagtacatgcttgcaatcagccatatgatttttccatgagttttctacttaacactgagggtcatttcctggaacacaagccatggtgccagacaaggtgtcaaaaagccatgtgctccaaatatttttcttaggagaaaacacaggaaagcaggcatgccacagtcattcaggttctcctgctgcagctcttactacagtgacccaccccccacccctcgccatggctttctggagtgctgagtttaaatctgttgctaagggttcatttccatgggctccagtaaagcagaaagggaaggaaagaggtgtattctctactcacctcctactcatctttcacctttgtaaaccccacggtgtttttgggttctttttttttttttttttttaatgagacagagtctcgctccgttgcccaggctggagtgcagtggcacgatcttggctcactgcaagctctgcctcccgggttcacgccattctcctgtctcagcctcccgagtagctgggactacaggtgcccgccaccatgcccggctaattttttgtatttttagtagagatggggtttcaccgtgttagccaggatggtctcgatctcctgaccttatgatccgcccgtctcggcctcctgcagtgctgggattacaggtgtgagccaccgtgcctggtgtttttgggttctttaatgcttcttttagagccacatttttcttttcaaaccgagttcccatcgcagtcaagaaaaaggtagagaagcaaaatgaaattctagaccaagtttttccacttaccaggaattgatttaaaaaaaaagtgctaatttctcatgcctccatctctgctacatcccttggaaataaatgcgtgtagttccttgcagggtgtgtcttctgggtaggacgctcgttcctaaatgccttcagtcatgtatgtgttgtcgtcttaataacatttgtcttacggtctattcacctttttctttaacatggtcaatcatgtaaggttatgttctgttgtcatttatcttcagttttcttattttctaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaaacatctgtgaaaggactgcattttgtacataattgggagcagttagggggtaaaacaaggtgtgtgtggaggattgttcagagcccgcactctaatttaaaagtgcggcgtctactcagcccacctggcgtctgttcacttgtttctatttgacagtaactgaatatgtgctcattccagttggatttctatgtagagggtggacgtgtagtcagacaacggtgccgagaagtaccttgtgaactcactcgggtaagagtaaaatacaaaataatttcatctgtggggtctctgtgcttcctaaaagtttactgtagtttgtggattgatgtttatttctatgggcttccaaagaatgaaaccaaaaagttgtgacatactcagtttatgtgaaattgccggggttttttaagattaaaaatggctgactataagcggtttcctatagttcatcatcatagcactttgctaaccacatctgtctgtcactcctcagggaaaggtggtgaagggatagccagcttcccttggccagatgttctggcatacgatattcctcccttagaaaaacacggaggagagaggttggtgggaatctggaactggtcttcgatattagtagttttaaacaaatgaggcttcaacacacagcagtgccctgtgaggagttgagtgttgtgagaaagagcacggtcttggatgagaactggatttccatcctaacccatctgctggccgttcatcccttccctgtgccttcagtaaacgggcctccaacaagcgccctccatggctgcgtcttctgtgttttagccttgggcaagttcctttacattctggatcatagttcccagtctgcaaaaagtggggagtagactggctggtttctgagtgcgccctctaggaggagatcttttctcctggatcaagatgctgtcagacacaagcactggactgaaagagtgggatgatggctcggtctccacagtgtccctggctctgcctggaacatgacagggactcagatgtttactggaggagtcaccaaggaaccacatcacatccatctcaccaagggagaagctgccctgtttgggttgctttggctcttctttgatagagttaaacgtttttaaaaaatcaaaagctaattagagccttccatccctgttaccattgaaacatttcacagtgtttctggtaaatgccttgctaggctggctgtcttgtcctcgttgttacaagtactttctagcaagataattttacaaaaccagcttaatgtattgagtacttaatgtatgcctggctgtgttgtaggtgcttaggatacatctctgaacaaaatggacaaaaatcctgacttccgtggggcttgtattttcatagtggcttttttccccactttatacttcatattccaaacctcctcgctgtcacagttccccagaggctaggtggacaaggagatgcttctagcttaatatctgaatgccagtaatctagatgactgccggcttttaatacttagcttaaaatgactctactaaaattatagctcacttaatgcatttgatattttattcatgtgggttttgatttgatattgaacctcgctttgaatatattgacttgaatccataaaaaaaatcataaagggcaatttaccttgaaagtggattagagcacaggcggatgagaaaagggttgactaggatataaaggccacatttaaagtgtttcaaagaccaggctgatagttacagaaaatggtttatcgttccccgtcagcctttacaggcccagctctcatggcctctttcctgcctgatggcaccactcctgcagctgccgcttcaggcagcctcagtgaaggttctggtgaagcactgctgttgagcgtatgttcgagggccttggaggtgtggatgggccattctgctagacttaacaaaacggggagccacaagccctgcccttcaacaccgtgggttccacacca

SEQ ID NO: 17254 - DNA, 42672 bp, Human; identical to SEQ ID NO: 17253
